US012460231B2

(12) United States Patent
Maeder et al.

(10) Patent No.: US 12,460,231 B2
(45) Date of Patent: Nov. 4, 2025

(54) CRISPR/CAS-RELATED METHODS AND COMPOSITIONS FOR TREATING PRIMARY OPEN ANGLE GLAUCOMA

(71) Applicant: EDITAS MEDICINE, INC., Cambridge, MA (US)

(72) Inventors: Morgan L. Maeder, Jamaica Plain, MA (US); David A. Bumcrot, Belmont, MA (US)

(73) Assignee: EDITAS MEDICINE, INC., Cambridge, MA (US)

( * ) Notice: Subject to any disclaimer, the term of this patent is extended or adjusted under 35 U.S.C. 154(b) by 0 days.

(21) Appl. No.: 15/300,991

(22) PCT Filed: Apr. 1, 2015

(86) PCT No.: PCT/US2015/023906

§ 371 (c)(1),
(2) Date: Sep. 30, 2016

(87) PCT Pub. No.: WO2015/153780

PCT Pub. Date: Oct. 8, 2015

(65) Prior Publication Data

US 2017/0029850 A1 Feb. 2, 2017

Related U.S. Application Data

(60) Provisional application No. 61/974,327, filed on Apr. 2, 2014.

(51) Int. Cl.

| | |
|---|---|
| ***C12N 15/90*** | (2006.01) |
| ***A61K 38/46*** | (2006.01) |
| ***A61K 47/54*** | (2017.01) |
| ***A61K 48/00*** | (2006.01) |
| ***C12N 9/22*** | (2006.01) |
| ***C12N 15/10*** | (2006.01) |
| ***C12N 15/11*** | (2006.01) |
| ***C12N 15/113*** | (2010.01) |

(52) U.S. Cl.

CPC .......... *C12N 15/907* (2013.01); *A61K 38/465* (2013.01); *A61K 47/549* (2017.08); *A61K 48/00* (2013.01); *C12N 9/22* (2013.01); *C12N 15/102* (2013.01); *C12N 15/11* (2013.01); *C12N 15/113* (2013.01); *C12N 2310/10* (2013.01); *C12N 2310/20* (2017.05); *C12N 2320/30* (2013.01)

(58) Field of Classification Search

CPC .................. A61K 38/465; A61K 48/00; A61K 47/48092; A61K 47/549; C12N 15/11; C12N 15/113; C12N 15/907; C12N 2310/10; C12N 2320/30; C12N 9/22; C12N 15/102; C12N 15/63; C12N 2310/20

USPC ........................................................ 435/320.1

See application file for complete search history.

(56) References Cited

U.S. PATENT DOCUMENTS

| | | | |
|---|---|---|---|
| 5,443,505 A | 8/1995 | Wong et al. | |
| 5,766,242 A | 6/1998 | Wong et al. | |
| 6,251,090 B1 | 6/2001 | Avery et al. | |
| 6,299,895 B1 | 10/2001 | Hammang et al. | |
| 6,413,540 B1 | 7/2002 | Yaacobi | |
| 6,416,777 B1 | 7/2002 | Yaacobi | |
| 6,586,240 B1 | 7/2003 | Singer et al. | |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,889,394 B2 | 11/2014 | Chalasani et al. | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 8,999,641 B2 | 4/2015 | Zhang et al. | |
| 9,163,259 B2 | 10/2015 | Choi et al. | |
| 9,322,037 B2 | 4/2016 | Liu et al. | |
| 9,499,847 B2 | 11/2016 | Porter et al. | |
| 10,227,302 B2 | 3/2019 | Payne et al. | |
| 10,253,312 B2 | 4/2019 | Maeder et al. | |
| 10,383,952 B2 | 8/2019 | Payne et al. | |
| 10,526,284 B2 | 1/2020 | Payne et al. | |
| 11,028,388 B2 | 6/2021 | Maeder et al. | |
| 2003/0186238 A1 | 10/2003 | Allawi et al. | |
| 2007/0020627 A1 | 1/2007 | Barbas | |
| 2007/0087989 A1* | 4/2007 | Huang | A61K 9/0048 536/23.1 |
| 2010/0055793 A1 | 3/2010 | Chandrasegaran et al. | |

(Continued)

FOREIGN PATENT DOCUMENTS

| | | | |
|---|---|---|---|
| KR | 1020010048693 A * | 4/2003 | |
| WO | 2000/040089 A1 | 7/2000 | |

(Continued)

OTHER PUBLICATIONS

Li et al. Diagnostic Pathology 4:46 (2009) (Year: 2009).*
Cho et al. Nature Biotechnol. 31(3):230-232. (Year: 2013).*
Sheffield, V.C. Project No. 1R01EY024259-01, retrieved from: http://grantome.com/grant/NIH/R01-EY024259-01. (Year: 2014).*
Val C Sheffield, NIH Reporter-NIH Research Portfolio Online Reporting Tools Expenditures and Results (see IDS May 25, 2017, Reference #175). (Year: 2014).*

(Continued)

*Primary Examiner* — Christopher M Babic
*Assistant Examiner* — Jennifer S Spence
(74) *Attorney, Agent, or Firm* — Perkins Coie LLP; Courtney Prochnow

(57) ABSTRACT

CRISPR/CAS-related compositions and methods for treatment of Primary Open Angle Glaucoma (POAG) are disclosed.

11 Claims, 27 Drawing Sheets

Specification includes a Sequence Listing.

(56) References Cited

U.S. PATENT DOCUMENTS

| | | | | |
|---|---|---|---|---|
| 2010/0055798 | A1 | 3/2010 | Battersby | |
| 2010/0076057 | A1 | 3/2010 | Sontheimer et al. | |
| 2011/0059502 | A1 | 3/2011 | Chalasani | |
| 2011/0189776 | A1 | 8/2011 | Terns et al. | |
| 2011/0223638 | A1 | 9/2011 | Wiedenheft et al. | |
| 2011/0236894 | A1 | 9/2011 | Rao et al. | |
| 2011/0301073 | A1 | 12/2011 | Gregory et al. | |
| 2012/0270273 | A1 | 10/2012 | Zhang et al. | |
| 2013/0130248 | A1 | 5/2013 | Haurwitz et al. | |
| 2013/0253040 | A1 | 9/2013 | Miller et al. | |
| 2014/0068797 | A1 | 3/2014 | Doudna et al. | |
| 2014/0179770 | A1* | 6/2014 | Zhang .................... | C12N 15/85<br>514/44 R |
| 2014/0242699 | A1 | 8/2014 | Zhang | |
| 2014/0309177 | A1 | 10/2014 | Perez-Pinera et al. | |
| 2014/0315985 | A1 | 10/2014 | May et al. | |
| 2014/0335620 | A1 | 11/2014 | Zhang et al. | |
| 2014/0342456 | A1 | 11/2014 | Mali et al. | |
| 2014/0342457 | A1 | 11/2014 | Mali et al. | |
| 2014/0342458 | A1 | 11/2014 | Mali et al. | |
| 2014/0356958 | A1 | 12/2014 | Mali et al. | |
| 2015/0056705 | A1 | 2/2015 | Conway et al. | |
| 2015/0232833 | A1 | 8/2015 | Mali et al. | |
| 2015/0259704 | A1 | 9/2015 | Church et al. | |
| 2016/0153005 | A1 | 6/2016 | Zhang et al. | |
| 2016/0281111 | A1 | 9/2016 | Cotta-Ramusino et al. | |
| 2016/0324987 | A1 | 11/2016 | Wang et al. | |
| 2016/0340661 | A1* | 11/2016 | Cong ..................... | A61K 48/00 |
| 2017/0058298 | A1 | 3/2017 | Kennedy et al. | |
| 2018/0291370 | A1 | 10/2018 | Gersbach et al. | |
| 2020/0297634 | A1 | 9/2020 | Karmali et al. | |

FOREIGN PATENT DOCUMENTS

| | | | | |
|---|---|---|---|---|
| WO | 2001/028474 | A1 | 4/2001 | |
| WO | 2002/089767 | A1 | 11/2002 | |
| WO | 2003/072788 | A1 | 9/2003 | |
| WO | 2008/108989 | A2 | 9/2008 | |
| WO | 2010/054108 | A9 | 5/2010 | |
| WO | 2011/012724 | A1 | 2/2011 | |
| WO | 2011/143124 | A2 | 11/2011 | |
| WO | 2011/146121 | A1 | 11/2011 | |
| WO | 2012/145601 | A2 | 10/2012 | |
| WO | 2012/164565 | A8 | 12/2012 | |
| WO | 2013/012674 | A1 | 1/2013 | |
| WO | 2013/066438 | A2 | 5/2013 | |
| WO | 2013/082519 | A2 | 6/2013 | |
| WO | 2013/098244 | A1 | 7/2013 | |
| WO | 2013/141680 | A1 | 9/2013 | |
| WO | 2013/142578 | A1 | 9/2013 | |
| WO | 2013/163628 | A2 | 10/2013 | |
| WO | 2013/176772 | A1 | 11/2013 | |
| WO | 2013/181228 | A1 | 12/2013 | |
| WO | 2014/018423 | A8 | 1/2014 | |
| WO | 2014/022702 | A2 | 2/2014 | |
| WO | 2014/036219 | A2 | 3/2014 | |
| WO | 2014/059255 | A1 | 4/2014 | |
| WO | 2014/065596 | A1 | 5/2014 | |
| WO | 2014/089290 | A1 | 6/2014 | |
| WO | 2014/093479 | A1 | 6/2014 | |
| WO | 2014/093595 | A1 | 6/2014 | |
| WO | 2014/093622 | A8 | 6/2014 | |
| WO | 2014/093635 | A9 | 6/2014 | |
| WO | 2014/093655 | A2 | 6/2014 | |
| WO | 2014/093661 | A2 | 6/2014 | |
| WO | 2014/093694 | A1 | 6/2014 | |
| WO | 2014/093709 | A1 | 6/2014 | |
| WO | 2014/093712 | A1 | 6/2014 | |
| WO | 2014/093718 | A1 | 6/2014 | |
| WO | 2014/099744 | A1 | 6/2014 | |
| WO | 2014/099750 | A2 | 8/2014 | |
| WO | 2014/124284 | A1 | 8/2014 | |
| WO | 2014/144288 | A1 | 9/2014 | |
| WO | 2014/144592 | A2 | 9/2014 | |
| WO | 2014/144761 | A2 | 9/2014 | |
| WO | 2014/152432 | A2 | 9/2014 | |
| WO | 2014/186585 | A2 | 11/2014 | |
| WO | 2014/197568 | A2 | 12/2014 | |
| WO | 2014/197748 | A2 | 12/2014 | |
| WO | 2014/204578 | A1 | 12/2014 | |
| WO | 2014/204725 | A8 | 12/2014 | |
| WO | 2015/006290 | A1 | 1/2015 | |
| WO | 2015/006294 | A2 | 1/2015 | |
| WO | 2015/006498 | A2 | 1/2015 | |
| WO | 2015/013583 | A8 | 1/2015 | |
| WO | 2015/021353 | A1 | 2/2015 | |
| WO | 2015/027134 | A1 | 2/2015 | |
| WO | 2015/035136 | A8 | 3/2015 | |
| WO | 2015/035139 | A2 | 3/2015 | |
| WO | 2015/035162 | A2 | 3/2015 | |
| WO | 2015/048577 | A2 | 4/2015 | |
| WO | 2015/048680 | A1 | 4/2015 | |
| WO | 2015/070083 | A1 | 5/2015 | |
| WO | 2015/071474 | A9 | 5/2015 | |
| WO | 2015/074085 | A1 | 5/2015 | |
| WO | 2015/077290 | A2 | 5/2015 | |
| WO | 2015/077318 | A1 | 5/2015 | |
| WO | 2015/089406 | A1 | 6/2015 | |
| WO | 2015/089462 | A1 | 6/2015 | |
| WO | 2015/099850 | A1 | 7/2015 | |
| WO | 2015/188056 | A1 | 12/2015 | |
| WO | WO-2015195621 | A1 * | 12/2015 | ........... C12N 15/111 |
| WO | 2016/022363 | A9 | 2/2016 | |
| WO | 2016/073990 | A2 | 5/2016 | |
| WO | 2016/081029 | A1 | 5/2016 | |
| WO | 2016/176191 | A1 | 11/2016 | |
| WO | 2016/182959 | A1 | 11/2016 | |
| WO | 2016/186772 | A2 | 11/2016 | |
| WO | 2016/205749 | A1 | 12/2016 | |
| WO | 2017/035416 | A2 | 3/2017 | |
| WO | 2017/044649 | A1 | 3/2017 | |
| WO | 2017/117530 | A1 | 7/2017 | |
| WO | 2017/184768 | | 10/2017 | |
| WO | 2018/126176 | A1 | 7/2018 | |
| WO | 2018/129368 | A2 | 7/2018 | |
| WO | 2019/136216 | A1 | 7/2019 | |
| WO | 2019/191780 | A1 | 10/2019 | |
| WO | 2019/209777 | A1 | 10/2019 | |
| WO | 2020/214613 | A1 | 10/2020 | |

OTHER PUBLICATIONS

NCBI MYOC reference sequence, first published 1993, downloaded Nov. 4, 2024. (Year: 1993).*

Maruyama et al. Increasing the efficiency of precise genome editing with CRISPR-Cas9 by inhibition of nonhomologous end joining. Nature Biotechnology 2015, 13;5:538-546. (Year: 2015).*

Graham et al. Resources for the design of CRISPR gene editing experiments. Genome Biology 2015, 16:260. (Year: 2015).*

Joung, J., et al., “Genome-Scale CRISPR-Cas9 Knockout and Transcriptional Activation Screening,” Nat. Protoc. 12(4):828-863 (2017).

Koike-Yusa, H., et al., “Genome-Wide Recessive Genetic Screening in Mammalian Cells with a Lentiviral CRISPR-Guide RNA Library,” Nat. Biotechnol. 32(3):267-273 (2014).

Shalem, O., et al., “Genome-Scale CRISPR-Cas9 Knockout Screening in Human Cells,” Science 343:84 (2014).

Bothmer, A., et al., “Characterization of the Interplay Between DNA Repair and CRISPR/Cas9-Induced DNA Lesions at an Endogenous Locus,” Nat. Commun. 8:13905 (2017).

Chen, F., et al., “Targeted Activation of Diverse CRISPR-Cas Systems for Mammalian Genome Editing Via Proximal CRISPR Targeting,” Nat. Commun. 8:14958 (2017).

Hinz, J. M., et al., “Nucleosomes Selectively Inhibit Cas9 Off-Target Activity at a Site Located at the Nucleosome Edge,” J. Biol. Chem. 291(48):24851-24856 (2016).

Ran, F. A., et al., “In Vivo Genome Editing Using *Staphylococcus aureus* Cas9,” Nature 520(7546):186-191 (2015).

Richardson, C. D., et al., “Enhancing Homology-Directed Genome Editing by Catalytically Active and Inactive CRISPR-Cas9 Using Asymmetric Donor DNA,” Nat. Biotechnol. 34(3):339-344 (2016).

(56) References Cited

OTHER PUBLICATIONS

Sather, B. D., et al., "Efficient Modification of CCR5 in Primary Human Hematopoietic Cells Using a Mega TAL Nuclease and AAV Donor Template," Sci. Trans. Med. 7(307):307ra156 (2015).
Shmakov, S., et al., "Discovery and Functional Characterization of Diverse Class 2 CRISPR-Cas Systems," Mol. Cell 60(3):385-397 (2015).
Smith, C., et al., "Efficient and Allele-Specific Genome Editing of Disease Loci in Human iPSCs," Mol. Ther. 23(3):570-577 (2015).
Zetsche, B., et al., "Cpf1 Is a Single RNA-Guided Endonuclease of a Class 2 CRISPR-Cas System," Cell 163(3):759-771 (2015).
European Patent Office, International Search Report and Written Opinion dated Jun. 12, 2017 for PCT/US2017/024163.
European Patent Office, International Search Report and Written Opinion dated May 29, 2017 for PCT/US2017/022377.
Boye, S. E., et al., "The Human Rhodopsin Kinase Promoter in an AAV5 Vector Confers Rod- and Cone-Specific Expression in the Primate Retina," Human Gene Therapy 23(10):1101-1115 (2012).
Amrani, N., et al., "NmeCas9 is an Intrinsically High-Fidelity Genome-Editing Platform," Genome Biol. 19:214 (2018).
Burstein, D., et al., "New CRISPR-Cas Systems from Uncultivated Microbes," Nature 542(7640):237-241 (2017).
Cassini, A., et al., "A Highly Specific SpCas9 Variant is Identified by In Vivo Screening in Yeast," Nat. Biotechnol. 36(3):265-271 (2018).
Chen, J. S., et al., "Enhanced Proofreading Governs CRISPR-Cas9 Targeting Accuracy," Nature 550(7676):407-410 (2017).
Fu, Y., et al., "Targeted Genome Editing in Human Cells Using CRISPR/Cas Nucleases and Truncated Guide RNAs," Methods Enzymol. 546:21-45 (2014).
Jain, A., et al., "CRISPR-Cas9-based treatment of myocilin-associated glaucoma" PNAS 114(42): 11199-11204 (2017).
Karvelis, T., et al., "crRNA and tracrRNA Guide Cas9-Mediated DNA Interference in *Streptococcus thermophilus*," RNA Biol. 10(5):841-851 (2013).
Kim, H.S., et al., "Problems Encountered in Detecting a Targeted Gene by the Polymerase Chain Reaction," Gene 103:227-233 (1991).
Kim, B. J., et al., "Gene Therapy for Ocular Diseases," Genetic Diseases of the Eye, 2nd Ed., Editor Elias I. Traboulsi, MD., Published by Oxford Univ. Press, Oxford, England, 20 pages (2012).
Kim, E., et al., "In Vivo Genome Editing with a Small Cas9 Orthologue Derived from Campylobacter Jejuni," Nat. Commun. 8:14500 (2017).
Lee, J. K., et al., "Directed evolution of CRISPR-Cas9 to Increase Its Specificity," Nat. Commun. 9:3048 (2018).
Liang, P., et al., "CRISPR/Cas9-Mediated Gene Editing in Human Tripronuclear Zygotes," Protein Cell 6(5):363-372 (2015).
Nishimasu, H., et al., "Engineered CRISPR-Cas9 Nuclease with Expanded Targeting Space," Science 361(6408):1259-1262 (2018).
Pellissier, L. P., et al., "Specific Tools for Targeting and Expression in Muller Glial Cells," Mol. Ther. Methods Clin. Dev. 1:14009 (2014).
Peng, R., et al., "Potential Pitfalls of CRISPR/Cas9-Mediated Genome Editing," Febs J. 283:1218-1231 (2016).
Singh, M., et al., "Genes and Genetics in Eye Diseases: A Genomic Medicine Approach for Investigating Hereditary and Inflammatory Ocular Disorders," Int. J. Ophthalmol. 11(1):117-134 (2018).
Stone, E.M., et al., "Clinically Focused Molecular Investigation of 1000 Consecutive Families with Inherited Retinal Disease," Opthalmol. 124(9):1314-1331 (2017).
Strecker, J., et al., "Engineering of CRISPR-Cas12b for Human Genome Editing," Nat. Commun. 10:212 (2019).
Tang, L., et al., "CRISPR/Cas9-Mediated Gene Editing in Human Zygotes Using Cas9 Protein," Mol. Genet. Genom. 292(3):525-533 (2017).
Teng, F., et al., "Repurposing CRISPR-Cas12b for Mammalian Genome Engineering," Cell Discov. 4:63 (2018).
Truong, L. N., et al., "Microhomology-Mediated End Joining and Homologous Recombination Share the Initial End Resection Step to Repair DNA Double-Strand Breaks in Mammalian Cells," PNAS 110(19):7720-7725 (2013).
Van Overbeek, M., et al., "DNA Repair Profiling Reveals Nonrandom Outcomes at Cas9-Mediated Breaks," Mol. Cell 63:633-646 (2016).
Wang, J., et al., "xCas9 Expands the Scope of Genome Editing with Reduced Efficiency in Rice," Plant Biotechnol. J. 17:709-711 (2019).
Yamano, T., et al., "Crystal Structure of Cpf1 in Complex with Guide RNA and Target DNA," Cell 165(4):949-962 (2016).
Yan, W. X., et al., "Functionally Diversse Type V CRISPR-Cas Systems," Science 363:88-91 (2019).
Ding, Q., et al., "Enhanced Efficiency of Human Pluripotent Stem Cell Genme Editing through Replacing TALENs with CRIPSRs," Cell Stem Cell 12:393-394 (2013).
Heintze, J., et al., "A CRISPR CASe for High-Throughput Silencing," Front. Genet. 4(193):1-6 (2013).
Mukherjee-Clavin, B., et al., "Current Approaches for Efficient Genetic Editing in Human Pluripotent Stem Cells," Front. Biol. 8(5):461-467 (2013).
Cramer, M. L., et al., "Induction of T-Cell Infiltration and Programmed Death Ligand 2 Expression by Adeno-Associated Virus in Rhesus Macaque Skeletal Muscle and Modulation by Prednisone," Hum. Gene Ther. 28(6):493-509 (2017).
Guo, Q., et al., "Cold shock' increases the frequency of homology directed repair gene editing in induced pluripotent stem cells," Sci. Rep. 8(1):2080 (2018).
Kumar, S. R.P., et al., "Clinical development of gene therapy: results and lessons from recent successes," Mol. Ther. Methods Clin. Dev. 3:16034 (2016).
Li, W., et al., "Gene Therapy Following Subretinal AAV5 Vector Delivery Is Not Affected By a Previous Intravitreal AAV5 Vector Administration in the Partner Eye," Mol. Vision 15:267-275 (2009).
Lopes, V. S., et al., "Retinal Gene Therapy with a Large MYO7A cDNA Using Adeno-Associated Virus," Gene Ther. 20(8):824-833 (2013).
Paix, A., et al., "Precision Genome Editing Using CRISPR-Cas9 and Linear Repair Templates in C. Elegans," Methods 121-121:86-93 (2017).
Sobrevals, L., et al., "AAV Vectors Transduce Hepatocytes In Vivo as Efficiently in Cirrhotic as in Healthy Rat Livers," Gene Ther. 19:411-417 (2012).
Vandenberghe, L. H., et al., "Dosage Thresholds for AAV2 and AAV8 Photoreceptor Gene Therapy in Monkey," Sci. Transl. Med. 3(88):88ra54 (2011).
Xue, K., et al., "Technique of Retinal Gene Therapy: Delivery of Viral Vector Into the Subretinal Space," Eye 31 (9):1308-1316 (2017).
Zetsche, B., et al., "Multiplex Gene Editing by CRISPR-Cpf1 Through Autonomous Processing of a Single crRNA Array," Nat. Biotechnol. 35(1):31-34 (2017).
Bothmer, A., et al., "Detection and Modulation of DNA Translocations During Multi-Gene Genome Editing in T Cells," The CRISPR Journal 3(3):177-187 (2020).
Burnight, E. R., et al., "Using CRIPSR-Cas9 to Generate Gene-Corrected Autologous iPSCs for the Treatment of Inherited Retinal Degeneration," Mol. Ther. 25(9):1999-2013 (2017).
Cost, G. J., et al., Geneseq Accession No. BBD49192 (2014), 2 pages.
Fu, B. X. H., et al., "Landscape of Target: Guide Homology Effects on Cas9-Mediated Cleavage," Nucl. Acids Res. 42(22):13778-13787 (2014).
Giannoukos, G., et al., "UDiTaS™, a genome editing detection method for indels and genome rearrangements," BMC Genomics 19:212 (2018).
Kleinstiver, B. P., et al., "Engineered CRISPR-Cas12a variants with increased activities and improved targeting ranges for gene, epigenetic and base editing," Nat. Biotechnol. 37(3):276-282 (2019).
Kosicki, M., et al., "Repair of Double-Strand Breaks Induced by CRISPR-Cas9 Leads to Large Deletions and Complex Rearrangements," Nat. Biotechnol. 36(8):765-771 (2018).
Krieg, A. M., et al., GeneSeq Accession No. BAY71542 (2013).

(56) References Cited

OTHER PUBLICATIONS

Lee, J. H., et al., "Gene Therapy for Visual Loss: Opportunities and Concerns," Progress in Retinal and Eye Research 68:31-53 (2019).
Pausch, P., et al., "CRISPR-Casϕ from Huge Phages is a Hypercompact Genome Editor," Science ;369(6501):333-337 (2020).
Reeks, J., et al., "Structure of a Dimeric Crenarchaeal Cas6 Enzyme with an Atypical Active Site for CRISPR RNA Processing," Biochem. J. 452:223-230 (2013).
Reichel, F. F., et al., "AAV8 Can Induce Innate and Adaptive Immune Response in the Primate Eye," Mol. Ther. 25(12):2648-1660 (2017).
Strohkendl, I., et al., "Kinetic Basis for DNA Target Specificity of CRISPR-Cas12a," Mol Cell. 71(5):816-824 (2018).
Swarts, D. C., et al., "Cas9 Versus Cas12a/Cpf1: Structure-Function Comparisons and Implications for Genome Editing," WIREs RNA 9:e1481 (2018).
Vidigal, J. A., et al.,"Rapid and Efficient One-Step Generation of Paired gRNA CRISPR-Cas9 Libraries," Nat. Commun. 6:8083 (2015).
Weber, L., et al., "Editing a γ-Globin Repressor Binding Site Restores Fetal Hemoglobin Synthesis and Corrects the Sickle Cell Disease Phenotype," Sci. Adv. 6:eaay9392 (2020).
Wu, W., et al., "Application of CRISPR-Cas9 in Eye Disease," Exp. Eye Res. 161:116-123 (2017).
European Patent Office, International Search Report and Written Opinion dated Jun. 17, 2020 for PCT/US2020/019766, 18 pages.
Jeon, C.J., et al., "The Major Cell Populations of the Mouse Retina," J. Neurosci. 18(21):8936-8946 (1998).
Kim, D., et al., "Genome-wide analysis reveals specificities of Cpf1 endonucleases in human cells," Nat. Biotechnol. 34(8):863-868 (2016).
Kleinstiver, B.P., et al., "Genome-Wide Specificities of CRISPR-Cas Cpf1 Nucleases in Human Cells," Nat. Biotechnol. 34(8):869-874 (2016).
Packer, O., et al., "Photoreceptor Topography of the Retina in the Adult Pigtail Macaque (*Macaca nemestrina*)," J. Comp. Neurol. 288(1):165-183 (1989).
Sakuma, T., et al., "Multiplex Genome Engineering in Human Cells Using All-in-One CRISPR/Cas9 Vector System," Sci. Rep. 4(5400):1-6 (2014).
Van Zyl, T., et al., "Cell Atlas of Aqueous Humor Outflow Pathways in Eyes of Humans and Four Model Species Provides Insight into Glaucoma Pathogenesis," PNAS 117(19):10339-10349 (2020).
Wikler, K. C., et al., "Photoreceptor Mosaic: Number and Distribution of Rods and Cones in the Rhesus Monkey Retina," J. Comp. Neurol. 297(4):499-508 (1990).
Boye, S. L., et al., "Transduction and Tropism of an Abbreviated Form of CMV-Chicken S-Actin Promoter (CBA) With AAV in Mouse Retina," Invest. Ophthalmol. Vis. Sci. 47:852 (2006).
Bulcha, J. T., et al., "Viral Vector Platforms within the Gene Therapy Landscape," Signal Transduction and Targeted Therapy 6:53 (2021), 24 pages.
Ctori, I., et al., "Repeatability of Foveal Measurements Using Spectralis Optical Coherence Tomography Segmentation Software," PLoS One 10(6):e0129005 (2015).
Konstantakos, V., et al., "CRISPR-Cas9 gRNA Efficiency Prediction: an Overview of Predictive Tools and the Role of Deep Learning," Nucl. Acids Res. 50(7):3616-3637 (2022).
Leber, T., "On Retinitis Pigmentosa and Congenital Amaurosis," Archiv fur Ophthalmologie 15(3):1-25 (1869).
Mangione, C. M., et al., "Development of the 25-item National Eye Institute Visual Function Questionnaire," Arch. Ophthalmol. 119(7):1050-1058 (2001).
Menke, M. N., et al., "Reproducibility of Retinal Thickness Measurements in Healthy Subjects Using Spectralis Optical Coherence Tomography," Am. J. Ophthalmol. 147(3):467-472 (2009).
National Institutes of Health, "Aflibercept (Eylea): Treatment of Neovascular (Wet) Age-Related Macular Degeneration (wAMD)," Ottowa (ON): Canadian Agency for Drugs and Technologies in Health (2015), 1 page, retrieved Feb. 29, 2024 from https://ncbi.nlm.nih.gov/books/NBK349601/table/T40/#.
Roman, A. J., et al., "Full-Field Stimulus Testing: Role in the Clinic and as an Outcome Measure in Clinical Trials of Severe Childhood Retinal Disease," Progress in Retinal and Eye Research 87:101000 (2022), 13 pages.
Santaeularia, M. L., et al., "Homology-Independent Targeted Integration in Photoreceptors," ARVO Annual Meeting Abstract, Jul. 2019, retrieved from: https://iovs.arvojournals.org/article.aspx?articleid=2743859, 2 pages.
European Patent Office, International Search Report and Written Opinion dated Jul. 29, 2022 for PCT/US022/025134, 13 pages.
European Patent Office, International Search Report and Written Opinion dated Mar. 5, 2024 for PCT/US2023/080164, 13 pages.
U.S. Appl. No. 61/652,086, filed May 25, 2012, Jinek et al.
U.S. Appl. No. 61/716,256, filed Oct. 19, 2012, Jinek et al.
U.S. Appl. No. 61/734,256, filed Dec. 6, 2012, Chen et al.
U.S. Appl. No. 61/736,527, filed Dec. 12, 2012, Zhang et al.
U.S. Appl. No. 61/738,355, filed Dec. 17, 2012, Church et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/779,169, filed Mar. 13, 2013, Mali et al.
Adatia, F. A., et al., "Chronic Open-Angle Glaucoma. Review for Primary Care Physicians," Can. Fam. Physician 51:1229-1237 (2005).
Al-Attar, S., et al., "Clustered Regularly Interspaced Short Palindromic Repeats (CRISPRs): The Hallmark of an Ingenious Antiviral Defense Mechanism in Prokaryotes," Biol. Chem. 392:277-289 (2011).
Altschul, S. F., et al., "Gapped BLAST and PSI-BLAST: A New Generation of Protein Database Search Programs," Nucleic Acids Res. 25(17):3389-3402 (1997).
Altschul, S. F., et al., "Basic Local Alignment Search Tool," J. Mol. Biol. 215(3):403-410 (1990).
Ambati, J., et al., "Diffusion of High Molecular Weight Compounds Through Sclera," Invest. Ophthalmol. Vis. Sci. 41(5):1181-1185 (2000).
Ambati, J., et al., "Transscleral Delivery of Bioactive Protein to the Choroid and Retina," Invest. Ophthalmol. Vis. Sci. 41(5):1186-1191 (2000).
Anders, C., et al., "Structural Basis of PAM-Dependent Target DNA Recognition by the Cas9 Endonuclease," Nature 513(7519):569-573 (2014).
Andreas, S., et al., "Enhanced Efficiency Through Nuclear Localization Signal Fusion on Phage PhiC31-Integrase: Activity Comparison with Cre and FLPe Recombinase in Mammalian Cells," Nucleic Acids Res. 30(11):2299-2306 (2002).
Anonymous, Third Party Observation for EP13818570.7, Oct. 1, 2014, 15 pages.
Anonymous, Third Party Observation for EP13824232.6, Sep. 8, 2014, 48 pages.
Anonymous, Third Party Observation for EP13824232.6, Sep. 22, 2014, 19 pages.
Anonymous, Third Party Observation for EP13824232.6, Oct. 22, 2014, 7 pages.
Bae, S., et al., "Cas-OFFinder: A Fast and Versatile Algorithm that Searches for Potential Off-Target Sites of Cas9 RNA-Guided Endonucleases," Bioinformatics 30(10):1473-1475 (2014).
Baker, M., "Gene Editing at CRISPR Speed," Nat. Biotechnol. 32(4):309-312 (2014).
Barker, C. S., et al., "Increased DNA Microarray Hybridization Specificity Using sscDNA Targets," BMC Genomics 6:57 (2005).
Baron-Benhamou, J., et al., "Using the LambdaN Peptide to Tether Proteins to RNAs," Methods Mol. Biol. 257:135-153 (2004).
Barrangou, R., "RNA-Mediated Programmable DNA Cleavage," Nat. Biotechnol. 30(9):836-838 (2012).
Barretina, J., et al., "The Cancer Cell Line Encyclopedia Enables Predictive Modeling of Anticancer Drug Sensitivity," Nature 483(7391):603-607 (2012).
Bassett, A. R., et al., "CRISPR/Cas9 and Genome Editing in *Drosophila*," J. Genet. Genom. 41:7-19 (2014).
Beerli, R. R., et al., "Toward Controlling Gene Expresion at Will: Specific Regulation of the erbB-2/HER-2 Promoter by Using Polydactyl

(56) References Cited

OTHER PUBLICATIONS

Zinc Finger Proteins Constructed from Modular Building Blocks," Proc. Natl. Acad. Sci. 95:14628-14633 (1998).
Bhaya, D., et al., "CRISPR-Cas Systems in Bacteria and Archaea: Versatile Small RNAs for Adaptive Defense and Regulation," Annu. Rev. Genet. 45:273-297 (2011).
Bikard, D., et al., "Programmable Repression and Activation of Bacterial Gene Expression Using an Engineered CRISPR-Cas System," Nucl. Acids Res. 41(15):7429-7437 (2013).
Bitinaite, J., et al., "Fokl Dimerization is Required for DNA Cleavage," Proc. Natl. Acad. Sci. 95:10570-10575 (1998).
Boch, J., et al., "Breaking the Code of DNA Binding Specificity of TAL-Type III Effectors," Science 326(5959):1509-1512 (2009).
Boch, J., et al., "Xanthomonas AvrBs3 Family-Type III Effectors: Discovery and Function," Annu. Rev. Phytopathol. 48:419-436 (2010).
Briner, A.E., et al., "Guide RNA Functional Modules Direct Cas9 Activity and Orthogonality," Mol. Cell 56(2):333-339 (2014).
Broad Institute, Communication Forwarding Declaration of Feng Zhang for U.S. Appl. No. 14/256,912, Nov. 24, 2014, 5 pages.
Broad Institute, Information Disclosure Statement submitted for U.S. Appl. No. 14/256,912, citing Electronic Mail from T. Kowalski which references Briner et al., Nov. 3, 2014, 8 pages.
Broad Institute, Request for Oral Examination for EP13818570.7, Oct. 27, 2014, 3 pages.
Broad Institute, Response to EP Examination Report for EP13824232.6, Dec. 31, 2014, 44 pages.
Broad Institute, Response to Third Party Observations and Request for Oral Hearing for EP13824232.6, Oct. 27, 2014, 9 pages.
Broad Institute, Response to Third Party Observations, with redlined and clean amended claims, for EP13818570.7, Oct. 16, 2014, 30 pages.
Broad Institute, Response to Third Party Observations, with redlined and clean amended claims, for EP13824232.6, Oct. 2, 2014, 16 pages.
Brummelkamp, T. R., et al., "A System for Stable Expression of Short Interfering RNAs in Mammalian Cells," Science 296(5567):550-553 (2002).
Caldecott, K.W., "Single-Strand Break Repair and Genetic Disease," Nat. Rev. Genet. 9(8):619-631 (2008).
Canver, M. C., "Evaluation of the Clinical Success of Ex Vivo and In Vivo Gene Therapy," Journal of Young Investitgators, http://www.hyi.org/issue/evaluation-of-the-clinical-success-of-ex-vivo-and-in-vivo-gene-therapy/, 9 pages (2009).
Carroll, D., "A CRISPR Approach to Gene Targeting," Mol. Ther. 20(9):1658-1660 (2012).
Cathomen, T., et al., "Zinc-Finger Nucleases: The Next Generation Emerges," Mol. Ther. 16:1200-1207 (2008).
Cermak, T., et al., "Efficient Design and Assembly of Custom TALEN and Other TAL Effector-Based Constructs for DNA Targeting," Nucl. Acids Res. 39(12):e82 (2011).
Chen, X., et al., "Fusion Protein Linkers: Property, Design and Functionality," Adv. Drug Deliv. Rev. 65(10):1357-1369 (2013).
Cho, S. W., et al., Supplementary Information: Targeted Genome Engineering in Human Cells With the Cas9 RNA-Guided Endonuclease, Nature Biotechnology (Mar. 2013) vol. 31, No. 3, 11 pages.
Cho, S. W., et al., "Targeted Genome Engineering in Human Cells with the Cas9 RNA-Guided Endonuclease," Nat. Biotechnol. 31(3):230-232 (2013).
Christian, M., et al., "Targeting DNA Double-Strand Breaks With TAL Effector Nucleases," Genetics 186:757-761 (2010).
Christian, M., et al., "Targeting DNA Double-Strand Breaks With TAL Effector Nucleases," Genetics Supporting Information, 1SI-8SI (2010).
Chylinski, K., et al., "The TrackRNA and Cas9 Families of Type II CRISPR-Cas Immunity Systems," RNA Biol. 10(5):726-737 (2013).
Cideciyan, A.V., et al., "Human Gene Therapy for RPE65 Isomerase Deficiency Activates the Retinoid Cycle of Vision but with Slow Rod Kinetics," Proc. Natl. Acad. Sci. U.S.A. 105(39):15112-15117 (2008).
Cong, L., et al., "Multiplex Genome Engineering Using CRISPR/Cas Systems," Science 339(6121):819-823 (2013).
Cong, L et al., "Supplementary Material: Multiplex Genome Engineering Using CRISPR-Cas Systems," Science Express (Jul. 5, 2012).
Cong, L et al., "Supplementary Material: Multiplex Genome Engineering Using CRISPR-Cas Systems," Science Express (Jan. 3, 2013).
Cornish-Bowden, A., "Nomenclature for Incompletely Specified Bases in Nucleic Acid Sequences: Recommendations 1984," Nucleic Acids Res. 13(9):3021-3030 (1985).
Cradick, T. J., et al., "CRISPR/Cas9 Systems Targeting Beta-Globin and CCR5 Genes Have Substantial Off-Target Activity," Nucleic Acids Res. 41(20):9584-9592 (2013).
Datsenko, K. A., et al., "Molecular Memory of Prior Infections Activates the CRISPR/Cas Adaptive Bacterial Immunity System," Nat. Commun. 3:945 (2012).
Davis, L., et al., "Homology-Directed Repair of DNA Nicks Via Pathways Distinct from Canonical Double-Strand Break Repair," PNAS 111(10):E924-932 (2014).
Deltcheva, E., et al., CRISPR RNA Maturation by Trans-Encoded Small RNA and Host Factor RNase III, Nature 471:602-607 (2011).
Deltcheva, E., et al., Supplementary Figures: CRISPR RNA Maturation by Trans-Encoded Small RNA and Host Factor RNase III. Downloaded from www.nature.com/nature, p. 1-35, 2011.
Den Hollander, A.I., et al., "Lighting a Candle in the Dark: Advances in Genetics and Gene Therapy of Recessive Retinal Dystrophies," J. Clin. Invest. 120(9):3042-3053 (2010).
Deveau, H., et al., "Phage Response to CRISPR-Encoded Resistance in *Streptococcus thermophilus*," J. Bacteriol. 190(4):1390-1400 (2008).
Dicarlo, J. E., et al., "Genome Engineering in *Saccharomyces cerevisiae* Using CRISPR-Cas Systems," Nucl. Acids Res. 41(7):4336-43 (2013).
Dingwall, C., et al., "A Polypeptide Domain That Specifies Migration of Nucleoplasmin Into the Nucleus," Cell 30:449-458 (1982).
Dreszer, T. R., et al., "The UCSC Genome Browser Database: Extensions and Updates 2011," Nucl. Acids Res. 40:D918-D923 (2012).
Esvelt, K.M., et al., "A System for the Continuous Directed Evolution of Biomolecules," Nature 472(7344):499-503 (2011).
Esvelt, K. M., et al., "Orthogonal Cas9 Proteins for RNA-Guided Gene Regulation and Editing," Nat. Methods 10(11):1116-1121 (2013).
Fine, E.J., et al., "Trans-Spliced Cas9 Allows Cleavage of HBB and CCR5 Genes in Human Cells Using Compact Expression Cassettes," Sci. Rep. 5:10777 (2015).
Fonfara, I., et al., "Phylogeny of Cas9 Determines Functional Exchangeability of Dual-RNA and Cas9 Among Orthologous Type II CRISPR-Cas Systems," Nucl. Acids Res.42(4):2577-2590 (2014).
Friedland, A.E., et al., "Characterization of *Staphylococcus aureus* Cas9: A Smaller Cas9 for All-in-One Adeno-Associated Virus Delivery and Paired Nickase Applications," Genome Biol. 16:257 (2015).
Frit, P., et al., "Alternative End-Joining Pathway(s): Bricolage at DNA Breaks," DNA Repair (Amst) 17:81-97 (2014).
Fu, Y., et al., "High-Frequency Off-Target Mutagenesis Induced by CRISPR-Cas Nucleases in Human Cells," Nat. Biotechnol. 31:822-826 (2013).
Fu, Y., et al., "Improving CRISPR-Cas Nuclease Specificity Using Truncated Guide RNAs," Nat. Biotechnol. 32(3):279-284 (2014).
Gabriel, R., et al., "An Unbiased Genome-Wide Analysis of Zinc-Finger Nuclease Specificity," Nat. Biotechnol. 29:816-823 (2011).
Garneau, J. E., et al., "The CRISPR-Cas Bacterial Immune Systems Cleaves Bacteriophage and Plasmid DNA," Nature 468:67-71 (2010).
Gasiunas, G., et al., "Cas9-crRNA Ribonucleoprotein Complex Mediates Specific DNA Cleavage for Adaptive Immunity in Bacteria," Proc. Natl. Acad. Sci. 109(39):E2579-E2586 (2012).
Gilbert, L. A., et al., "CRISPR-Mediated Modular RNA-Guided Regulation of Transcription in Eukaryotes," Cell 154(2):442-451 (2013).
Goldfarb, D. S., et al., "Synthetic Peptides as Nuclear Localization Signals," Nature 322:641-644 (1986).

(56) References Cited

OTHER PUBLICATIONS

Gratz, S. J., et al., "Genome Engineering of *Drosophila* with the CRISPR RNA-Guided Cas9 Nuclease," Genetics 194(4):1029-1035 (2013).
Grieger, J. C., et al., "Production and Characterization of Adeno-Associated Viral Vectors," Nat. Protoc. 1(3):1412-1428 (2006).
Guilinger, J. P., et al., "Fusion of Catalytically Inactive Cas9 to Fokl Nuclease Improves the Specificity of Genome Modification," Nat Biotechnol. 32(6):577-583 (2014).
Guo, X., et al., "RNA-Dependent Folding and Stabilization of C5 Protein During Assembly of the *E. coli* Rnase P Holoenzyme," J. Mol. Biol. 360:190-203 (2006).
Gustafsson, C., et al., "Codon Bias and Heterologous Protein Expression," Trends Biotechnol. 22(7):346-353 (2004).
Haft, D. H., et al., "A Guild of 45 CRISPR-Associated (Cas) Protein Families and Multiple CRISPR/Cas Subtypes Exist in Prokaryotic Genomes," PLoS Comput. Biol. 1(6):e60 (2005).
Hale, C. R., et al., "Essential Features and Rational Design of CRISPR RNAs That Function With the Cas RAMP Module Complex to Cleave RNAs," Mol. Cell 45(3):292-302 (2012).
Hatoum-Aslan, A., et al. "Mature Clustered Regularly Interspaced, Short Palindromic Repeats RNA 5,9,14 (crRNA) Length is Measured by a Ruler Mechanism Anchored at the Precursor Processing Site," Proc. Natl. Acad. Sci. 108(52):21218-21222 (2011).
Heigwer, F., et al., "E-CRISP: Fast CRISPR Target Site Identification," Nat. Methods 11(2):122-123 (2014).
Hockemeyer, D., et al., "Efficient Targeting of Expressed and Silent Genes in Human ESCs and iPSCs Using Zinc-Finger Nucleases," Nat. Biotechnol. 27(9):851-857 (2009).
Hockemeyer, D., et al., "Genetic Engineering of Human Iuripotent Cells Using TALE Nucleases," Nat. Biotechnol. 29:731-734 (2011).
Holt, N, et al., "Zinc Finger Nuclease-Mediated CCR5 Konockout Hematopoietic Stem Cell Transplantation Controls HIV-1 In Vivo," Nat. Biotechnol. 28(8):839-847 (2010).
Horvath, P., et al., "CRISPR/Cas, The Immune System of Bacteria and Archaea," Science 327(5962):167-170 (2010).
Horvath, P., et al., "RNA-Guided Genome Editing A La Carte," Cell Res. 23:733-734 (2013).
Hou, Z., et al., "Efficient Genome Engineering in Human Pluripotent Stem Cells Using Cas9 from Neisseria Meningitidis," Proc. Natl. Acad. Sci. U.S.A. 110(39):15644-15649 (2013).
Hsu, P.D., et al., "DNA Targeting Specificity of RNA-Guided Cas9 Nucleases," Nat. Biotechnol. 31(9):827-832 (2013).
Hwang, W. Y., et al., "Heritable and Precise Zebrafish Genome Editing Using a CRISPR-Cas System," PLoS One 8(7):e68708 (2013).
Hwang, W. Y., et al., "Efficient Genome Editing in Zebrafish Using a CRISPR-Cas System," Nat. Biotechnol. 31(3):227-229 (2013).
Iyama, T., et al., "DNA Repair Mechanisms in Dividing and Non-Dividing Cells," DNA Repair (Amst.) 12(8):620-636 (2013).
Iyer, L. M., et al., "Prediction of Novel Families of Enzymes Involved in Oxidative and Other Complex Modifications of Bases in Nucleic Acids," Cell Cycle 8(11):1698-1710 (2009).
Jiang, W., et al., "RNA-Guided Editing of Bacterial Genomes Using CRISPR-Cas Systems," Nat. Biotechnol. 31(3):233-239 (2013).
Jinek, M., et al., "A Programmable Dual-RNA-Guided DNA Endonuclease in Adaptive Bacterial Immunity," Science 337(6096):816-821 (2012).
Jinek, M., et al., "Structures of Cas9 Endonucleases Reveal RNA-Mediated Conformational Activation," Science 343(6176):1247997 (2014).
Jinek, M., et al., "RNA-Programmed Genome Editing in Human Cells," eLife 2:e00471 (2013).
Kaiser, J., "The Gene Editor CRISPR Won't Fully Fix Sick People Anytime Soon. Here's Why," (May 3, 2016), Biol., Technol, CRISPR, DOI: 10.1126/science.aaf5689, 5 pages.
Karolchik, D., et al., "The UCSC Table Browser Data Retrieval Tool," Nucleic Acids Research 32:D493-496 (2004).
Kent, W. J., et al., "The Human Genome Browser at UCSC," Genome Research 12:996-1006 (2002).
Keryer-Bibens, C., et al., "Tethering of Proteins to RNAs by Bacteriophage Proteins," Biol. Cell, 100:125-138 (2008).
Khalil, A. S., et al., "Synthetic Biology: Applications Come of Age," Nat. Rev. Genet. 11(5):367-379 (2010).
Kim, Y.G., et al., "Hybrid Restriction Enzymes: Zinc Finger Fusions to Fok I Cleavage Domain," Proc. Natl. Acad. Sci. USA 93:1156-1160 (1996).
King, N. M.P., et al., "En Route to Ethical Recommendations for Gene Transfer Clinical Trials," Mol. Ther. 16(3):432-438 (2008).
Kleinstiver, B.P., et al., "Broadening the Targeting Range of *Staphylococcus aureus* CRISPR-Cas9 by Modifying PAM Recognition," Nat. Biotechnol. 33(12):1293-1298 (2015).
Kleinstiver, B.P., et al., "Engineered CRISPR-Cas9 Nucleases with Altered PAM Specificities," Nature 523(7561):481-485 (2015).
Kleinstiver, B.P., et al., "High-Fidelity CRISPR-Cas9 Nucleases with No. Detectable Genome-Wide Off-Target Effects," Nature 529(7587):490-495 (2016).
Koenekoop, R.K., et al., "Genetic Testing for Retinal Dystrophies and Dysfunctions: Benefits, Dilemmas and Solutions," Clin. Exp. Ophthalmol. 35(5):473-485 (2007).
Komor, A.C., et al., "Programmable Editing of a Target Base in Genomic DNA Without Double-Stranded DNA Cleavage," Nature 533(7603):420-424 (2016).
Kosuri, S., et al., "A Scalable Gene Synthesis Platform Using High-Fidelity DNA Microchips," Nat. Biotechnol. 28(12):1295-1299 (2010).
Kuchtey, J., et al., "A De Novo MYOC Mutation Detected in Juvenille Open Angle Glaucoma Associated with Reduced Myocilin Protein in Aqueous Humor," Eur. J. Med. Genet. 56(6):292-296 (2013).
Lambowitz, A. M., et al., "Group II Introns: Mobile Ribozymes that Invade DNA," Cold Spring Harb. Perspect. Biol. 3:a003616 (2011).
Langmead, B., et al., "Ultrafast and Memory-Efficient Alignment of Short DNA Sequences to the Human Genome," Genome Biology 10(3):R25 (2009).
Lee, J.H., et al., "A Robust Approach to Identifying Tissue-Specific Gene Expression Regulatory Variants Using Personalized Human Induced Pluripotent Stem Cells," PLoS Genetics 5(11):e1000718 (2009).
Lee, J., et al., "Non-Endocytic Delivery of Functional Engineered Nanoparticles into the Cytoplasm of Live Cells Using a Novel, High-Throughput Microfluidic Device," Nano Lett. 12(12):6322-6327 (2012).
Li, G.M., "Mechanisms and Functions of DNA Mismatch Repair," Cell Res. 18(1):85-98 (2008).
Li, M., et al., "RNA Interference as a Gene Silencing Therapy for Mutant MYOC Protein in Primary Open Angle Glaucoma," Diagnostic Pathology 4:46 (2009).
Li, T., et al., "TAL Nucleases (TALNs): Hybrid Proteins Composed of TAL Effectors and Fokl DNA-Cleavage Domain," Nucl. Acids Res.39(1): 359-372 (2011).
Li, H., et al., "In Vivo Genome Editing Restores Hemostasis in a Mouse Model of Hemophilia," Nature 475(7355):217-221 (2011).
Li, T., et al., "Modularly Assembled Designer TAL Effector Nucleases for Targeted Gene Knockout and Gene Replacement in Eukaryotes," Nucl. Acids Res. 39(14):6315-6325 (2011).
Lombardo, A., et al., "Gene Editing in Human Stem Cells Using Xinc Finger Nucleases and Integrase-Defective Lentiviral Vector Delivery," Nat. Biotechnol. 25(11):1298-1306 (2007).
Lorenz, R., et al., "ViennaRNA Package 2.0," Algorithms for Molecular Biology 6:26 (2011).
Maeder, M. L., et al., "CRISPR RNA-Guided Activation of Endogenous Human Genes," Nat. Methods 10:977-979 (2013).
Maeder, M. L., et al., "Rapid "Open-Source" Engineering of Customized Zinc-Finger Nucleases for Highly Efficient Gene Modification," Mol. Cell 31(2):294-301 (2008).
Makarova, K. S., et al., "A Putative RNA-Interference-Based Immune System in Prokaryotes: Computational Analysis of the Predicted Enzymatic Machinery, Functional Analogies with Eukaryotic RNAi, and Hypothetical Mechanisms of Action," Biol. Direct. 1:7 (2006).
Makarova, K. S., et al., "Unification of Cas Protein Families and a Simple Scenario for the Origin and Evolution of CRISPR-Cas Systems," Biol. Direct 6:38 (2011).

(56) References Cited

OTHER PUBLICATIONS

Makarova, K.S., et al., "Evolution and Classification of the CRISPR-Cas Systems," Nat. Rev. Microbiol. 9(6):467-477 (2011).
Mali, P., et al., "CAS9 Transcriptional Activators for Target Specificity Screening and Paired Nickases for Cooperative Genome Engineering," Nat. Biotechnol. 31:833-838 (2013).
Mali, P., et al., "Cas9 as a Versatile Tool for Engineering Biology," Nat. Methods 10(10):957-963 (2013).
Mali, P., et al., "RNA-Guided Human Genome Engineering Via Cas9," Science 339(6121):823-826 (2013).
Marteijn, J.A., et al., "Understanding Nucleotide Excision Repair and Its Role in Cancer and Ageing," Nat. Rev. Mol. Cell Biol. 15(7):465-481 (2014).
Mathews, D. H., et al., "Expanded Sequence Dependence of Thermodynamic Parameters Improves Prediction of RNA Secondary Structure," J. Mol. Biol. 288:911-940 (1999).
Miller, J. C., et al., "An Improved Zinc-Finger Nuclease Architecture for Highly Specific Genome Editing," Nat. Biotechnol. 25:778-785 (2007).
Miller, J. C., et al., "A Tale Nuclease Architecture for Efficient Genome Editing," Nat. Biotechnol. 29(2):143-150 (2011).
Miyagishim M., et al., "U6 Promoter-Driven siRNAs with Four Uridine 3' Overhangs Efficiently Suppress Targeted Gene Expression in Mammalian Cells," Nat. Biotechnol. 20(5):497-500 (2002).
Moscou, M. J., et al., "A Simple Cipher Governs DNA Recognition by TAL Effectors," Science 326(5959):1501 (2009).
Myers, E. W., et al., "Optimal Alignments in Linear Space," Comput. Appl. Biosci. 4(1):11-17 (1988).
Nakamura, Y., et al., "Codon Usage Tabulated From International DNA Sequence Databases: Status for the Year 2000," Nucl. Acids Res. 28(1):292 (2000).
Needleman, S. B., et al., "A General Method Applicable to the Search for Similarities in the Amino Acid Sequence of Two Proteins," J. Mol. Biol. 48(3):443-453 (1970).
Nishimasu, H., et al., "Crystal Structure of Cas9 in Complex with Guide RNA and Target DNA," Cell 156(5):935-949 (2014).
Nishimasu, H., et al., "Crystal Structure of *Staphylococcus aureus* Cas9," Cell 162:1113-1126 (2015).
Pattanayak, V., et al., "High-Throughput Profiling of Off-Target DNA Cleavage Reveals RNA-Programmed Cas9 Nuclease Specificity," Nat. Biotechnol. 31:839-843 (2013).
Pattanayak, V., et al., "Revealing Off-Target Cleavage Specificities of Zinc-Finger Nucleases by In Vitro Selection," Nat. Methods 8:765-770 (2011).
Patterson, S. S., et al., "Codon Optimization of Bacterial Luciferase (lux) for Expression in Mammalian Cells," J. Ind. Microbio. Biotechnology 32:115-123 (2005).
Pearson, W. R., et al., "Improved Tools for Biological Sequence Comparison," Proc. Natl. Acad. Sci. U.S.A. 85(8):2444-2448 (1988).
Perez, E. E., et al., "Establishment of HIV-1 Resistance in CD4+ T Cells by Genome Editing Using Zinc-Finger Nucleases," Nat. Biotechnol. 26:808-816 (2008).
Porteus, M. H., et al., "Gene Targeting Using Zinc Finger Nucleases," Nat. Biotechnol. 23(8):967-973 (2005).
Pougach, K., et al., "Transcription, Processing and Function of CRISPR Cassettes in *Escherichia coli*," Mol. Microbiol. 77(6):1367-1379 (2010).
Pride, D. T., et al., "Analysis of Streptococcal CRISPRs from Human Saliva Reveals Substantial Sequence Diversity Within and Between Subjects Over Time," Genome Res. 21:126-136 (2011).
Purnick, P. E. M., et al., "The Second Wave of Synthetic Biology: From Modules to Systems," Nat. Rev. Mol. Cell Biol. 10(6):410-422 (2009).
Qi, L. S., et al., "Repurposing CRISPR as an RNA-Guided Platform for Sequence-Specific Control of Gene Expression," Cell 152:1173-1183 (2013).
Qi, L., et al., "RNA Processing Enables Predictable Programming of Gene Expression," Nat. Biotechnol. 30(10):1002-1007 (2012).
Quigley, H. A., et al., "Models of Open-Angle Glaucoma Prevalence and Incidence in the United States," Invest. Ophthalmol. Vis. Sci. 38(1):83-91 (1997).
Quinlan, A. R., et al., "BEDTools: A Flexible Suite of Utilities for Comparing Genomic Features," Bioinformatics 26(6):841-842 (2010).
Ran, F.A., et al., "Double Nicking by RNA-Guided CRISPR Cas9 for Enhanced Genome Editing Specificity," Cell 154(6):1380-1389 (2013).
Rand, T. A., et al., "Argonaute2 Cleaves the Anti-Guide Strand of siRNA During RISC Activation," Cell 123:621-629 (2005).
Raymond, C. S., et al., "High-Efficiency FLP and PhiC31 Site-Specific Recombination in Mammalian Cells," PLoS One 2(1):e162 (2007).
Rebar, E. J., et al., "Zinc Finger Phage: Affinity Selection of Fingers with New DNA-Binding Specificities," Science 263(5147):671-673 (1994).
Rebar, E. J., et al., "Induction of Angiogenesis in a Mouse Model Using Engineered Transcription Factors," Nat. Med. 8(12):1427-1432 (2008).
Recht, M. I., et al., "Monitoring Assembly of Ribonucleoprotein Complexes by Isothermal Titration Calorimetry," Methods in Mol. Biol. 488:117-127 (2008).
Regalado, A., "Who Owns the Biggest Biotech Discovery of the Century?," MIT Technology Review, Dec. 4, 2014, http://www.technologyreview.com/featuredstory/532796/who-owns-the-biggest--biotech-discovery-of-the-century/.
Reyon, D., et al., "FLASH Assembly of TALENs for High-Throughput Genome Editing," Nat. Biotech. 30:460-465 (2012).
Rho, M., et al. "Diverse CRISPRs Evolving in Human Microbiomes." PLoS Genetics 8(6):e1002441 (2012).
Sander, J. D., et al., "Zinc Finger Targeter (ZiFIT): An Engineered Zinc Finger/Target Site Design Tool," Nucleic Acids Res. 35:W599-W605 (2007).
Sander, J. D., et al., "ZiFIT (Zinc Finger Targeter): An Updated Zinc Finger Engineering Tool," Nucleic Acids Res. 38:W462-468 (2010).
Sander, J. D., et al., "CRISPR-Cas Systems for Editing, Regulating and Targeting Genomes," Nat. Biotechnol. 32(4):347-355 (2014).
Sanders, R., "Cheap and Easy Technique to Snip DNA Could Revolutionize Gene Therapy", Berkeley News Online, pp. 1-3 (Jan. 7, 2013).
Sanjana, N. E., et al., "A Transcription Activator-Like Effector (TALE) Toolbox for Genome Engineering," Nat. Protoc. 7(1):171-192 (2012).
Sapranauskas, R., et al., "The *Streptococcus thermophilus* CRISPR-Cas System Provides Immunity in *Escherichia coli*," Nucl. Acids Res.39:9275-9282 (2011).
Schramm, L., et al., "Recruitment of RNA Polymerase III to Its Target Promoters," Genes Devel. 16:2593-2620 (2002).
Selleck, W., et al., "Biophysical Characterization and Direct Delivery of S. Pyogenes Cas9 Ribonucleoprotein Complexes," Editas Medicine, Apr. 27, 2015, retrieved from URL http://www.editasmedicine.com/documents/ASGCT_poster_2015_Will.pdf.
Shanks, P., "CRISPR Opportunities . . . For What? And for Whom?," Biopolitical Times, Dec. 4, 2014, http://www.biopoliticaltimes.org/article.php?id=8235.
Sharma, R., et al., "In Vivo Genome Editing of the Albumin Locus as a Platform for Protein Replacement Therapy," Blood 126(15):1777-1784 (2015).
Shayakhmetov, D. M., et al., "Analysis of Adenovirus Sequestration in the Liver, Transduction of Hepatic Cells, and Innate Toxicity after Injection of Fiber-Modified Vectors," J. Virol. 78(10):5368-5381 (2004).
Sheffield, V. C., "Project Information—Novel Glaucoma Treatment Using Genome Editing," NIH Reporter (2014) Project No. 1R01EY024259-01, retrieved from: http://projectreporter.nih.gov/project_info_description.cfm?aid=8668519&icde=25569763&ddparam=&ddvalue=&ddsub=&cr=1&csb=default&cs=ASC.
Shen, B., et al., "Generation of Gene-Modified Mice via Cas9/RNA-Mediated Gene Targeting," Cell Res. 23:720-723 (2013).
Smith, T. F., et al., "Comparison of Biosequences," Adv. Appl. Math. 2(4):482-489 (1981).

(56) References Cited

OTHER PUBLICATIONS

Sontheimer, E., "Project 7: Establishing RNA-Directed DNA Targeting in Eukaryotic Cells; Project dates: Nov. 16, 2011 to Dec. 31, 2012," Physical Sciences—Oncology Center (Feb. 4, 2012).
Sternberg, S.H., et al., "DNA Interrogation by the CRISPR RNA-Guided Endonuclease Cas9," Nature 507(7490):62-67 (2014).
Sugimoto, N., et al., "Thermodynamic Parameters to Predict Stability of RNA/DNA Hybrid Duplexes," Biochem. 34:11211-11216 (1995).
Sugimoto, N., et al., "Thermodynamics-Structure Relationship of Single Mismatches in RNA/DNA Duplexes," Biochem. 39(37): 11270-11281 (2000).
Szczepek, M., et al., "Structure-Based Redesign of the Dimerization Interface Reduces the Toxicity of Zinc-Finger Nucleases," Nat. Biotechnol. 25:786-793 (2007).
Terns, M. P., et al., "CRISPR-based Adaptive Immune Systems," Curr. Opin. Microbiol. 14:321-327 (2011).
Thurman, R. E., et al., "The Accessible Chromatin Landscape of the Human Genome," Nature 489(7414):75-82 (2012).
Tolia, N. H., et al., "Slicer and the Argonautes," Nat. Chem. Biol. 3(1):36-43 (2007).
Tolpin, Thomas W., Third Party Observation for EP13793997.1, Jan. 6, 2015, 50 pages.
Tsai, S. Q., et al., "Dimeric CRISPR RNA-Guided FokI Nucleases for Highly Specific Genome Editing," Nat. Biotechnol. 32(6):569-576 (2014).
Tsai, S.Q., et al., "Open-Source GuideSeq Software for Analysis of GUIDE-Seq Data," Nat. Biotechnol. 34(5):483 (2016).
Urnov, F. D., et al., "Highly Efficient Endogenous Human Gene Correction Using Designed Zinc-Finger Nucleases," Nature 435:646-651 (2005).
Van Der Oost, J., "New Tool for Genome Surgery," Science 336:768-768 (2013).
Van Der Ploeg, J. R., "Analysis of CRISPR in *Streptococcus* Mutans Suggests Frequent Occurrence of Acquired Immunity Against Infection by M102-Like Bacteriophages," Microbiology 155:1966-1976 (2009).
Wang, H., et al., "One-Step Generation of Mice Carrying Mutations in Multiple Genes By CRISPR/Cas-Mediated Genome Engineering," Cell 153(4):910-918 (2013).
Wang, J., et al., "Homology-Driven Genome Editing in Hematopoietic Stem and Progenitor Cells Using ZFN mRNA and AAV6 Donors," Nat. Biotechnol. 33(12):1256-1263 (2015).
Wang, J., et al., "Highly Efficient Homology-Driven Genome Editing in Human T Cells by Combining Zinc-Finger Nuclease mRNA and AAV6 Donor Delivery," Nucleic Acids Res. 44(3):e30 (2016).
Wang, T., et al., "Genetic Screens in Human Cells Using the CRISPR-Cas9 System," Science 343(6166):80-84 (2013).
Waryah, A. M., et al., "The Novel Heterozygous Thr377Arg MYOC Mutation Causes Severe Juvenile Open Angle Glaucoma in a Large Pakistani Family," Gene 528(2):356-359 (2013).
Wiedenheft, B., et al., "RNA-Guided Genetic Silencing Systems in Bacteria and Archaea," Nature 482:331-338 (2012).
Wu, X., et al., "Genome-Wide Binding of the CRISPR Endonuclease Cas9 in Mammalian Cells," Nat. Biotechnol. 32(7):670-676 (2014).
Wu, Y., et al., "Correction of a Genetic Disease in Mouse via Use of CRISPR-Cas9," Cell Stem Cell 13(6):659-662 (2013).
Xiao, A., et al., "CasOT: A Genome-Wide Cas9/gRNA Off-Target Searching Tool," Bioinformatics 30(8):1180-1182 (2014).
Xu, Q., et al., "Design of 240,000 Orthogonal 25mer DNA Barcode Probes," Proc. Natl. Acad. Sci.106(7):2289-2294 (2009).
Yang, H., et al., "One-Step Generation of Mice Carrying Reporter and Conditional Alleles by CRISPR/Cas-Mediated Genome Engineering," Cell 154(6):1370-1390 (2013).
Zetsche, B., et al., "A Split-Cas9 Architecture for Inducible Genome Editing and Transcription Modulation," Nat. Biotechnol. 33(2):139-142 (2015).
Zheng, A., et al., "Personalized Therapeutic Strategies for Patients with Retinitis Pigmentosa," Expert Opin. Biol. Ther. 15(3):391-402 (2015).
Zhuo, Y. H., et al., "Pro370Leu MYOC Gene Mutation ni a Large Chinese Family with Juvenile-Onset Open Angle Glaucoma: Correlation Between Genotype and Phenotype," Mol. Vis. 14:1533-1539 (2008).
Zou, J., et al., "Gene Targeting of a Disease-Related Gene in Human Induced Pluripotent Stem and Embryonic Stem Cells," Cell Stem Cell 5(1):97-110 (2009).
7th Annual 2014 Midwest Eye Research Symposium Program, Aug. 8, 2014, retrieved from: http://webeye.ophth.uiowa.edu/eig/MERS_2014.html#Back.
European Patent Office, International Search Report and Written Opinion dated Jun. 24, 2015 for PCT/US2015/019064.
European Patent Office, International Search Report and Written Opinion dated Jul. 1, 2015 for PCT/US2015/019790.
European Patent Office, International Search Report and Written Opinion dated Sep. 28, 2015 for PCT/US2015/022856.
European Patent Office, International Search Report and Written Opinion dated Jul. 31, 2015 for PCT/US2015/022851.
European Patent Office, International Search Report and Written Opinion dated Aug. 10, 2015 for PCT/US2015/023906.
European Patent Office, International Search Report and Written Opinion dated Jul. 28, 2016 for PCT/US2016/029252.
European Patent Office, Examination Report for EP 13824232.6, Dec. 16, 2014, 4 pages.
United States Patent and Trademark Office, International Search Report and Written Opinion for PCT/US2013/075317, Apr. 15, 2014, 12 pages.
United States Patent and Trademark Office, International Search Report and Written Opinion for PCT/US2013/075326, Aug. 22, 2014, 13 pages.
United States Patent and Trademark Office, International Search Report and Written Opinion for PCT/US2014/027335, Jul. 16, 2014, 13 pages.
United States Patent and Trademark Office, International Search Report and Written Opinion for PCT/US2014/028630, Jul. 24, 2014, 9 pages.
United States Patent and Trademark Office, Invitation to Pay Additional Fees and, Where Applicable, Protest Fee for PCT/US2014/029068, Aug. 20, 2014, 3 pages.
United States Patent and Trademark Office, Office Action for U.S. Appl. No. 14/319,380, Jan. 28, 2015, 47 pages.
United States Patent and Trademark Office, Office Action for U.S. Appl. No. 14/319,530, Apr. 1, 2015, 23 pages.

* cited by examiner

*Streptococcus thermophilus* a) Structure (See, e.g., Karvelis et al. RNA Biology. 2013; 10(5): 841-851)

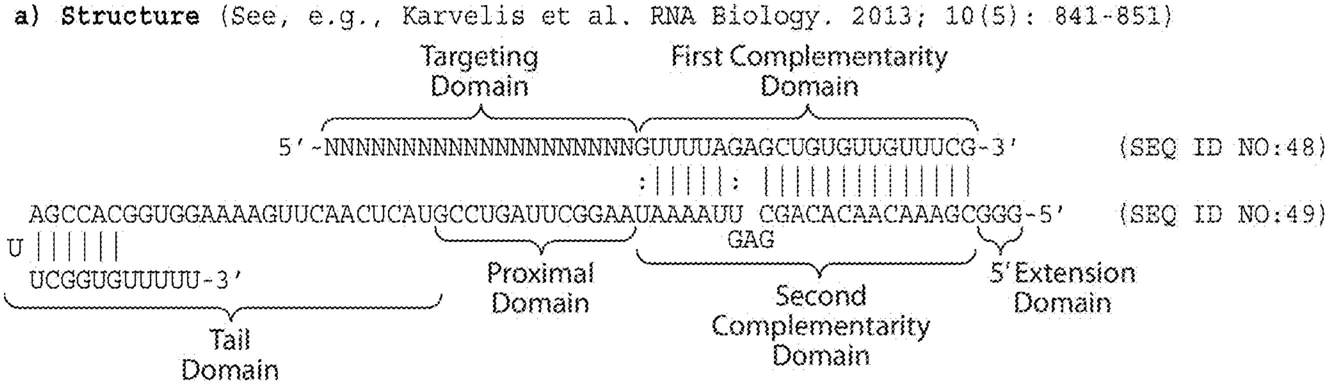

Fig. 1F

*Alignment*

```
S. pyogenes      5'-NNNNNNNNNNNNNNNNNNNNGUUUUAGAGCUAUGCUGUUUUG-3'      (SEQ ID NO:50)
S. thermophilus  5'-NNNNNNNNNNNNNNNNNNNNGUUUUAGAGCUGUGUUGUUUCG-3'      (SEQ ID NO:51)
                                       *********** ** ***** *

S. pyogenes      5'-GAACCAUUCAAAACAGCAUAGCAAGUUAAAAUAAGGC-UAGUCCGUUAUCAACUUGAAAAAGUGGCACCGAGUCGGUGCUUUUUUU-3'
S. thermophilus  5'------GGGCGAAACAACACAGCGAGUUAAAAUAAGGCUUAGUCCGUACUCAACUUGAAAAGGUGGCACCGAUUCGGUGUUUUU----3'
                       * ***** ** *** ************** ********  ************ ********** ****** ****

S. pyogenes - cont          (SEQ ID NO:52)
S. thermophilus - cont      (SEQ ID NO:53)
```

Fig. 1G

```
CLUSTAL format alignment by MAFFT (v7.058b)
                                                        Y
                       *
SM          KKPYSIGLDIGTNSVGWAVVTDDYKVPAKKMKVLGNTDKSHIEKNLLGALLFDSGNTAED
SP          DKKYSIGLDIGTNSVGWAVITDEYKVPSKKFKVLGNTDRHSIKKNLIGALLFDSGETAEA
ST          TKPYSIGLDIGTNSVGWAVTTDNYKVPSKKMKVLGNTSKKYIKKNLLGVLLFDSGITAEG
LI          KKPYTIGLDIGTNSVGWAVLTDQYDLVKRKMKIAGDSEKKQIKKNFWGVRLFDEGQTAAD
             * *:************ **:*.:  :*:*: *::.:  *:**: *. ***.* **
Motif:      -K-Y*IGLDIGTNSVGWAV-TD*Y-*---*K*K*-G**-*--I*KN*-G--LFD-G-TA--

SM          RRLKRTARRRYTRRRNRILYLQEIFSEEMGKVDDSFFHRLEDSFLVTEDKRGERHPIFGN
SP          TRLKRTARRRYTRRKNRICYLQEIFSNEMAKVDDSFFHRLEESFLVEEDKKHERHPIFGN
ST          RRLKRTARRRYTRRRNRILYLQEIFSTEMATLDDAFFQRLDDSFLVPDDKRDSKYPIFGN
LI          RRMARTARRRIERRRNRISYLQGIFAEEMSKTDANFFCRLSDSFYVDNEKRNSRHPFFAT
             *: ******  **:*** *** **: **.. *  ** **.:** * ::*: .::*:*..
Motif:      -R*-RTARRR--RR*NRI-YLQ-IF*-EM---D--FF-RL-*SF-V-**K*--**P*F--

SM          LEEEVKYHENFPTIYHLRQYLADNPEKVDLRLVYLALAHIIKFRGHFLIEGKFDTRNNDV
SP          IVDEVAYHEKYPTIYHLRKKLVDSTDKADLRLIYLALAHMIKFRGHFLIEGDLNPDNSDV
ST          LVEEKAYHDEFPTIYHLRKYLADSTKKADLRLVYLALAHMIKYRGHFLIEGEFNSKNNDI
LI          IEEEVEYHKNYPTIYHLREELVNSSEKADLRLVYLALAHIIKYRGNFLIEGALDTQNTSV
            : :*  **.::*******: *.:...*.****:******:**:**:*****  ::. *..:
Motif:      *--*E--YH-**PTIYHLR*-L-*----K-DLRL*YLALAH*IK*RGNFLIEG-**--N--*
```

Fig. 2A

```
SM      QRLFQEFLAVYDNTFENSS------LQEQNVQVEEILTDKISKSAKKDRVLKLFPNEKSN
SP      DKLFIQLVQTYNQLFEENP------INASGVDAKAILSARLSKSRRLENLIAQLPGEKKN
ST      QKNFQDFLDTYNAIFESDL------SLENSKQLEEIVKDKISKLEKKDRILKLFPGEKNS
LI      DGIYKQFIQTYNQVFASGIEDGSLKKLEDNKDVAKILVEKVTRKEKLERILKLYPGEKSA
        :  : ::: .*:  * ..             .. :   *:  ::::  : :.::   *.**.
Motif:  *--*-***--Y*--f----------------*---I*--****--*-*-**---P-EK--

SM      GRFAEFLKLIVGNQADFKKHFELEEKAPLQFSKDTYEEELEVLLAQIGDNYAELFLSAKK
SP      GLFGNLIALSLGLTPNFKSNFDLAEDAKLQLSKDTYDDDLDNLLAQIGDQYADLFLAAKN
ST      GIFSEFLKLIVGNQADFRKCFNLDEKASLHFSKESYDEDLETLLGYIGDDYSDVFLKAKK
LI      GMFAQFISLIVGSKGNFQKPFDLIEKSDIECAKDSYEEDLESLLALIGDEYAELFVAAKN
        * *.::: * :*   :*:. *:* *.: :. :*::*:::*: **. ***:*:::*: **:
Motif:  G-F-***-L-*G---*F*--F*L-E-*-*--*K**Y***L*-LL--IGD*Y***F*-AK*

SM      LYDSILLSGILTVTDVGTKAPLSASMIQRYNEHQMDLAQLKQFIRQKLSDKYNEVFSDVS
SP      LSDAILLSDILRVNTEITKAPLSASMIKRYDEHHQDLTLLKALVRQQLPEKYKEIFFDQS
ST      LYDAILLSGFLTVTDNETEAPLSSAMIKRYNEHKEDLALLKEYIRNISLKTYNEVFKDDT
LI      AYSAVVLSSIITVAETETNAKLSASMIERFDTHEEDLGELKAFIKLHLPKHYEEIFSNTE
          .:::**.:: *    *:* **::**:*:: *. **   **  ::    . *:*:* :
Motif:  ---***LS-**-V----T*A-LS**MI*R**-H--DL--LK--*-------Y*E*F-*--

SM      KDGYAGYIDGKTNQEAFYKYLKGLLNKIEGSGYFLDKIEREDFLRKQRTFDNGSIPHQIH
SP      KNGYAGYIDGGASQEEFYKFIKPILEKMDGTEELLVKLNREDLLRKQRTFDNGSIPHQIH
ST      KNGYAGYIDGKTNQEDFYVYLKKLLAEFEGADYFLEKIDREDFLRKQRTFDNGSIPYQIH
LI      KHGYAGYIDGKTKQADFYKYMKMTLENIEGADYFIAKIEKENFLRKQRTFDNGAIPHQLH
        *.******** :.*  ** ::*  * :::*:  :: *:::*::*********:**:*:*
Motif:  K-GYAGYIDG-*-Q--FY-**K--L-***G*--**-K***E**LRKQRTFDNG*IP*Q*H
```

Fig. 2B

```
SM       LQEMRAIIRRQAEFYPFLADNQDRIEKLLTFRIPYYVGPLARGKSDFAWLSRKSADKITP
SP       LGELHAILRRQEDFYPFLKDNREKIEKILTFRIPYYVGPLARGNSRFAWMTRKSEETITP
ST       LQEMRAILDKQAKFYPFLAKNKERIEKILTFRIPYYVGPLARGNSDFAWSIRKRNEKITP
LI       LEELEAILHQQAKYYPFLKENYDKIKSLVTFRIPYFVGPLANGQSEFAWLTRKADGEIRP
         * *:.**: :* .:**** .* ::*:.::******:*****.*:* ***  **    * *
Motif:   L-E*-AI*-*Q--*YPFL--N-**I*-**TFRIPY*VGPLA-G*S-FAW--RK----I-P

SM       WNFDEIVDKESSAEAFINRMTNYDLYLPNQKVLPKHSLLYEKFTVYNELTKVKYKTE-QG
SP       WNFEEVVDKGASAQSFIERMTNFDKNLPNEKVLPKHSLLYEYFTVYNELTKVKYVTEGMR
ST       WNFEDVIDKESSAEAFINRMTSFDLYLPEEKVLPKHSLLYETFNVYNELTKVRFIAESMR
LI       WNIEEKVDFGKSAVDFIEKMTNKDTYLPKENVLPKHSLCYQKYLVYNELTKVRYIND-QG
         **::: :*   **  **::**. *  **:::******* *: : ********::   :
Motif:   WN***-*D---SA--FI**MT--D--LP***VLPKHSL-Y*-*-VYNELTKV**--*---

SM       KTAFFDANMKQEIFDGVFKVYRKVTKDKLMDFLEKEFDEFRIVDLTGLDKENKVFNASYG
SP       KPAFLSGEQKKAIVDLLFKTNRKVTVKQLKEDYFKKIECFDSVEISGVEDR---FNASLG
ST       DYQFLDSKQKKDIVRLYFKDKRKVTDKDIIEYL-HAIYGYDGIELKGIEKQ---FNSSLS
LI       KTSYFSGQEKEQIFNDLFKQKRKVKKKDLELFL-RNMSHVESPTIEGLEDS---FNSSYS
         .  ::..: *: *.   **  ***. ..:      : :        : *::.   **:* .
Motif:   ---**--*-K*-I----FK--RKV----*------*-*--------*-G**------FN*S--

SM       TYHDLCKIL-DKDFLDNSKNEKILEDIVLTLTLFEDREMIRKRLENYSDLLTKEQVKKLE
SP       TYHDLLKIIKDKDFLDNEENEDILEDIVLTLTLFEDREMIEERLKTYAHLFDDKVMKQLK
ST       TYHDLLNIINDKEFLDDSSNEAIIEEIIHTLTIFEDREMIKQRLSKFENIFDKSVLKKLS
LI       TYHDLLKVGIKQEILDNPVNTEMLENIVKILTVFEDKRMIKEQLQQFSDVLDGVVLKKLE
         ***** ::  .:::**:  *  ::*:*:  **:***:.**.::*. : .::    :*:*.
Motif:   TYHDL-**----***LD*--N--**E*I*--LT*FED*-MI-**L--*--**-----*K*L-
```

Fig. 2C

```
SM       KLLSAKLITQRKFDNLTKAERGGLTDDDKAGFIKRQLVETRQITKHVARILDERFNTETD
SP       QLLNAKLITQRKFDNLTKAERGGLSELDKAGFIKRQLVETRQITKHVAQILDSRMNTKYD
ST       QLLKSKLISQRKFDNLTKAERGGLSPEDKAGFIQRQLVETRQITKHVARLLDEKFNNKKD
LI       KLYQGNLMSKRKFDYLTKAERGGLTEADKARFIHRQLVETRQITKNVANILHQRFNYEKD
         :*  ..:*:::****  *********:   ***  **:***********:**.:*..::*  :  *
Motif:   *L---*L***RKFD-LTKAERGGL*--DKA-FI*RQLVETRQITK*VA-*L--**N-*-D

SM       ENNKKIRQVKIVTLKSNLVSNFRKEFELYKVREINDYHHAHDAYLNAVIGKALLGVYPQL
SP       ENDKLIREVKVITLKSKLVSDFRKDFQFYKVREINNYHHAHDAYLNAVVGTALIKKYPKL
ST       ENNRAVRTVKIITLKSTLVSQFRKDFELYKVREINDFHHAHDAYLNAVVASALLKKYPKL
LI       DHGNTMKQVRIVTLKSALVSQFRKQFQLYKVRDVNDYHHAHDAYLNGVVANTLLKVYPQL
         ::..  ::  *:::****  ***:***:*::****::*::*********.*:..:*:   **:*
Motif:   **----**-V***TLKS-LVS*FRK*F**LYKV**N**HHAHDAYLN-V*--*L*--YP*L

SM       EPEFVYGDYPHFHGHKE--------NK-ATAKKFFYSNIMNFFKKDDVRTD---------
SP       ESEFVYGDYKVYDVRKMIAKSEQEIGK-ATAKYFFYSNIMNFFKTEITLANGEIRKRPLI
ST       EPEFVYGDYPKYNSFRE--------RKSATEKVYFYSNIMNIFKKSISLADGRVIERPLI
LI       EPEFVYGDYHQFDWFKA--------NK-ATAKKQFYTNIMLFFAQKDRIID---------
         *.*******  :.   :             *  **  *   **:***  :*   .     :
Motif:   E-EFVYGDY--*---*----------K-AT-K--FY*NIM-*F-------*---------

SM       ----KNGEIIWKKDEHISNIKKVLSYPQVNIVKKVEEQTGGFSKE----------SILPK
SP       ETNGETGEIVWDKGRDFATVRKVLSMPQVNIVKKTEVQTGGFSKE----------SILPK
ST       EVNEETGESVWNKESDLATVRRVLSYPQVNVVKKVEEQNHGLDRGKPKGLFNANLSSKPK
LI       ----ENGEILWDK-KYLDTVKKVMSYRQMNIVKKTEIQKGEFSKA----------TIKPK
             :.** :*.*    :  .:::*:*   *:*:***.* *.   :.:            :   **
Motif:   ----*-GE-*W-K---*--***V*M--Q*N*VKK-E-Q---*-*-----------*--PK
```

B

Fig. 2E

```
SM      GNSDK-LIPRKTKKFYWDTKKYGGFDSPIVAYSILVIADIEKGKSKKLKTVKALVGVTIM
SP      RNSDK-LIARKKD---WDPKKYGGFDSPTVAYSVLVVAKVEKGKSKKLKSVKELLGITIM
ST      PNSNENLVGAKEY---LDPKKYGGYAGISNSFTVLVKGTIEKGAKKKITNVLEFQGISIL
LI      GNSSK-LIPRKTN---WDPMKYGGLDSPNMAYAVVI--EYAKGKN-KLVFEKKIIRVTIM
         **.: *:  *      *. ****  .   ::::::    ** . *:     :  ::*:
Motif:  -NS-*-L*--K------D--KYGG------******-----KG---K*-----*--**I*

SM      EKMTFERDPVAFLERKGYRNVQEENIIKLPKYSLFKLENGRKRLLAS-------ARELQK
SP      ERSSFEKNPIDFLEAKGYKEVKKDLIIKLPKYSLFELENGRKRMLAS-------AGELQK
ST      DRINYRKDKLNFLLEKGYKDI--ELIIELPKYSLFELSDGSRRMLASILSTNNKRGEIHK
LI      ERKAFEKDEKAFLEEQGYRQP--KVLAKLPKYTLYECEEGRRRMLAS-------ANEAQK
        ::  :.::   **  :**::   . : :****:*:: .:* :*:***          * :*
Motif:  **--*-**---FL--*GY**-----*-*LPKY*L**--*G-*R*LAS---------E-*K

SM      GNEIVLPNHLGTLLYHAKNIHKV------DEPKHLDYVDKHKDEFKELLDVVSNFSKKYT
SP      GNELALPSKYVNFLYLASHYEKLKGSPEDNEQKQL-FVEQHKHYLDEIIEQISEFSKRVI
ST      GNQIFLSQKFVKLLYHAKRISNT------INENHRKYVENHKKEFEELFYYILEFNENYV
LI      GNQQVLPNHLVTLLHHAANCEVS-------DGKSLDYIESNREMFAELLAHVSEFAKRYT
        **:  *..:  .:*: * .            : :   :::.::. : *::  : :* :.
Motif:  GN*--L--*---*L*-A-----------*-*---***-**--*-E**--*-*F-*---

SM      LAEGNLEKIKELYAQNNGEDLKELASSFI--------NLLTFTAIGAPATFKFFDKNIDR
SP      LADANLDKVLSAYNKHRDKPIREQAENII--------HLFTLTNLGAPAAFKYFDTTIDR
ST      GAKKNGKLLNSAFQSWQNHSIDELCSSFIGPTGSERKGLFELTSRGSAADFEFLGVKIPR
LI      LAEANLNKINQLFEQNKEGDIKAIAQSFV--------DLMAFNAMGAPASFKFFETTIER
         *. * . : . : . .   :    ...::         *: :.  *:.* *:::  .* *
Motif:  -A--N---*---*-------*------**---------L*-*---G*-A-F***---I-R
```

Fig. 2F

```
SM        KR-YTSTTEILNATLIHQSITGLYETRIDLNKLGGD   (SEQ ID NO:1)
SP        KR-YTSTKEVLDATLIHQSITGLYETRIDLSQLGGD   (SEQ ID NO:2)
ST        YRDYTPSSLLKDATLIHQSVTGLYETRIDLAKLGEG   (SEQ ID NO:3)
LI        KR-YNNLKELLNSTIIYQSITGLYESRKRLD----D   (SEQ ID NO:4)
           * *.  . :  ::*:*:**:*****:*  *     .
Motif:    -R-Y-----*-**T*I*QS*TGLYE*R--L------
```

Fig. 2G

Alignment of the N terminal RuvC-like Domains disclosed in Chylinski *et al.* (excluding sequence outliers).
(CLUSTAL format alignment by MAFFT (v7.058b))

| | | |
|---|---|---|
| 1 | DIGTNSVGWAVT | (SEQ ID NO:54) |
| 12 | DIGTNSVGWAVT | (SEQ ID NO:55) |
| 3 | DVGTNSVGWAVT | (SEQ ID NO:56) |
| 20 | DVGTNSVGWAVT | (SEQ ID NO:57) |
| 15 | DMGTNSVGWAVT | (SEQ ID NO:58) |
| 4 | DVGTSSVGWAVT | (SEQ ID NO:59) |
| 7 | DIGTASVGWAVT | (SEQ ID NO:60) |
| 6 | DVGTGSVGWAVT | (SEQ ID NO:61) |
| 9 | DIGTNSVGWAVV | (SEQ ID NO:62) |
| 10 | DIGTNSVGWAVI | (SEQ ID NO:63) |
| 11 | DIGTNSVGWAVL | (SEQ ID NO:64) |
| 42 | DLGTNSIGWAVV | (SEQ ID NO:65) |
| 48 | DLGTNSIGWAI- | (SEQ ID NO:66) |
| 43 | DLGTNSIGWALV | (SEQ ID NO:67) |
| 2 | DIGTNSVGWCVT | (SEQ ID NO:68) |
| 14 | DIGTNSVGYAVT | (SEQ ID NO:69) |
| 5 | DMGTGSLGWAVT | (SEQ ID NO:70) |
| 16 | DIGTSSVGWAAI | (SEQ ID NO:71) |
| 8 | DLGTGSVGWAVV | (SEQ ID NO:72) |
| 22 | DLGVGSVGWAIV | (SEQ ID NO:73) |
| 23 | DLGIASIGWAII | (SEQ ID NO:74) |
| 24 | DLGIASVGWAIV | (SEQ ID NO:75) |
| 25 | DLGVASVGWSIV | (SEQ ID NO:76) |
| 26 | DIGIASVGWAIL | (SEQ ID NO:77) |
| 28 | DLGISSVGWSVI | (SEQ ID NO:78) |
| 32 | DIGIASVGWSVI | (SEQ ID NO:79) |
| 33 | DVGIGSIGWAVI | (SEQ ID NO:80) |
| 39 | DLGVGSIGFAIV | (SEQ ID NO:81) |
| 34 | DIGYASIGWAVI | (SEQ ID NO:82) |
| 47 | DTGTNSLGWAIV | (SEQ ID NO:83) |
| 50 | DLGTNSIGWCLL | (SEQ ID NO:84) |
| 49 | DIGTDSLGWAVF | (SEQ ID NO:85) |
| 18 | DIGSNSIGFAVV | (SEQ ID NO:86) |
| 41 | DLGVGSIGVAVA | (SEQ ID NO:87) |
| 45 | DLGIASCGWGVV | (SEQ ID NO:88) |

Fig. 3A

```
21     DLGIASVGWCLT  (SEQ ID NO:89)
27     DIGIGSVGVGIL  (SEQ ID NO:90)
29     DIGITSVGYGLI  (SEQ ID NO:91)
30     DIGITSVGFGII  (SEQ ID NO:92)
31     DVGITSTGYAVL  (SEQ ID NO:93)
40     DLGITSFGYAIL  (SEQ ID NO:94)
17     DIGNASVGWSAF  (SEQ ID NO:95)
19     DVGTNSCGWVAM  (SEQ ID NO:96)
35     DVGERSIGLAAV  (SEQ ID NO:97)
36     DVGLNSVGLAAV  (SEQ ID NO:98)
37     DVGLMSVGLAAI  (SEQ ID NO:99)
38     DVGTFSVGLAAI  (SEQ ID NO:100)
13     DIGTGSVGYACM  (SEQ ID NO:101)
44     DLGTTSIGFAHI  (SEQ ID NO:102)
46     DLGTNSIGSSVR  (SEQ ID NO:103)
       * *  * *
```

Fig. 3B

Alignment of the N terminal RuvC-like Domains disclosed in Chylinski *et al.*
(CLUSTAL format alignment by MAFFT (v7.058b))

| | | |
|---|---|---|
| 1 | D----IGTNSVGWAVT | (SEQ ID NO:104) |
| 12 | D----IGTNSVGWAVT | (SEQ ID NO:105) |
| 3 | D----VGTNSVGWAVT | (SEQ ID NO:106) |
| 20 | D----VGTNSVGWAVT | (SEQ ID NO:107) |
| 15 | D----MGTNSVGWAVT | (SEQ ID NO:108) |
| 4 | D----VGTSSVGWAVT | (SEQ ID NO:109) |
| 7 | D----IGTASVGWAVT | (SEQ ID NO:110) |
| 6 | D----VGTGSVGWAVT | (SEQ ID NO:111) |
| 9 | D----IGTNSVGWAVV | (SEQ ID NO:112) |
| 10 | D----IGTNSVGWAVI | (SEQ ID NO:113) |
| 52 | D----IGTNSIGWAVI | (SEQ ID NO:114) |
| 11 | D----IGTNSVGWAVL | (SEQ ID NO:115) |
| 42 | D----LGTNSIGWAVV | (SEQ ID NO:116) |
| 48 | D----LGTNSIGWAI- | (SEQ ID NO:117) |
| 43 | D----LGTNSIGWALV | (SEQ ID NO:118) |
| 2 | D----IGTNSVGWCVT | (SEQ ID NO:119) |
| 14 | D----IGTNSVGYAVT | (SEQ ID NO:120) |
| 5 | D----MGTGSLGWAVT | (SEQ ID NO:121) |
| 16 | D----IGTSSVGWAAI | (SEQ ID NO:122) |
| 8 | D----LGTGSVGWAVV | (SEQ ID NO:123) |
| 22 | D----LGVGSVGWAIV | (SEQ ID NO:124) |
| 23 | D----LGIASIGWAII | (SEQ ID NO:125) |
| 24 | D----LGIASVGWAIV | (SEQ ID NO:126) |
| 68 | D----LGIASVGWAVV | (SEQ ID NO:127) |
| 25 | D----LGVASVGWSIV | (SEQ ID NO:128) |
| 26 | D----IGIASVGWAIL | (SEQ ID NO:129) |
| 66 | D----IGIASVGWAVL | (SEQ ID NO:130) |
| 59 | D----IGIASIGWAVI | (SEQ ID NO:131) |
| 61 | D----IGIASVGWAII | (SEQ ID NO:132) |
| 64 | D----VGIASVGWAVI | (SEQ ID NO:133) |
| 62 | D----IGIASVGWAL- | (SEQ ID NO:134) |
| 67 | D----IGIASVGWAMV | (SEQ ID NO:135) |
| 32 | D----IGIASVGWSVI | (SEQ ID NO:136) |
| 28 | D----LGISSVGWSVI | (SEQ ID NO:137) |
| 63 | D----IGITSVGWAVI | (SEQ ID NO:138) |

Fig. 4A

```
33   D----VGIGSIGWAVI    (SEQ ID NO:139)
57   D----LGISSLGWAIV    (SEQ ID NO:140)
39   D----LGVGSIGFAIV    (SEQ ID NO:141)
34   D----IGYASIGWAVI    (SEQ ID NO:142)
50   D----LGTNSIGWCLL    (SEQ ID NO:143)
54   D----LGTNSIGWGLL    (SEQ ID NO:144)
47   D----TGTNSLGWAIV    (SEQ ID NO:145)
49   D----IGTDSLGWAVF    (SEQ ID NO:146)
51   D----LGSTSLGWAIF    (SEQ ID NO:147)
58   D----IGISSIGWAFS    (SEQ ID NO:148)
21   D----LGIASVGWCLT    (SEQ ID NO:149)
45   D----LGIASCGWGVV    (SEQ ID NO:150)
18   D----IGSNSIGFAVV    (SEQ ID NO:151)
65   D----IGTTSIGFSVI    (SEQ ID NO:152)
29   D----IGITSVGYGLI    (SEQ ID NO:153)
30   D----IGITSVGFGII    (SEQ ID NO:154)
44   D----LGTTSIGFAHI    (SEQ ID NO:155)
27   D----IGIGSVGVGIL    (SEQ ID NO:156)
41   D----LGVGSIGVAVA    (SEQ ID NO:157)
31   D----VGITSTGYAVL    (SEQ ID NO:158)
40   D----LGITSFGYAIL    (SEQ ID NO:159)
53   D----IGTSSIGWWLY    (SEQ ID NO:160)
55   D----LGSNSLGWFVT    (SEQ ID NO:161)
56   D----LGANSLGWFVV    (SEQ ID NO:162)
17   D----IGNASVGWSAF    (SEQ ID NO:163)
19   D----VGTNSCGWVAM    (SEQ ID NO:164)
35   D----VGERSIGLAAV    (SEQ ID NO:165)
36   D----VGLNSVGLAAV    (SEQ ID NO:166)
37   D----VGLMSVGLAAI    (SEQ ID NO:167)
38   D----VGTFSVGLAAI    (SEQ ID NO:168)
13   D----IGTGSVGYACM    (SEQ ID NO:169)
46   D----LGTNSIGSSVR    (SEQ ID NO:170)
60   DIGLRIGITSCGWSI-    (SEQ ID NO:171)
69   D----MGAKYTGVFYA    (SEQ ID NO:172)
73   D----LGGKNTGFFSF    (SEQ ID NO:173)
74   D----LGVKNTGVFSA    (SEQ ID NO:174)
70   D----LGAKFTGVALY    (SEQ ID NO:175)
71   D----LGGKFTGVCLS    (SEQ ID NO:176)
72   D----LGGTYTGTFIT    (SEQ ID NO:177)
     *     *    *
```

Fig. 4B

Alignment of the HNH-like Domains disclosed in Chylinski *et al.*
(CLUSTAL format alignment by MAFFT (v7.058b))

```
1     YDIDHIYPRS-LTKD------DSF-DNLVLCERTAN    (SEQ ID NO:178)
2     -DIDHIYPRSKVIKD------DSF-DNLVLVLKNEN    (SEQ ID NO:179)
3     -DRDHIYPQS-KIKD------DSI-DNLVLVNKTYN    (SEQ ID NO:180)
4     -DIDHIYPRS-KIKD------DSI-TNRVLVEKDIN    (SEQ ID NO:181)
6     -DIDHIYPQS-KIKD------DSI-SNRVLVCSSCN    (SEQ ID NO:182)
5     -DIDHIYPQS-KTMD------DSL-NNRVLVKKNYN    (SEQ ID NO:183)
7     -DQDHIYPKS-KIYD------DSL-ENRVLVKKNLN    (SEQ ID NO:184)
8     -QIDHIVPQS-LVKD------DSF-DNRVLVVPSEN    (SEQ ID NO:185)
9     -DIDHIIPQA-FIKD------NSI-DNRVLTSSKEN    (SEQ ID NO:186)
12    -DIDHIIPQA-FLKD------NSI-DNKVLVSSASN    (SEQ ID NO:187)
16    -DIDHIIPQA-YTKD------NSL-DNRVLVSNITN    (SEQ ID NO:188)
11    -DIDHIVPQS-FITD------NSI-DNLVLTSSAGN    (SEQ ID NO:189)
10    -DVDHIVPQS-FLKD------DSI-DNKVLTRSDKN    (SEQ ID NO:190)
14    -NIDHIYPQS-MVKD------DSL-DNKVLVQSEIN    (SEQ ID NO:191)
18    -DIDHILPQS-LIKD------DSL-DNRVLVNATIN    (SEQ ID NO:192)
19    -DIDHILPQS-FIKD------DSL-ENRVLVKKAVN    (SEQ ID NO:193)
13    -EVDHIFPRS-FIKD------DSI-DNKVLVIKKMN    (SEQ ID NO:194)
15    -EVDHIIPRS-YIKD------DSF-ENKVLVYREEN    (SEQ ID NO:195)
17    -DIDHIIPQA-VTQN------DSI-DNRVLVARAEN    (SEQ ID NO:196)
22    -EIDHIIPYS-ISFD------DSS-SNKLLVLAESN    (SEQ ID NO:197)
24    -EIDHIIPYS-LCFD------DSS-ANKVLVHKQSN    (SEQ ID NO:198)
32    -DIDHIIPYS-RSMD------DSY-SNKVLVLSGEN    (SEQ ID NO:199)
63    -DIDHIIPYS-KSMD------DSF-NNKVLCLAEEN    (SEQ ID NO:200)
59    -EIDHIYPYS-RSFD------DSY-MNKVLVFTKQN    (SEQ ID NO:201)
65    -QIDHIYPYS-RSMD------DSY-MNKVLVLTDEN    (SEQ ID NO:202)
64    -EIDHIIPFS-RSFD------DSL-SNKILVLGSEN    (SEQ ID NO:203)
68    -EIDHALPFS-RTWD------DSF-NNKVLVLGSEN    (SEQ ID NO:204)
69    -EIDHALPFS-RTWD------DSF-NNKVLVLASEN    (SEQ ID NO:205)
28    -EIDHIIPIS-ISLD------DSI-NNKVLVLSKAN    (SEQ ID NO:206)
30    -EVDHIIPIS-ISLD------DSI-TNKVLVTHREN    (SEQ ID NO:207)
62    -QVDHALPYS-RSYD------DSK-NNKVLVLTHEN    (SEQ ID NO:208)
27    -EVDHILPLS-ITFD------DSL-ANKVLVYATAN    (SEQ ID NO:209)
26    -EIDHIIPRS-ISFD------DAR-SNKVLVYRSEN    (SEQ ID NO:210)
```

Fig. 5A

| | | |
|---|---|---|
| 29 | -EVDHIIPRS-VSFD------NSY-HNKVLVKQSEN | (SEQ ID NO:211) |
| 67 | -DIDHILPYS-ITFD------DSF-RNKVLVTSQEN | (SEQ ID NO:212) |
| 58 | -EIDHILPRS-RSAD------DSF-ANKVLCLARAN | (SEQ ID NO:213) |
| 51 | -EIEHLLPFS-LTLD------DSM-ANKTVCFRQAN | (SEQ ID NO:214) |
| 55 | -DIDHILPFS-VSLD------DSA-ANKVVCLREAN | (SEQ ID NO:215) |
| 57 | -DIDHLIPFS-ISWD------DSA-ANKVVCMRYAN | (SEQ ID NO:216) |
| 56 | -DIDHILPVA-MTLD------DSP-ANKIICMRYAN | (SEQ ID NO:217) |
| 54 | -DVDHILPYS-RTLD------DSF-PNRTLCLREAN | (SEQ ID NO:218) |
| 52 | -EIEHILPFS-RTLD------DSL-NNRTVAMRRAN | (SEQ ID NO:219) |
| 31 | -EVDHIIPYS-ISWD------DSY-TNKVLTSAKCN | (SEQ ID NO:220) |
| 45 | -QVDHILPWS-RFGD------DSY-LNKTLCTARSN | (SEQ ID NO:221) |
| 53 | -QVDHILPFS-KTLD------DSF-ANKVLAQHDAN | (SEQ ID NO:222) |
| 60 | -QIDHAFPLS-RSLD------DSQ-SNKVLCLTSSN | (SEQ ID NO:223) |
| 21 | -DIDHIVPRS-ISFD------DSF-SNLVIVNKLDN | (SEQ ID NO:224) |
| 23 | -EIEHIIPYS-MSYD------NSQ-ANKILTEKAEN | (SEQ ID NO:225) |
| 25 | -EIDHVIPYS-KSAD------DSW-FNKLLVKKSTN | (SEQ ID NO:226) |
| 49 | -EMDHILPYS-RSLD------NGW-HNRVLVHGKDN | (SEQ ID NO:227) |
| 33 | -EVDHIVPYS-LILD------NTI-NNKALVYAEEN | (SEQ ID NO:228) |
| 42 | -EIEHVIPQS-LYFD------DSF-SNKVICEAEVN | (SEQ ID NO:229) |
| 43 | -DIEHIIPQA-RLFD------DSF-SNKTLEARSVN | (SEQ ID NO:230) |
| 44 | -EIEHIVPKA-RVFD------DSF-SNKTLTFHRIN | (SEQ ID NO:231) |
| 20 | -DKDHIIPQS-MKKD------DSIINNLVLVNKNAN | (SEQ ID NO:232) |
| 66 | -EVEHIWPRS-RSFD------NSP-RNKTLCRKDVN | (SEQ ID NO:233) |
| 61 | -IVNHIIPYN-RSFD------DTY-HNRVLTLTETK | (SEQ ID NO:234) |
| 46 | -DMEHTIPKS-ISFD------NSD-QNLTLCESYYN | (SEQ ID NO:235) |
| 47 | -DIEHTIPRS-AGGD------STK-MNLTLCSSRFN | (SEQ ID NO:236) |
| 48 | -DIEHTIPRS-ISQD------NSQ-MNKTLCSLKFN | (SEQ ID NO:237) |
| 50 | -DIDHVIPLA-RGGR------DSL-DNMVLCQSDAN | (SEQ ID NO:238) |
| 39 | -DIEHLFPIA-ESED------NGR-NNLVISHSACN | (SEQ ID NO:239) |
| 41 | -DVDHIFPRD-DTAD------NSY-GNKVVAHRQCN | (SEQ ID NO:240) |
| 40 | -DIEHIVPQS-LGGL------STD-YNTIVTLKSVN | (SEQ ID NO:241) |
| 35 | -ELDHIVPRT-DGGS------NRH-ENLAITCGACN | (SEQ ID NO:242) |
| 36 | -EMDHIVPRKGVGST------NTR-TNFAAVCAECN | (SEQ ID NO:243) |
| 37 | -EMDHIVPRKGVGST------NTR-VNLAAACAACN | (SEQ ID NO:244) |
| 38 | -EMDHIVPRAGQGST------NTR-ENLVAVCHRCN | (SEQ ID NO:245) |
| 70 | -EIDHILPRS-LIKDARGIVFNAE-PNLIYASSRGN | (SEQ ID NO:246) |
| 71 | -EIDHIIPRS-LTGRTKKTVFNSE-ANLIYCSSKGN | (SEQ ID NO:247) |
| 73 | -EIDHIIPRS-LTLKKSESIYNSE-VNLIFVSAQGN | (SEQ ID NO:248) |

Fig. 5B

```
72    -EIDHIYPRS-LSKKHFGVIFNSE-VNLIYCSSQGN    (SEQ ID NO:249)
74    -EIDHILPRS-HTLKIYGTVFNPE-GNLIYVHQKCN    (SEQ ID NO:250)
75    -ELDHIIPRS-HKKY---GTLNDE-ANLICVTRGDN    (SEQ ID NO:251)
34    -ELEHIVPHS-FRQS------NAL-SSLVLTWPGVN    (SEQ ID NO:252)
         :*   *            .    .        :
```

Fig. 5C

Alignment of the HNH-like Domains disclosed in Chylinski *et al.* (excluding sequence outliers).
(CLUSTAL format alignment by MAFFT (v7.058b))

```
1    YDIDHIYPRS-LTKDDS-FDNLVLCERTAN    (SEQ ID NO:253)
2    -DIDHIYPRSKVIKDDS-FDNLVLVLKNEN    (SEQ ID NO:254)
3    -DRDHIYPQS-KIKDDS-IDNLVLVNKTYN    (SEQ ID NO:255)
4    -DIDHIYPRS-KIKDDS-ITNRVLVEKDIN    (SEQ ID NO:256)
6    -DIDHIYPQS-KIKDDS-ISNRVLVCSSCN    (SEQ ID NO:257)
5    -DIDHIYPQS-KTMDDS-LNNRVLVKKNYN    (SEQ ID NO:258)
7    -DQDHIYPKS-KIYDDS-LENRVLVKKNLN    (SEQ ID NO:259)
8    -QIDHIVPQS-LVKDDS-FDNRVLVVPSEN    (SEQ ID NO:260)
9    -DIDHIIPQA-FIKDNS-IDNRVLTSSKEN    (SEQ ID NO:261)
12   -DIDHIIPQA-FLKDNS-IDNKVLVSSASN    (SEQ ID NO:262)
16   -DIDHIIPQA-YTKDNS-LDNRVLVSNITN    (SEQ ID NO:263)
11   -DIDHIVPQS-FITDNS-IDNLVLTSSAGN    (SEQ ID NO:264)
10   -DVDHIVPQS-FLKDDS-IDNKVLTRSDKN    (SEQ ID NO:265)
14   -NIDHIYPQS-MVKDDS-LDNKVLVQSEIN    (SEQ ID NO:266)
18   -DIDHILPQS-LIKDDS-LDNRVLVNATIN    (SEQ ID NO:267)
19   -DIDHILPQS-FIKDDS-LENRVLVKKAVN    (SEQ ID NO:268)
13   -EVDHIFPRS-FIKDDS-IDNKVLVIKKMN    (SEQ ID NO:269)
15   -EVDHIIPRS-YIKDDS-FENKVLVYREEN    (SEQ ID NO:270)
17   -DIDHIIPQA-VTQNDS-IDNRVLVARAEN    (SEQ ID NO:271)
21   -DIDHIVPRS-ISFDDS-FSNLVIVNKLDN    (SEQ ID NO:272)
22   -EIDHIIPYS-ISFDDS-SSNKLLVLAESN    (SEQ ID NO:273)
24   -EIDHIIPYS-LCFDDS-SANKVLVHKQSN    (SEQ ID NO:274)
28   -EIDHIIPIS-ISLDDS-INNKVLVLSKAN    (SEQ ID NO:275)
30   -EVDHIIPIS-ISLDDS-ITNKVLVTHREN    (SEQ ID NO:276)
27   -EVDHILPLS-ITFDDS-LANKVLVYATAN    (SEQ ID NO:277)
26   -EIDHIIPRS-ISFDDA-RSNKVLVYRSEN    (SEQ ID NO:278)
29   -EVDHIIPRS-VSFDNS-YHNKVLVKQSEN    (SEQ ID NO:279)
31   -EVDHIIPYS-ISWDDS-YTNKVLTSAKCN    (SEQ ID NO:280)
32   -DIDHIIPYS-RSMDDS-YSNKVLVLSGEN    (SEQ ID NO:281)
23   -EIEHIIPYS-MSYDNS-QANKILTEKAEN    (SEQ ID NO:282)
33   -EVDHIVPYS-LILDNT-INNKALVYAEEN    (SEQ ID NO:283)
25   -EIDHVIPYS-KSADDS-WFNKLLVKKSTN    (SEQ ID NO:284)
49   -EMDHILPYS-RSLDNG-WHNRVLVHGKDN    (SEQ ID NO:285)
42   -EIEHVIPQS-LYFDDS-FSNKVICEAEVN    (SEQ ID NO:286)
43   -DIEHIIPQA-RLFDDS-FSNKTLEARSVN    (SEQ ID NO:287)
```

Fig. 6A

```
44    -EIEHIVPKA-RVFDDS-FSNKTLTFHRIN       (SEQ ID NO:288)
20    -DKDHIIPQS-MKKDDSIINNLVLVNKNAN       (SEQ ID NO:289)
45    -QVDHILPWS-RFGDDS-YLNKTLCTARSN       (SEQ ID NO:290)
50    -DIDHVIPLA-RGGRDS-LDNMVLCQSDAN       (SEQ ID NO:291)
46    -DMEHTIPKS-ISFDNS-DQNLTLCESYYN       (SEQ ID NO:292)
47    -DIEHTIPRS-AGGDST-KMNLTLCSSRFN       (SEQ ID NO:293)
48    -DIEHTIPRS-ISQDNS-QMNKTLCSLKFN       (SEQ ID NO:294)
39    -DIEHLFPIA-ESEDNG-RNNLVISHSACN       (SEQ ID NO:295)
41    -DVDHIFPRD-DTADNS-YGNKVVAHRQCN       (SEQ ID NO:296)
40    -DIEHIVPQS-LGGLST-DYNTIVTLKSVN       (SEQ ID NO:297)
35    -ELDHIVPRT-DGGSNR-HENLAITCGACN       (SEQ ID NO:298)
36    -EMDHIVPRKGVGSTNT-RTNFAAVCAECN       (SEQ ID NO:299)
37    -EMDHIVPRKGVGSTNT-RVNLAAACAACN       (SEQ ID NO:300)
38    -EMDHIVPRAGQGSTNT-RENLVAVCHRCN       (SEQ ID NO:301)
34    -ELEHIVPHS-FRQSNA-LSSLVLTWPGVN       (SEQ ID NO:302)
        : :*  *        .     .        *
```

Fig. 6B

Sequence alignment between SpCas9 and NmCas9

```
                                                      Y
NmCas9   MAAFKPNSINYILGLDIGIASVGWAMVEIDEEENPIRLID-------------LGVRVFE
SpCas9   ------MDKKYSIGLDIGTNSVGWAVITDEYKVPSKKFKVLGNTDRHSIKKNLIGALLFD
         ---------*Y-*GLDIG--SVGWA**--*-*----**---------------*G--*F*

NmCas9   RAEVPKTGDSLAMARRLARSVRRLTRRRAHRLLRTRRLLKREGVLQAA------------
SpCas9   SGET-------AEATRLKRTARRRYTRRKNRICYLQEIFSNEMAKVDDSFFHRLEESFLV
         --E--------A-A-RL-R*-RR---RR--R*----*-**--E-----------------

NmCas9   --------------NFDENGLIKSLPNTPWQLRAAALDRK---LTPLEWSAVLLHLIKHR
SpCas9   EEDKKHERHPIFGNIVDEVAYHEKYP-TIYHLRKKLVDSTDKADLRLI-YLALAHMIKFR
         ----------------DE----*--P-T **LR---*D--------L-----L-H*IK-R

NmCas9   GYLSQRKNE------------------------------GETA----------DKEL---
SpCas9   GHFLIEGDLNPDNSDVDKLFIQLVQTYNQLFEENPINASGVDAKAILSARLSKSRRLENL
         G**----*-------------------------------G--A-----------*-L---

NmCas9   -----GALLKGVAGNAHALQTG---DFRTPAE------LAL--NKFEKESGHIRNQ-RSD
SpCas9   IAQLPGEKKNGLFGNLIALSLGLTPNFKSNFDLAEDAKLQLSKDTYDDDLDNLLAQIGDQ
         -----G---*G*-GN--AL--G---*F**--*------L-L--*-**-*----*--Q---*

NmCas9   YSHTFSR------------------------------------------------KDLQA
SpCas9   YADLFLAAKNLSDAILLSDILRVNTEITKAPLSASMIKRYDEHHQDLTLLKALVRQQLPE
         Y*--F--------------------------------------------------**L--

NmCas9   ELILLFEKQKEFGN-PHVSGGLK---------------EGIETL---------LMTQRPA
SpCas9   KYKEIFFDQSKNGYAGYIDGGASQEEFYKFIKPILEKMDGTEELLVKLNREDLLRKQRTF
         *----*F--Q-*-G---**-GG----------------*G-E-L---------L--QR--

NmCas9   LSGDAV-QKMLGH--------CTFEPAEP----------------KAAKNTYTAERFIWL
SpCas9   DNGSIPHQIHLGELHAILRRQEDFYPFLKDNREKIEKILTFRIPYYVGPLARGNSRFAWM
         --G----Q--LG-----------F-P-----------------------*-----RF-W*

NmCas9   TKLNNLRILEQGSERPLTD-------TERATLMDEPY------RKSKLTYAQAR------
SpCas9   TRKSEETITPWNFEEVVDKGASAQSFIERMTNFDKNLPNEKVLPKHSLLYEYFTVYNELT
         T*--**--I-----E--*---------ER-T-*D*--------K--L-Y----------

NmCas9   ----KLLGLEDTAFFKGLRY--------GKDN-------------------------AEA
SpCas9   KVKYVTEGMRKPAFLSGEQKKAIVDLLFKTNRKVTVKQLKEDYFKKIECFDSVEISGVED
         -------G*---AF*-G-*------------*--------------------------E-

NmCas9   STLMEMKAYHAISRALEKEGLKDKKSPLNLSPELQDEIGTAFSLFKTDEDITGRLKDRIQ
SpCas9   RFNASLGTYHDLLKIIKDKDFLDNEE----NEDILEDIVLTLTLFEDREMIEERLKTYAH
         ------*-*YH-*-*-**-*-*-D**--------**-**I--***LF*--E-I--RLK---*

NmCas9   P--EILEALLKHISFDKFVQISLKALRRIVPLMEQGKRYDEACAE----IYGDHYGKKNT
SpCas9   LFDDKVMKQLKRRRYTGWGRLSRKLI--------NGIRDKQSGKTILDFLKSDGFANRNF
         ---*-*---LK*--*--*-**S-K-*--------*G-R--**--------*--D-*-**N-

NmCas9   EEKI------Y---------------LPPIPADEIRNPVVLRALSQARKVINGVVRRYG-
SpCas9   MQLIHDDSLTFKEDIQKAQVSGQGDSLHEHIANLAGSPAIKKGILQTVKVVDELVKVMGR
         -*-I------*---------------L----A*----P-*-*-*-Q*-KV**-*V*--G-

NmCas9   -SPARIHIETAREVGKSFKDRKEIEKRQEENRKDREKAAAKFREYFPNF----VGEPKSK
SpCas9   HKPENIVIEMARENQTTQKGQKNSRER-------MKRIEEGIKELGSQILKEHPVENTQL
         --P--I-IE-ARE---*-K-*K*---*R---------**-----**E---**------E----
B                                       G
NmCas9   DILKLRLYEQQHGKCLYSGKEINLGRLNEKGYVEIDHALPFSRTWDDSFNNKVLVLGSEN
SpCas9   QNEKLYLYYLQNGRDMYVDQELDINRLSD---YDVDHIVPQSFLKDDSIDNKVLTRSDKN
         *--KL-LY--Q-G*-*Y--*E*** RL-*----**DH-*P-S---DDS**NKVL----*N

NmCas9   QNKGNQTPYEYFNGKDNSREWQEFKA-RVET-SRFP-RSKKQRILLQKFDEDGFKERNLN
SpCas9   RGKSDNVPSEEVVKKM-KNYWRQLLNAKLITQRKFDNLTKAERGGLSELDKAGFIKRQLV
         * K-**-P-E----K-----W***---**-T--*F---*K-*R--L-**D*-GF-*R*L-
```

Fig. 7A

```
                                                                                B
NmCas9      DTRYVNRFLCQFVADRMRLTGKGKKRVF------ASNGQITNLLRGFWGLRKVRAENDRH
SpCas9      ETRQITKHVAQILDSRMNTKYDENDKLIREVKVITLKSKLVSDFRKDFQFYKVREINNYH
            *TR-*-*-*-Q**--RM------*-***------*-*-**----*R--*-*-KVR--N*-H

NmCas9      HALDAVVVACSTVAMQQKI---TRFVRYKEMNAFDGKTID----KETGEVLHQKTHFPQP
SpCas9    B HAHDAYLNAVVGTALIKKYPKLESEFVYGDYKVYDVRKMIAKSEQEIGKATAKYFFYSNI
            HH-AD-*-A----A*-*K---------Y-*-*-*D-*-*------*E-G*---*---*-*-

NmCas9      WEFFAQEVMIRVFGKPDGKPE------------FEEADTLEKLRTLLAEKLSSRPEAVHEY
SpCas9      MNFFKTEITLA-NGEIRKRPLIETNGETGEIVWDKGRDFATVRKVLS-----MPQ-----
            -*FF--E*-*---G*----*P-------------***---*---*R-*L*------P*-----

NmCas9      VTPLFVSRAPNRKMSGQGHMETVKSAKRLDEGVSVLRVPLTQLKLKDLEKMVN--REREP
SpCas9      -------------------VNIVKKTEVQTGGFSKES----ILPKRNSDKLIARKKDWDP
            -------------------**-VK-**-----G-S---------L--**-*K**----**-*P

NmCas9      KLYEALKARLEAHKDDPAKAFAEPFYKYDKAGNRTQQVKAVR---VEQVQKTGVWVRNH-
SpCas9      KKYGGFD--------SPTVAYSVLVVAKVEKGK-SKKLKSVKELLGITIMERSSFEKNPI
            K-Y--*-----------P*-A**---------*-G*-****K*V*-------*-*----*-*N--

NmCas9      -----NGIAD---------------------NATMVRVDVFEKGDKYYLVPIY-------
SpCas9      DFLEAKGYKEVKKDLIIKLPKYSLFELENGRKRMLASAGELQKGNELALPSKYVNFLYLA
            -----*G--*---------------------*--*------**KG**--L---Y-------

NmCas9      -SWQVAKGILPDRAVVQGKDEEDWQLIDDS------FNFKFSLHPNDLVEVI--------
SpCas9      SHYEKLKGSPEDNEQKQLFVEQHKHYLDEIIEQISEFSKRVILADANLDKVLSAYNKHRD
            --**--KG---D----Q---E*---*-*D*-------F--*--L---*L-*V*--------

NmCas9      ------------------TKKARMFGYFASCHRGTGNINIRIHDLDHKIGKNGILEGIGV
SpCas9      KPIREQAENIIHLFTLTNLGAPAAFKYFDTTIDRKRYTS-TKEVLDATLIHQSI------
            ------------------------F-YF-*--------------LD--*-**-I------

NmCas9      KTALSFQKYQIDELGKEIRPCRLKKRPPVR     (SEQ ID NO:6)
SpCas9      -TGLYETRIDLSQLGGD-------------     (SEQ ID NO:7)
            -T-L---*-**-*LG-*-------------
```

Percent Identity Matrix - created by Clustal2.1

Fig. 7B

Sequence of the NmCas9 ORF with dual NLS and HA tags

R atggtgcctaagaagaagagaaaggtggctgccttcaaacctaattcaatcaactacatcctcggcctcgat
atcggcatcgcatccgtcggctgggcgatggtagaaattgacgaagaagaaaaccccatccgcctgattgat
ttgggcgtgcgcgtatttgagcgtgccgaagtaccgaaaacaggcgactcccttgccatggcaaggcgtttg
gcgcgcagtgttcgccgcctgacccgccgtcgcgcccaccgcctgcttcggacccgccgcctattgaaacgc
gaaggcgtattacaagccgccaatttgacgaaaacggcttgattaaatccttaccgaatacaccatggcaa
cttcgcgcagccgcattagaccgcaaactgacgcctttagagtggtcggcagtcttgttgcatttaatcaaa
catcgcggctatttatcgcaacggaaaaacgagggcgaaactgccgataaggagcttggcgctttgcttaaa
ggcgtagccggcaatgcccatgccttacagacaggcgatttccgcacaccggccgaattggctttaaataaa
tttgagaaagaaagcggccatatccgcaatcagcgcagcgattattcgcatacgttcagccgcaaagattta
caggcggagctgattttgctgtttgaaaaacaaaaagaatttggcaatccgcatgtttcaggcggccttaaa
gaaggtattgaaaccctactgatgacgcaacgccctgccctgtccggcgatgccgttcaaaaaatgttgggg
cattgcaccttcgaaccggcagagccgaaagccgctaaaaacacctacacagccgaacgtttcatctggctg
accaagctgaacaacctgcgtattttagagcaaggcagcgagcggccattgaccgataccgaacgcgccacg
cttatggacgagccatacagaaaatccaaactgacttacgcacaagcccgtaagctgctgggtttagaagat
accgcctttttcaaaggcttgcgctatggtaaagacaatgccgaagcctcaacattgatggaaatgaaggcc
taccatgccatcagccgtgcactggaaaaagaaggattgaaagacaaaaaatccccattaaacctttctccc
gaattacaagacgaaatcggcacggcattctccctgttcaaaaccgatgaagacattacaggccgtctgaaa
gaccgtatacagcccgaaatcttagaagcgctgttgaaacacatcagcttcgataagttcgtccaaatttcc
ttgaaagcattgcgccgaattgtgcctctaatggaacaaggcaaacgttacgatgaagcctgcgccgaaatc
tacggagaccattacggcaagaagaatacggaagaaaagatttatctgccgccgattcccgccgacgaaatc
cgcaaccccgtcgtcttgcgcgccttatctcaagcacgtaaggtcattaacggcgtggtacgccgttacggc
tccccagctcgtatccatattgaaactgcaagggaagtaggtaaatcgtttaaagaccgcaaagaaattgag
aaacgccaagaagaaaaccgcaaagaccgggaaaaagccgccgccaaattccgagagtatttccccaatttt
gtcggagaacccaaatccaaagatattctgaaactgcgcctgtacgagcaacaacacggcaaatgcctgtat
tcgggcaaagaaatcaacttaggccgtctgaacgaaaaaggctatgtcgaaatcgaccatgccctgccgttc
tcgcgcacatgggacgacagtttcaacaataaagtactggtattgggcagcgaaaaccaaaacaaaggcaat
caaaccccttacgaatacttcaacggcaaagacaacagccgcgaatggcaggaatttaaagcgcgtgtcgaa
accagccgtttcccgcgcagtaaaaaacaacggattctgctgcaaaaattcgatgaagacggctttaaagaa
cgcaatctgaacgacacgcgctacgtcaaccgtttcctgtgtcaatttgttgccgaccgtatgcggctgaca
ggtaaaggcaagaaacgtgtctttgcatccaacggacaaattaccaatctgttgcgcggcttttggggattg
cgcaaagtgcgtgcggaaaacgaccgccatcacgccttggacgccgtcgtcgttgcctgctcgaccgttgcc
atgcagcagaaaattacccgttttgtacgctataaagagatgaacgcgtttgacggtaaaaccatagacaaa
gaaacaggagaagtgctgcatcaaaaaacacacttcccacaaccttgggaattttcgcacaagaagtcatg
attcgcgtcttcggcaaaccggacggcaaacccgaattcgaagaagccgataccctagaaaaactgcgcacg
ttgcttgccgaaaaattatcatctcgccccgaagccgtacacgaatacgttacgccactgtttgtttcacgc
gcgcccaatcggaagatgagcgggcaagggcatatggagaccgtcaaatccgccaaacgactggacgaaggc
gtcagcgtgttgcgcgtaccgctgacacagttaaaactgaaagacttggaaaaaatggtcaatcgggagcgc
gaacctaagctatacgaagcactgaaagcacggctggaagcacataaagacgatcctgccaaagcctttgcc
gagccgttttacaaatacgataaagcaggcaaccgcacccaacaggtaaaagccgtacgcgtagagcaagta
cagaaaaccggcgtatgggtgcgcaaccataacggtattgccgacaacgcaaccatggtgcgcgtagatgtg
tttgagaaaggcgacaagtattatctggtaccgatttacagttggcaggtagcgaaagggattttgccggat
agggctgttgtacaaggaaaagatgaagaagattggcaacttattgatgatagtttcaactttaaattctca
ttacaccctaatgatttagtcgaggttataacaaaaaaagctagaatgtttggttactttgccagctgccat
cgaggcacaggtaatatcaatatacgcattcatgatcttgatcataaaattggcaaaaatggaatactggaa
ggtatcggcgtcaaaaccgccctttcattccaaaaataccaaattgacgaactgggcaaagaaatcagacca
tgccgtctgaaaaaacgcccgcctgtccgttacccatacgatgttccagattacgctgcagctccagcagcg
aagaaaaagaagctggattaa

G (SEQ ID NO:303)

O

R: SV40 NLS, G: HA tag, O: synthetic NLS (1); all else NmCas9

Fig. 8

CRISPR/CAS-RELATED METHODS AND COMPOSITIONS FOR TREATING PRIMARY OPEN ANGLE GLAUCOMA

REFERENCE TO RELATED APPLICATIONS

The present application is a U.S. national phase of International Patent Application No. PCT/US2015/023906, filed Apr. 1, 2015, which claims the benefit of U.S. Provisional Application No. 61/974,327, filed Apr. 2, 2014, the contents of which are hereby incorporated by reference in their entirety.

FIELD OF THE INVENTION

The invention relates to CRISPR/CAS-related methods and components for editing of a target nucleic acid sequence, and applications thereof in connection with Primary Open Angle Glaucoma (POAG).

BACKGROUND

Glaucoma is the second leading cause of blindness in the world. Primary Open Angle Glaucoma (POAG) is the leading cause of glaucoma, representing more than 50% of glaucoma in the United States (Quigley et al. Investigations in Ophthalmology and Visual Science 1997; 38:83-91). POAG affects 3 million subjects in the United States (Glaucoma Research Foundation: glaucoma.org; Accessed Mar. 27, 2015). Approximately 1% of subjects ages 40-89 have POAG.

The disease develops due to an imbalance between the production and outflow of aqueous humor within the eye. Aqueous humor (AH) is produced by the ciliary body located in the anterior chamber of the eye. The vast majority (80%) of AH drains through the trabecular meshwork (TM) to the episcleral venous system. The remainder (20%) of AH drains through the interstitium between the iris root and ciliary muscle (Feisal et al., Canadian Family Physician 2005; 51(9): 1229-1237). POAG is likely due to decreased drainage through the trabecular meshwork. Decreased outflow of AH results in increased intraocular pressure (IOP). IOP causes damage to the optic nerve and leads to progressive blindness.

Mutations in the MYOC gene have been shown to be a leading genetic cause of POAG. Mutations in MYOC have been shown to account for 3% of POAG. Approximately 90,000 individuals in the United States have POAG that is caused by MYOC mutations. Many patients with MYOC mutations develop rapidly advancing disease and early-onset POAG, including juvenile-onset POAG.

MYOC mutations are inherited in an autosomal dominant fashion. Disease-causing mutations cluster in the olfactomedin domain of exon 3 of the MYOC gene. The most common MYOC mutation causing severe, early onset disease is a proline to leucine substitution at amino acid position 370 (P370L) (Waryah et al., Gene 2013; 528(2): 356-9). The most common MYOC mutation is a missense mutation at amino acid position 368 (Q368X). This mutation is associated with less severe disease, termed late-onset POAG.

Treatments that reduce IOP can slow the progression of POAG. Trabeculectomy surgery and eye drops are both effective in in reducing IOP. Eye drops include alpha-adrenergic antagonists and beta-adrenergic antagonists. However, POAG is known as a silent cause of blindness, as it is painless and leads to progressive blindness if left untreated. Despite advances in POAG therapies, there remains a need for the treatment and prevention of POAG. A one-time or several dose treatment that reduces IOP and prevents the progression of POAG would be beneficial in the treatment and prevention of POAG.

SUMMARY OF THE INVENTION

Methods and compositions discussed herein, allow the correction of disorders of the eye, e.g., disorders that affect trabecular meshwork cells, photoreceptor cells and any other cells in the eye, including those of the iris, ciliary body, optic nerve or aqueous humor.

In one aspect, methods and compositions discussed herein, provide for treating or delaying the onset or progression of (POAG). POAG is a common form of glaucoma, characterized by degeneration of the trabecular meshwork, which leads to obstruction of the normal ability of aqueous humor to leave the eye without closure of the space (e.g., the "angle") between the iris and cornea. This obstruction leads to increased intraocular pressure ("IOP"), which can result in progressive visual loss and blindness if not treated appropriately and in a timely fashion. POAG is a progressive ophthalmologic disorder characterized by increased intraocular pressure (IOP).

In one aspect, methods and compositions discussed herein, provide for the correction of the underlying cause of Primary Open Angle Glaucoma (POAG).

Mutations in the MYOC gene (also known as GPOA, JOAG, TIGR, GLC1A, JOAG1 and myocilin) have been shown to account for 3% of POAG. Certain mutations in MYOC lead to severe, early onset POAG. Mutations in the MYOC gene leading to POAG can be described based on the mutated amino acid residue(s) in the MYOC protein. Severe, early-onset POAG can be caused by mutations in the MYOC gene, including mutations in exon 3. Exemplary mutations include, but are not limited to the mutations T377R, I477, and P370L (Zhuo et al., Molecular Vision 2008; 14:1533-1539).

In an embodiment, the target mutation is at P370, e.g., P370L, in the MYOC gene. In an embodiment, the target mutation is at I477, e.g., I477N or I477S, in the MYOC gene. In an embodiment, the target mutation is at T377, e.g., T377R, in the MYOC gene. In an embodiment, the target mutation is at Q368, e.g., Q368stop, in the MYOC gene. In an embodiment, the target mutation is a mutational hotspot between amino acid sequence positions 246-252 in the MYOC gene. In an embodiment, the target mutation is a mutational hotspot between amino acid sequence positions, e.g., amino acids 368-380, amino acids 368-370+377-380, amino acids 364-380, or amino acids 347-380 in the MYOC gene. In an embodiment, the target mutation is a mutational hotspot between amino acid sequence positions 423-437 (e.g., amino acids 423-426, amino acids 423-427 and amino acids 423-437) in the MYOC gene. In an embodiment, the target mutation is a mutational hotspot between amino acid sequence positions 477-502 in the MYOC gene.

"POAG target point position", as used herein, refers to a target position in the MYOC gene, typically a single nucleotide, which, if mutated, can result in a mutant protein and give rise to POAG. In an embodiment, the POAG target point position is a position in the MYOC gene at which a change can give rise to a mutant protein having a mutation at Q368 (e.g., Q368stop), P370 (e.g., the substitution P370L), T377 (e.g., the substitution T377R), or I477 (e.g., the substitution I477N or I477S).

"POAG target hotspot position", as used herein, refers to a target position in a region of the MYOC gene, which: (1) encodes amino acid sequence positions 246-252, amino acid sequence positions 368-380, amino acid sequence positions 423-437, or amino acid sequence positions 477-502; and (2) when mutated, can give rise to a mutation in one of the aforesaid amino acid sequence regions and give rise to POAG.

While some of the disclosure herein is presented in the context of several specific mutations in the MYOC gene, the methods and compositions herein are broadly applicable to any mutation, e.g., a point mutation or a deletion, in the MYOC gene that gives rise to POAG.

While not wishing to be bound by theory, it is believed that, in an embodiment, a mutation at a POAG target point position or a POAG target hotspot position is corrected by homology directed repair (HDR), as described herein.

In another aspect, methods and compositions discussed herein may be used to alter the MYOC gene to treat or prevent POAG by targeting the MYOC gene, e.g., the non-coding or coding regions, e.g., the promoter region, or a transcribed sequence, e.g., intronic or exonic sequence. In an embodiment, coding sequence, e.g., a coding region, e.g., an early coding region, of the MYOC gene, is targeted for alteration and knockout of expression.

In another aspect, the methods and compositions discussed herein may be used to alter the MYOC gene to treat or prevent POAG by targeting the coding sequence of the MYOC gene. In one embodiment, the gene, e.g., the coding sequence of the MYOC gene, is targeted to knockout the gene, e.g., to eliminate expression of the gene, e.g., to knockout both alleles of the MYOC gene, e.g., by induction of an alteration comprising a deletion or mutation in the MYOC gene. In an embodiment, the method provides an alteration that comprises an insertion or deletion. while not wishing to be bound by theory, in an embodiment, a targeted knockout approach is mediated by non-homologous end joining (NHEJ) using a CRISPR/Cas system comprising a Cas9 molecule, e.g., an enzymatically active Cas9 (eaCas9) molecule.

In one embodiment, a coding region, e.g., an early coding region, of the MYOC gene is targeted to knockout the MYOC gene. In an embodiment, targeting affects both alleles of the MYOC gene. In an embodiment, a targeted knockout approach reduces or eliminates expression of functional MYOC gene product. In an embodiment, the method provides an alteration that comprises an insertion or deletion.

In another aspect, the methods and compositions discussed herein may be used to alter the MYOC gene to treat or prevent POAG by targeting non-coding sequence of the MYOC gene, e.g., promoter, an enhancer, an intron, 3'UTR, and/or polyadenylation signal. In one embodiment, the gene, e.g., the non-coding sequence of the MYOC gene, is targeted to knockout the gene, e.g., to eliminate expression of the gene, e.g., to knockout both alleles of the MYOC gene, e.g., by induction of an alteration comprising a deletion or mutation in the MYOC gene. In an embodiment, the method provides an alteration that comprises an insertion or deletion.

"POAG target knockout position", as used herein, refers to a target position in the MYOC gene, which if altered by NHEJ-mediated alteration, results in reduction or elimination of expression of a functional MYOC gene product. In an embodiment, the position is in the MYOC coding region, e.g., an early coding region.

In another aspect, methods and compositions discussed herein may be used to alter the expression of the MYOC gene to treat or prevent POAG by targeting the MYOC gene, e.g., a promoter region of the MYOC gene. In an embodiment, the promoter region of the MYOC gene is targeted to knockdown expression of the MYOC gene. A targeted knockdown approach reduces or eliminates expression of a mutated MYOC gene. As described herein, a targeted knockdown approach is mediated by targeting an enzymatically inactive Cas9 (eiCas9) molecule or an eiCas9 fusion protein (e.g., an eiCas9 fused to a transcription repressor domain or chromatin modifying protein) to alter transcription, e.g., block, reduce, or decrease transcription, of the MYOC gene. While not wishing to be bound by theory, in an embodiment, a targeted knockdown approach is mediated by NHEJ using a CRISPR/Cas system comprising a Cas9 molecule, e.g., an enzymatically inactive Cas9 (eiCas9) molecule.

"POAG target knockdown position", as used herein, refers to a position, e.g., in the MYOC gene, which if targeted by an eiCas9 molecule or an eiCas9 fusion described herein, results in reduction or elimination of expression of functional MYOC gene product. In an embodiment, transcription is reduced or eliminated. In an embodiment, the position is in the MYOC promoter sequence. In an embodiment, a position in the promoter sequence of the MYOC gene is targeted by an enzymatically inactive Cas9 (eiCas9) molecule or an eiCas9-fusion protein, as described herein.

"POAG target position", as used herein, refers to any of the POAG target point positions, POAG target hotspot positions, POAG target knockout positions and/or POAG target knockdown positions in the MYOC gene, as described herein.

In one aspect, disclosed herein is a gRNA molecule, e.g., an isolated or non-naturally occurring gRNA molecule, comprising a targeting domain which is complementary with a target domain from the MYOC gene.

In an embodiment, the targeting domain of the gRNA molecule is configured to provide a cleavage event, e.g., a double strand break or a single strand break, sufficiently close to a POAG target position in the MYOC gene to allow alteration, e.g., alteration associated with HDR or NHEJ, of a POAG target position in the MYOC gene. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 300, 400, or 500 nucleotides of a POAG target position. The break, e.g., a double strand or single strand break, can be positioned upstream or downstream of a POAG target position in the MYOC gene.

In an embodiment, a second gRNA molecule comprising a second targeting domain is configured to provide a cleavage event, e.g., a double strand break or a single strand break, sufficiently close to the POAG target position in the MYOC gene, to allow alteration, e.g., alteration associated with HDR or NHEJ, of the POAG target position in the MYOC gene, either alone or in combination with the break positioned by said first gRNA molecule. In an embodiment, the targeting domains of the first and second gRNA molecules are configured such that a cleavage event, e.g., a double strand or single strand break, is positioned, independently for each of the gRNA molecules, within 1, 2, 3, 4, 5, 10, 15, 20, 25, 30, 35, 40, 45, 50, 60, 70, 80, 90, 100, 150, 200, 300, 400, or 500 nucleotides of the target position. In an embodiment, the breaks, e.g., double strand or single strand breaks, are positioned on both sides of a nucleotide of a POAG target position in the MYOC gene. In an embodiment, the breaks, e.g., double strand or single strand breaks, are positioned on one side, e.g., upstream or downstream, of a nucleotide of a POAG target position in the MYOC gene.

In an embodiment, a single strand break is accompanied by an additional single strand break, positioned by a second gRNA molecule, as discussed below. For example, the targeting domains are configured such that a cleavage event, e.g., the two single strand breaks, are positioned within 1, 2, 3, 4, 5, 10, 15, 20, 25, 30, 35, 40, 45, 50, 60, 70, 80, 90, 100, 150, 200, 300, 400, or 500 nucleotides of a POAG target position. In an embodiment, the first and second gRNA molecules are configured such, that when guiding a Cas9 molecule, e.g., a Cas9 nickase, a single strand break will be accompanied by an additional single strand break, positioned by a second gRNA, sufficiently close to one another to result in alteration of a POAG target position in the MYOC gene. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 molecule is a nickase. In an embodiment, the two gRNA molecules are configured to position cuts at the same position, or within a few nucleotides of one another, on different strands, e.g., essentially mimicking a double strand break.

In an embodiment, a double strand break can be accompanied by an additional double strand break, positioned by a second gRNA molecule, as is discussed below. For example, the targeting domain of a first gRNA molecule is configured such that a double strand break is positioned upstream of a POAG target position in the MYOC gene, e.g., within 1, 2, 3, 4, 5, 10, 15, 20, 25, 30, 35, 40, 45, 50, 60, 70, 80, 90, 100, 150, 200, 300, 400, or 500 nucleotides of the target position; and the targeting domain of a second gRNA molecule is configured such that a double strand break is positioned downstream of a POAG target position in the MYOC gene, e.g., within 1, 2, 3, 4, 5, 10, 15, 20, 25, 30, 35, 40, 45, 50, 60, 70, 80, 90, 100, 150, 200, 300, 400, or 500 nucleotides of the target position.

In an embodiment, a double strand break can be accompanied by two additional single strand breaks, positioned by a second gRNA molecule and a third gRNA molecule. For example, the targeting domain of a first gRNA molecule is configured such that a double strand break is positioned upstream of a POAG target position in the MYOC gene, e.g., within 1, 2, 3, 4, 5, 10, 15, 20, 25, 30, 35, 40, 45, 50, 60, 70, 80, 90, 100, 150, 200, 300, 400, or 500 nucleotides of the target position; and the targeting domains of a second and third gRNA molecule are configured such that two single strand breaks are positioned downstream of a POAG target position in the MYOC gene, e.g., within 1, 2, 3, 4, 5, 10, 15, 20, 25, 30, 35, 40, 45, 50, 60, 70, 80, 90, 100, 150, 200, 300, 400, or 500 nucleotides of the target position. In an embodiment, the targeting domain of the first, second and third gRNA molecules are configured such that a cleavage event, e.g., a double strand or single strand break, is positioned, independently for each of the gRNA molecules.

In an embodiment, a first and second single strand breaks can be accompanied by two additional single strand breaks positioned by a third gRNA molecule and a fourth gRNA molecule. For example, the targeting domain of a first and second gRNA molecule are configured such that two single strand breaks are positioned upstream of a POAG target position in the MYOC gene, e.g., within 1, 2, 3, 4, 5, 10, 15, 20, 25, 30, 35, 40, 45, 50, 60, 70, 80, 90, 100, 150, 200, 300, 400, or 500 nucleotides of the target position; and the targeting domains of a third and fourth gRNA molecule are configured such that two single strand breaks are positioned downstream of a POAG target position in the MYOC gene, e.g., within 1, 2, 3, 4, 5, 10, 15, 20, 25, 30, 35, 40, 45, 50, 60, 70, 80, 90, 100, 150, 200, 300, 400, or 500 nucleotides of the target position.

It is contemplated herein that, in an embodiment, when multiple gRNAs are used to generate (1) two single stranded breaks in close proximity, (2) two double stranded breaks, e.g., flanking a POAG target position, e.g., a mutation (e.g., to remove a piece of DNA, e.g., a insertion mutation) or to create more than one indel in an early coding region, (3) one double stranded break and two paired nicks flanking a POAG target position, e.g., a mutation (e.g., to remove a piece of DNA, e.g., a insertion mutation) or (4) four single stranded breaks, two on each side of a mutation, that they are targeting the same POAG target position. It is further contemplated herein that multiple gRNAs may be used to target more than one POAG target position (e.g., mutation) in the same gene.

In an embodiment, the targeting domain of the first gRNA molecule and the targeting domain of the second gRNA molecules are complementary to opposite strands of the target nucleic acid molecule. In an embodiment, the gRNA molecule and the second gRNA molecule are configured such that the PAMs are oriented outward.

In an embodiment, the targeting domain of a gRNA molecule is configured to avoid unwanted target chromosome elements, such as repeat elements, e.g., Alu repeats, in the target domain. The gRNA molecule may be a first, second, third and/or fourth gRNA molecule, as described herein.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

In an embodiment, the targeting domain of a gRNA molecule comprises a sequence that is the same as, or differs by no more than 1, 2, 3, 4, or 5 nucleotides from, a targeting domain sequence described herein, e.g., from any one of Tables 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B. In an embodiment, the targeting domain of a gRNA molecule comprises a sequence that is the same as a targeting domain sequence described herein, e.g., from any one of Tables 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B.

In an embodiment, when two or more gRNAs are used to position two or more breaks, e.g., two single stranded breaks, in the target nucleic acid sequence, each guide RNA is independently selected from any one of Tables 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B.

In an embodiment, a POAG target position, e.g., a mutation in the MYOC gene, e.g., a mutation at P370, e.g., a point mutation P370L, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 1A-1E, 21A-21D, 22A-22E, or 23A-23B. In some embodiments, the targeting domain is independently selected from those in Tables 1A-1E, 21A-21D, 22A-22E, or 23A-23B.

In an embodiment, when the POAG target point position is P370L and two gRNAs are used to position two breaks, e.g., two single stranded breaks, in the target nucleic acid sequence, each guide RNA is selected from one of Tables 1A-1E, 21A-21D, 22A-22E, or 23A-23B.

In an embodiment, a POAG target position, e.g., a mutation in the MYOC gene, e.g., a mutation at P370, e.g., a point mutation P370L, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 1A-1E. In some embodiments, the targeting domain is independently selected from those in Tables 1A-1E. For example, in certain embodiments, the targeting domain is independently selected from Table 1A.

In an embodiment, when the POAG target point position is P370L and two gRNAs are used to position two breaks, e.g., two single stranded breaks, in the target nucleic acid sequence, each guide RNA is selected from one of Tables 1A-1E.

In an embodiment, a POAG target position, e.g., a mutation in the MYOC gene, e.g., a mutation at P370, e.g., a point mutation P370L, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 21A-21D. In some embodiments, the targeting domain is independently selected from those in Tables 21A-21D. For example, in certain embodiments, the targeting domain is independently selected from Table 21A.

In an embodiment, when the POAG target point position is P370L and two gRNAs are used to position two breaks, e.g., two single stranded breaks, in the target nucleic acid sequence, each guide RNA is selected from one of Tables 21A-21D.

In an embodiment, a POAG target position, e.g., a mutation in the MYOC gene, e.g., a mutation at P370, e.g., a point mutation P370L, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 22A-22E. In some embodiments, the targeting domain is independently selected from those in Tables 22A-22E. For example, in certain embodiments, the targeting domain is independently selected from Table 22A.

In an embodiment, when the POAG target point position is P370L and two gRNAs are used to position two breaks, e.g., two single stranded breaks, in the target nucleic acid sequence, each guide RNA is selected from one of Tables 22A-22E.

In an embodiment, a POAG target position, e.g., a mutation in the MYOC gene, e.g., a mutation at P370, e.g., a point mutation P370L, is targeted, e.g., for correction. In an embodiment, the targeting domain of a gRNA molecule comprises a sequence that is the same as, or differs by no more than 1, 2, 3, 4, or 5 nucleotides from, a targeting domain sequence from any one of Tables 23A-23B. In some embodiments, the targeting domain is independently selected from those in Tables 23A-23B. For example, in certain embodiments, the targeting domain is independently selected from Table 23A.

In an embodiment, when the POAG target point position is P370L and two gRNAs are used to position two breaks, e.g., two single stranded breaks, in the target nucleic acid sequence, each guide RNA is selected from one of Tables 23A-23B.

In another embodiment, a POAG target position, e.g., a mutation in the MYOC gene, e.g., a mutation at I477, e.g., a point mutation I477N, is targeted, e.g., for correction. In an embodiment, the targeting domain comprises a sequence that is the same as, or differs by no more than 1, 2, 3, 4, or 5 nucleotides from, a targeting domain sequence from any one of Tables 2A-2E, 18A-18D, 19A-19E, or 20A-20D. In an embodiment, the targeting domain is independently selected from those in Tables 2A-2E, 18A-18D, 19A-19E, or 20A-20D.

In an embodiment, when the POAG target point position is I477N and two gRNAs are used to position two breaks, e.g., two single stranded breaks, in the target nucleic acid sequence, each guide RNA is selected from one of Tables 2A-2E, 18A-18D, 19A-19E, or 20A-20D.

In another embodiment, a POAG target position, e.g., a mutation in the MYOC gene, e.g., a mutation at I477, e.g., a point mutation I477N, is targeted, e.g., for correction. In an embodiment, the targeting domain comprises a sequence that is the same as, or differs by no more than 1, 2, 3, 4, or 5 nucleotides from, a targeting domain sequence from any one of Tables 2A-2E. In an embodiment, the targeting domain is independently selected from those in Tables 2A-2E. In another embodiment, the targeting domain is independently selected from Table 2A. In an embodiment, when the POAG target point position is I477N and two gRNAs are used to position two breaks, e.g., two single stranded breaks, in the target nucleic acid sequence, each guide RNA is selected from one of Tables 2A-2E.

In another embodiment, a POAG target position, e.g., a mutation in the MYOC gene, e.g., a mutation at I477, e.g., a point mutation I477N, is targeted, e.g., for correction. In an embodiment, the targeting domain comprises a sequence that is the same as, or differs by no more than 1, 2, 3, 4, or 5 nucleotides from, a targeting domain sequence from any one of Tables 18A-18D. In an embodiment, the targeting domain is independently selected from those in Tables 18A-18D. In another embodiment the targeting domain is independently selected from Table 18A.

In an embodiment, when the POAG target point position is I477N and two gRNAs are used to position two breaks, e.g., two single stranded breaks, in the target nucleic acid sequence, each guide RNA is selected from one of Tables 18A-18D.

In another embodiment, a POAG target position, e.g., a mutation in the MYOC gene, e.g., a mutation at I477, e.g., a point mutation I477N, is targeted, e.g., for correction. In an embodiment, the targeting domain comprises a sequence that is the same as, or differs by no more than 1, 2, 3, 4, or 5 nucleotides from, a targeting domain sequence from any one of Tables 19A-19E. In an embodiment, the targeting domain is independently selected from those in Tables 19A-19E. In another embodiment the targeting domain is independently selected from Table 19A.

In an embodiment, when the POAG target point position is I477N and two gRNAs are used to position two breaks, e.g., two single stranded breaks, in the target nucleic acid sequence, each guide RNA is selected from one of Tables 19A-19E.

In another embodiment, a POAG target position, e.g., a mutation in the MYOC gene, e.g., a mutation at I477, e.g., a point mutation I477N, is targeted, e.g., for correction. In an embodiment, the targeting domain comprises a sequence that is the same as, or differs by no more than 1, 2, 3, 4, or 5 nucleotides from, a targeting domain sequence from any one of Tables 20A-20D. In an embodiment, the targeting domain is independently selected from those in Tables 20A-20D. In another embodiment the targeting domain is independently selected from Table 20A.

In an embodiment, when the POAG target point position is I477N and two gRNAs are used to position two breaks, e.g., two single stranded breaks, in the target nucleic acid sequence, each guide RNA is selected from one of Tables 20A-20D.

In an embodiment, a POAG target position, e.g., a mutation hotspot between amino acids 477-502 is targeted, e.g., for correction. In an embodiment, the targeting domain comprises a sequence that is the same as, or differs by no more than 1, 2, 3, 4, or 5 nucleotides from, a targeting domain sequence from any one of Tables 3A-3E, 12A-12D, 13A-13E, 14A-14C, 15A-15D, 16A-16E, or 17A-17B. In an embodiment, the targeting domain is independently selected from those in Tables 3A-3E, 12A-12D, 13A-13E, 14A-14C, 15A-15D, 16A-16E, or 17A-17B.

In an embodiment, when the POAG target hotspot position is the mutation hotspot between amino acids 477-502 and more than one gRNA is used to position breaks, e.g., two single stranded breaks or two double stranded breaks, or a combination of single strand and double strand breaks, in the target nucleic acid sequence, each guide RNA is selected from one of Tables 3A-3E, 12A-12D, 13A-13E, 14A-14C, 15A-15D, 16A-16E, or 17A-17B. In another embodiment, a POAG target position, e.g., a mutation hotspot between amino acids 477-502 is targeted, e.g., for correction. In an embodiment, the targeting domain comprises a sequence that is the same as, or differs by no more than 1, 2, 3, 4, or 5 nucleotides from, a targeting domain sequence from any one of Tables 3A-3E. In an embodiment, the targeting domain is independently selected from those in Tables 3A-3E. In another embodiment, the targeting domain is independently selected from Table 3A.

In an embodiment, when the POAG target hotspot position is the mutation hotspot between amino acids 477-502 and more than one gRNA is used to position breaks, e.g., two single stranded breaks or two double stranded breaks, or a combination of single strand and double strand breaks, in the target nucleic acid sequence, each guide RNA is selected from one of Tables 3A-3E.

In another embodiment, a POAG target position, e.g., a mutation hotspot between amino acids 477-502 is targeted, e.g., for correction. In an embodiment, the targeting domain comprises a sequence that is the same as, or differs by no more than 1, 2, 3, 4, or 5 nucleotides from, a targeting domain sequence from any one of Tables 12A-12D. In an embodiment, the targeting domain is independently selected from those in Tables 12A-12D. In another embodiment, the targeting domain is independently selected from Table 12A.

In an embodiment, when the POAG target hotspot position is the mutation hotspot between amino acids 477-502 and more than one gRNA is used to position breaks, e.g., two single stranded breaks or two double stranded breaks, or a combination of single strand and double strand breaks, in the target nucleic acid sequence, each guide RNA is selected from one of Tables 12A-12D.

In another embodiment, a POAG target position, e.g., a mutation hotspot between amino acids 477-502 is targeted, e.g., for correction. In an embodiment, the targeting domain comprises a sequence that is the same as, or differs by no more than 1, 2, 3, 4, or 5 nucleotides from, a targeting domain sequence from any one of Tables 13A-13E. In an embodiment, the targeting domain is independently selected from those in Tables 13A-13E. In another embodiment, the targeting domain is independently selected from Table 13A.

In an embodiment, when the POAG target hotspot position is the mutation hotspot between amino acids 477-502 and more than one gRNA is used to position breaks, e.g., two single stranded breaks or two double stranded breaks, or a combination of single strand and double strand breaks, in the target nucleic acid sequence, each guide RNA is selected from one of Tables 13A-13E.

In another embodiment, a POAG target position, e.g., a mutation hotspot between amino acids 477-502 is targeted, e.g., for correction. In an embodiment, the targeting domain comprises a sequence that is the same as, or differs by no more than 1, 2, 3, 4, or 5 nucleotides from, a targeting domain sequence from any one of Tables 14A-14C. In an embodiment, the targeting domain is independently selected from those in Tables 14A-14C. In another embodiment, the targeting domain is independently selected from Table 14A.

In an embodiment, when the POAG target hotspot position is the mutation hotspot between amino acids 477-502 and more than one gRNA is used to position breaks, e.g., two single stranded breaks or two double stranded breaks, or a combination of single strand and double strand breaks, in the target nucleic acid sequence, each guide RNA is selected from one of Tables 14A-14C.

In another embodiment, a POAG target position, e.g., a mutation hotspot between amino acids 477-502 is targeted, e.g., for correction. In an embodiment, the targeting domain comprises a sequence that is the same as, or differs by no more than 1, 2, 3, 4, or 5 nucleotides from, a targeting domain sequence from any one of Tables 15A-15D. In an embodiment, the targeting domain is independently selected from those in Tables 15A-15D. In another embodiment, the targeting domain is independently selected from Table 15A.

In an embodiment, when the POAG target hotspot position is the mutation hotspot between amino acids 477-502 and more than one gRNA is used to position breaks, e.g., two single stranded breaks or two double stranded breaks, or a combination of single strand and double strand breaks, in the target nucleic acid sequence, each guide RNA is selected from one of Tables 15A-15D.

In another embodiment, a POAG target position, e.g., a mutation hotspot between amino acids 477-502 is targeted, e.g., for correction. In an embodiment, the targeting domain comprises a sequence that is the same as, or differs by no more than 1, 2, 3, 4, or 5 nucleotides from, a targeting domain sequence from any one of Tables 16A-16E. In an embodiment, the targeting domain is independently selected from those in Tables 16A-16E. In another embodiment, the targeting domain is independently selected from Table 16A.

In an embodiment, when the POAG target hotspot position is the mutation hotspot between amino acids 477-502 and more than one gRNA is used to position breaks, e.g., two single stranded breaks or two double stranded breaks, or a combination of single strand and double strand breaks, in the target nucleic acid sequence, each guide RNA is selected from one of Tables 16A-16E.

In another embodiment, a POAG target position, e.g., a mutation hotspot between amino acids 477-502 is targeted, e.g., for correction. In an embodiment, the targeting domain comprises a sequence that is the same as, or differs by no more than 1, 2, 3, 4, or 5 nucleotides from, a targeting domain sequence from any one of Tables 17A-17B. In an embodiment, the targeting domain is independently selected from those in Tables 17A-17B. In another embodiment, the targeting domain is independently selected from Table 17A.

In an embodiment, when the POAG target hotspot position is the mutation hotspot between amino acids 477-502 and more than one gRNA is used to position breaks, e.g., two single stranded breaks or two double stranded breaks, or a combination of single strand and double strand breaks, in the target nucleic acid sequence, each guide RNA is selected from one of Tables 17A-17B.

In another embodiment, the early coding region of the MYOC gene is targeted, e.g., for correction. In an embodiment, the targeting domain comprises a sequence that is the same as, or differs by no more than 1, 2, 3, 4, or 5 nucleotides from, a targeting domain sequence from any one of Tables 4A-4E, 6A-6E, 7A-7G, or 8A-8E. In an embodiment, the targeting domain is independently selected from those in Tables 4A-4E, 6A-6E, 7A-7G, or 8A-8E.

In an embodiment, when the POAG target knockout position is the MYOC early coding region and more than one gRNA is used to position breaks, e.g., two single stranded breaks or two double stranded breaks, or a combination of single strand and double strand breaks, e.g., to create one or more indels, in the target nucleic acid sequence, each guide RNA is selected from one of Tables 4A-4E, 6A-6E, 7A-7G, or 8A-8E.

In another embodiment, the early coding region of the MYOC gene is targeted, e.g., for correction. In an embodiment, the targeting domain comprises a sequence that is the same as, or differs by no more than 1, 2, 3, 4, or 5 nucleotides from, a targeting domain sequence from any one of Tables 4A-4E. In an embodiment, the targeting domain is independently selected from those in Tables 4A-4E. In another embodiment, the targeting domain is independently selected from Table 4A.

In an embodiment, when the POAG target knockout position is the MYOC early coding region and more than one gRNA is used to position breaks, e.g., two single stranded breaks or two double stranded breaks, or a combination of single strand and double strand breaks, e.g., to create one or more indels, in the target nucleic acid sequence, each guide RNA is selected from one of Tables 4A-4E.

In another embodiment, the early coding region of the MYOC gene is targeted, e.g., for correction. In an embodiment, the targeting domain comprises a sequence that is the same as, or differs by no more than 1, 2, 3, 4, or 5 nucleotides from, a targeting domain sequence from any one of Tables 6A-6E. In an embodiment, the targeting domain is independently selected from those in Tables 6A-6E. In another embodiment, the targeting domain is independently selected from Table 6A.

In an embodiment, when the POAG target knockout position is the MYOC early coding region and more than one gRNA is used to position breaks, e.g., two single stranded breaks or two double stranded breaks, or a combination of single strand and double strand breaks, e.g., to create one or more indels, in the target nucleic acid sequence, each guide RNA is selected from one of Tables 6A-6E.

In another embodiment, the early coding region of the MYOC gene is targeted, e.g., for correction. In an embodiment, the targeting domain comprises a sequence that is the same as, or differs by no more than 1, 2, 3, 4, or 5 nucleotides from, a targeting domain sequence from any one of Tables 7A-7G. In an embodiment, the targeting domain is independently selected from those in Tables 7A-7G. In another embodiment, the targeting domain is independently selected from Table 7A.

In an embodiment, when the POAG target knockout position is the MYOC early coding region and more than one gRNA is used to position breaks, e.g., two single stranded breaks or two double stranded breaks, or a combination of single strand and double strand breaks, e.g., to create one or more indels, in the target nucleic acid sequence, each guide RNA is selected from one of Tables 7A-7G.

In another embodiment, the early coding region of the MYOC gene is targeted, e.g., for correction. In an embodiment, the targeting domain comprises a sequence that is the same as, or differs by no more than 1, 2, 3, 4, or 5 nucleotides from, a targeting domain sequence from any one of Tables 8A-8E. In an embodiment, the targeting domain is independently selected from those in Tables 8A-8E. In another embodiment, the targeting domain is independently selected from Table 8A.

In an embodiment, when the POAG target knockout position is the MYOC early coding region and more than one gRNA is used to position breaks, e.g., two single stranded breaks or two double stranded breaks, or a combination of single strand and double strand breaks, e.g., to create one or more indels, in the target nucleic acid sequence, each guide RNA is selected from one of Tables 8A-8E.

In an embodiment, the targeting domain of the gRNA molecule is configured to target an enzymatically inactive Cas9 (eiCas9) molecule or an eiCas9 fusion protein (e.g., an eiCas9 fused to a transcription repressor domain), sufficiently close to a POAG target knockdown position to reduce, decrease or repress expression of the MYOC gene. In an embodiment, the targeting domain is configured to target the promoter region of the MYOC gene to reduce (e.g., block) transcription initiation, binding of one or more transcription enhancers or activators, and/or RNA polymerase. One or more gRNA may be used to target an eiCas9 molecule to the promoter region of the MYOC gene.

In an embodiment, when the MYOC promoter region is targeted, the targeting domain can comprise a sequence that is the same as, or differs by no more than 1, 2, 3, 4, or 5 nucleotides from, a targeting domain sequence from any one of Tables 5A-5F, 9A-9E, 10A-10G, or 11A-11E. In an embodiment, the targeting domain is independently selected from those in Tables 5A-5F, 9A-9E, 10A-10G, or 11A-11E.

In an embodiment, when the POAG target knockdown position is the MYOC promoter region and more than one gRNA is used to position an eiCas9 molecule or an eiCas9-fusion protein (e.g., an eiCas9-transcription repressor domain fusion protein), in the target nucleic acid sequence, each guide RNA is selected from one of 5A-5F, 9A-9E, 10A-10G, or 11A-11E.

In an embodiment, when the MYOC promoter region is targeted, the targeting domain can comprise a sequence that is the same as, or differs by no more than 1, 2, 3, 4, or 5 nucleotides from, a targeting domain sequence from any one of Tables 5A-5F. In an embodiment, the targeting domain is independently selected from those in Tables 5A-5F. In another embodiment, the targeting domain is independently selected from Table 5A.

In an embodiment, when the POAG target knockdown position is the MYOC promoter region and more than one gRNA is used to position an eiCas9 molecule or an eiCas9-fusion protein (e.g., an eiCas9-transcription repressor domain fusion protein), in the target nucleic acid sequence, each guide RNA is selected from one of Tables 5A-5F.

In an embodiment, when the MYOC promoter region is targeted, the targeting domain can comprise a sequence that is the same as, or differs by no more than 1, 2, 3, 4, or 5 nucleotides from, a targeting domain sequence from any one of Tables 9A-9E. In an embodiment, the targeting domain is independently selected from those in Tables 9A-9E. In another embodiment, the targeting domain is independently selected from Table 9A.

In an embodiment, when the POAG target knockdown position is the MYOC promoter region and more than one gRNA is used to position an eiCas9 molecule or an eiCas9-fusion protein (e.g., an eiCas9-transcription repressor domain fusion protein), in the target nucleic acid sequence, each guide RNA is selected from one of Tables 9A-9E.

In an embodiment, when the MYOC promoter region is targeted, the targeting domain can comprise a sequence that is the same as, or differs by no more than 1, 2, 3, 4, or 5 nucleotides from, a targeting domain sequence from any one of Tables 10A-10G. In an embodiment, the targeting domain is independently selected from those in Tables 10A-10G. In another embodiment, the targeting domain is independently selected from Table 10A.

In an embodiment, when the POAG target knockdown position is the MYOC promoter region and more than one gRNA is used to position an eiCas9 molecule or an eiCas9-fusion protein (e.g., an eiCas9-transcription repressor domain fusion protein), in the target nucleic acid sequence, each guide RNA is selected from one of Tables 10A-10G.

In an embodiment, when the MYOC promoter region is targeted, the targeting domain can comprise a sequence that is the same as, or differs by no more than 1, 2, 3, 4, or 5 nucleotides from, a targeting domain sequence from any one of Tables 11A-11E. In an embodiment, the targeting domain is independently selected from those in Tables 11A-11E. In another embodiment, the targeting domain is independently selected from Table 11A.

In an embodiment, when the POAG target knockdown position is the MYOC promoter region and more than one gRNA is used to position an eiCas9 molecule or an eiCas9-fusion protein (e.g., an eiCas9-transcription repressor domain fusion protein), in the target nucleic acid sequence, each guide RNA is selected from one of Tables 11A-11E.

In an embodiment, the gRNA, e.g., a gRNA comprising a targeting domain, which is complementary with the MYOC gene, is a modular gRNA. In other embodiments, the gRNA is a unimolecular or chimeric gRNA.

In an embodiment, the targeting domain which is complementary with a target domain from the POAG target position in the MYOC gene is 16 nucleotides or more in length. In an embodiment, the targeting domain is 16 nucleotides in length. In an embodiment, the targeting domain is 17 nucleotides in length. In another embodiment, the targeting domain is 18 nucleotides in length. In still another embodiment, the targeting domain is 19 nucleotides in length. In still another embodiment, the targeting domain is 20 nucleotides in length. In still another embodiment, the targeting domain is 21 nucleotides in length. In still another embodiment, the targeting domain is 22 nucleotides in length. In still another embodiment, the targeting domain is 23 nucleotides in length. In still another embodiment, the targeting domain is 24 nucleotides in length. In still another embodiment, the targeting domain is 25 nucleotides in length. In still another embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

A gRNA as described herein may comprise from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a gRNA comprises a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 25 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In another embodiment, a gRNA comprises a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

A cleavage event, e.g., a double strand or single strand break, is generated by a Cas9 molecule. The Cas9 molecule may be an enzymatically active Cas9 (eaCas9) molecule, e.g., an eaCas9 molecule that forms a double strand break in a target nucleic acid or an eaCas9 molecule forms a single strand break in a target nucleic acid (e.g., a nickase molecule). Alternatively, in an embodiment, the Cas9 molecule may be an enzymatically inactive Cas9 (eiCas9) molecule or a modified eiCas9 molecule, e.g., the eiCas9 molecule is fused to Krüppel-associated box (KRAB) to generate an eiCas9-KRAB fusion protein molecule.

In an embodiment, the eaCas9 molecule catalyzes a double strand break.

In some embodiments, the eaCas9 molecule comprises HNH-like domain cleavage activity but has no, or no significant, N-terminal RuvC-like domain cleavage activity. In an embodiment, the eaCas9 molecule is an HNH-like domain nickase, e.g., the eaCas9 molecule comprises a mutation at D10, e.g., D10A. In another embodiment, the eaCas9 molecule comprises N-terminal RuvC-like domain cleavage activity but has no, or no significant, HNH-like domain cleavage activity. In an embodiment, the eaCas9 molecule is an N-terminal RuvC-like domain nickase, e.g., the eaCas9 molecule comprises a mutation at H840, e.g., H840A. In an embodiment, the eaCas9 molecule is an N-terminal RuvC-like domain nickase, e.g., the eaCas9 molecule comprises a mutation at N863, e.g., an N863A mutation.

In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

In another aspect, disclosed herein is a nucleic acid, e.g., an isolated or non-naturally occurring nucleic acid, e.g., DNA, that comprises (a) a sequence that encodes a gRNA molecule comprising a targeting domain that is complementary with a POAG target position in the MYOC gene as disclosed herein.

In an embodiment, the nucleic acid encodes a gRNA molecule, e.g., a first gRNA molecule, comprising a targeting domain configured to provide a cleavage event, e.g., a double strand break or a single strand break, sufficiently close to a POAG target position in the MYOC gene to allow alteration, e.g., alteration associated with HDR or NHEJ, of a POAG target position in the MYOC gene.

In an embodiment, the nucleic acid encodes a gRNA molecule, e.g., a first gRNA molecule, comprising a targeting domain configured to target an enzymatically inactive Cas9 (eiCas9) molecule or an eiCas9 fusion protein (e.g., an eiCas9 fused to a transcription repressor domain), sufficiently close to a POAG target knockdown position to reduce, decrease or repress expression of the MYOC gene.

In an embodiment, the nucleic acid encodes a gRNA molecule, e.g., the first gRNA molecule, comprising a targeting domain comprising a sequence that is the same as, or differs by no more than 1, 2, 3, 4, or 5 nucleotides from, a targeting domain sequence from any one of 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B. In an embodiment, the nucleic acid encodes a gRNA molecule comprising a targeting domain is selected from those in 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B.

In an embodiment, the nucleic acid encodes a modular gRNA, e.g., one or more nucleic acids encode a modular gRNA. In another embodiment, the nucleic acid encodes a chimeric gRNA. The nucleic acid may encode a gRNA, e.g., the first gRNA molecule, comprising a targeting domain comprising 16 nucleotides or more in length. In an embodiment, the nucleic acid encodes a gRNA, e.g., the first gRNA molecule, comprising a targeting domain that is 16 nucleotides in length. In another embodiment, the nucleic acid encodes a gRNA, e.g., the first gRNA molecule, comprising a targeting domain that is 17 nucleotides in length. In another embodiment, the nucleic acid encodes a gRNA, e.g., the first gRNA molecule, comprising a targeting domain that is 18 nucleotides in length. In still another embodiment, the nucleic acid encodes a gRNA, e.g., the first gRNA molecule, comprising a targeting domain that is 19 nucleotides in length. In still another embodiment, the nucleic acid encodes a gRNA, e.g., the first gRNA molecule, comprising a targeting domain that is 20 nucleotides in length. In still another embodiment, the nucleic acid encodes a gRNA, e.g., the first gRNA molecule, comprising a targeting domain that is 21 nucleotides in length. In still another embodiment, the nucleic acid encodes a gRNA, e.g., the first gRNA molecule, comprising a targeting domain that is 22 nucleotides in length. In still another embodiment, the nucleic acid encodes a gRNA, e.g., the first gRNA molecule, comprising a targeting domain that is 23 nucleotides in length. In still another embodiment, the nucleic acid encodes a gRNA, e.g., the first gRNA molecule, comprising a targeting domain that is 24 nucleotides in length. In still another embodiment, the nucleic acid encodes a gRNA, e.g., the first gRNA molecule, comprising a targeting domain that is 25 nucleotides in length. In still another embodiment, the nucleic acid encodes a gRNA, e.g., the first gRNA molecule, comprising a targeting domain that is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, a nucleic acid encodes a gRNA comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a gRNA e.g., the first gRNA molecule, comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 25 nucleotides in length; and a targeting domain equal to or greater than 16, 17, 18, 19, 20, 21, 22, 23, 24, 25 or 26 nucleotides in length.

In an embodiment, a nucleic acid encodes a gRNA e.g., the first gRNA molecule, comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a gRNA comprising e.g., the first gRNA molecule, a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In an embodiment, a nucleic acid comprises (a) a sequence that encodes a gRNA molecule e.g., the first gRNA molecule, comprising a targeting domain that is complementary with a target domain in the MYOC gene as disclosed herein, and further comprising (b) a sequence that encodes a Cas9 molecule.

The Cas9 molecule may be an enzymatically active Cas9 (eaCas9) molecule, e.g., an eaCas9 molecule that forms a double strand break in a target nucleic acid or an eaCas9 molecule that forms a single strand break in a target nucleic acid (e.g., a nickase molecule). In an embodiment, a single strand break is formed in the strand of the target nucleic acid to which the targeting domain of said gRNA is complementary. In another embodiment, a single strand break is formed in the strand of the target nucleic acid other than the strand to which to which the targeting domain of said gRNA is complementary.

In an embodiment, the eaCas9 molecule catalyzes a double strand break.

In an embodiment, the eaCas9 molecule comprises HNH-like domain cleavage activity but has no, or no significant, N-terminal RuvC-like domain cleavage activity. In another embodiment, the said eaCas9 molecule is an HNH-like domain nickase, e.g., the eaCas9 molecule comprises a mutation at D10, e.g., D10A. In another embodiment, the eaCas9 molecule comprises N-terminal RuvC-like domain cleavage activity but has no, or no significant, HNH-like domain cleavage activity. In another embodiment, the eaCas9 molecule is an N-terminal RuvC-like domain nickase, e.g., the eaCas9 molecule comprises a mutation at H840, e.g., H840A. In another embodiment, the eaCas9 molecule is an N-terminal RuvC-like domain nickase, e.g., the eaCas9 molecule comprises a mutation at N863, e.g., an N863A mutation.

A nucleic acid disclosed herein may comprise (a) a sequence that encodes a gRNA molecule comprising a targeting domain that is complementary with a target domain in the BCL11A gene as disclosed herein; (b) a sequence that encodes a Cas9 molecule.

Alternatively, in an embodiment, the Cas9 molecule may be an enzymatically inactive Cas9 (eiCas9) molecule or a modified eiCas9 molecule, e.g., the eiCas9 molecule is fused to Krüppel-associated box (KRAB) to generate an eiCas9-KRAB fusion protein molecule.

A nucleic acid disclosed herein may comprise (a) a sequence that encodes a gRNA molecule comprising a targeting domain that is complementary with a target domain in the MYOC gene as disclosed herein; (b) a sequence that encodes a Cas9 molecule; and further may comprise (c)(i) a sequence that encodes a second gRNA molecule described herein having a targeting domain that is complementary to a second target domain of the MYOC gene, and optionally, (c)(ii) a sequence that encodes a third gRNA molecule described herein having a targeting domain that is complementary to a third target domain of the MYOC gene; and optionally, (c)(iii) a sequence that encodes a fourth gRNA molecule described herein having a targeting domain that is complementary to a fourth target domain of the MYOC gene.

In an embodiment, a nucleic acid encodes a second gRNA molecule comprising a targeting domain configured to provide a cleavage event, e.g., a double strand break or a single strand break, sufficiently close to a POAG target position in the MYOC gene, to allow alteration, e.g., alteration associated with HDR or NHEJ, of a POAG target position in the MYOC gene, either alone or in combination with the break positioned by said first gRNA molecule.

In an embodiment, the nucleic acid encodes a second gRNA molecule comprising a targeting domain configured to target an enzymatically inactive Cas9 (eiCas9) molecule or an eiCas9 fusion protein (e.g., an eiCas9 fused to a transcription repressor domain), sufficiently close to a POAG target knockdown position to reduce, decrease or repress expression of the MYOC gene.

In an embodiment, a nucleic acid encodes a third gRNA molecule comprising a targeting domain configured to provide a cleavage event, e.g., a double strand break or a single strand break, sufficiently close to a POAG target position in the MYOC gene to allow alteration, e.g., alteration associated with HDR or NHEJ, of a POAG target position in the MYOC gene, either alone or in combination with the break positioned by the first and/or second gRNA molecule.

In an embodiment, the nucleic acid encodes a third gRNA molecule comprising a targeting domain configured to target an enzymatically inactive Cas9 (eiCas9) molecule or an eiCas9 fusion protein (e.g., an eiCas9 fused to a transcription repressor domain), sufficiently close to a POAG target knockdown position to reduce, decrease or repress expression of the BCL11A gene.

In an embodiment, a nucleic acid encodes a fourth gRNA molecule comprising a targeting domain configured to provide a cleavage event, e.g., a double strand break or a single strand break, sufficiently close to a POAG target position in the MYOC gene to allow alteration, e.g., alteration associated with HDR or NHEJ, of a POAG target position in the MYOC gene, either alone or in combination with the break positioned by the first gRNA molecule, the second gRNA molecule and/or the third gRNA molecule.

In an embodiment, the nucleic acid encodes a fourth gRNA molecule comprising a targeting domain configured to target an enzymatically inactive Cas9 (eiCas9) or an eiCas9 fusion protein (e.g., an eiCas9 fused to a transcription repressor domain), sufficiently close to a POAG target knockdown position to reduce, decrease or repress expression of the MYOC gene.

In an embodiment, the nucleic acid encodes a second gRNA molecule. The second gRNA is selected to target the same POAG target position as the first gRNA molecule. Optionally, the nucleic acid may encode a third gRNA, and further optionally, the nucleic acid may encode a fourth gRNA molecule. The third gRNA molecule and the fourth gRNA molecule are selected to target the same POAG target position as the first and second gRNA molecules.

In an embodiment, the nucleic acid encodes a second gRNA molecule comprising a targeting domain comprising a sequence that is the same as, or differs by no more than 1, 2, 3, 4, or 5 nucleotides from, a targeting domain sequence from one of Tables 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B. In an embodiment, the nucleic acid encodes a second gRNA molecule comprising a targeting domain selected from those in Tables 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B. In an embodiment, when a third or fourth gRNA molecule are present, the third and fourth gRNA molecules may independently comprise a targeting domain comprising a sequence that is the same as, or differs by no more than 1, 2, 3, 4, or 5 nucleotides from, a targeting domain sequence from one of Tables 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B. In a further embodiment, when a third or fourth gRNA molecule are present, the third and fourth gRNA molecules may independently comprise a targeting domain selected from those in Tables 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B.

In an embodiment, the nucleic acid encodes a second gRNA which is a modular gRNA, e.g., wherein one or more nucleic acid molecules encode a modular gRNA. In another embodiment, the nucleic acid encoding a second gRNA is a chimeric gRNA. In another embodiment, when a nucleic acid encodes a third or fourth gRNA, the third and fourth gRNA may be a modular gRNA or a chimeric gRNA. When multiple gRNAs are used, any combination of modular or chimeric gRNAs may be used.

A nucleic acid may encode a second, a third, and/or a fourth gRNA, each independently, comprising a targeting domain comprising 16 nucleotides or more in length. In an embodiment, the nucleic acid encodes a second gRNA comprising a targeting domain that is 16 nucleotides in length. In an embodiment, the nucleic acid encodes a second gRNA comprising a targeting domain that is 17 nucleotides in length. In another embodiment, the nucleic acid encodes a second gRNA comprising a targeting domain that is 18 nucleotides in length. In still another embodiment, the nucleic acid encodes a second gRNA comprising a targeting domain that is 19 nucleotides in length. In still another embodiment, the nucleic acid encodes a second gRNA comprising a targeting domain that is 20 nucleotides in length. In still another embodiment, the nucleic acid encodes a second gRNA comprising a targeting domain that is 21 nucleotides in length. In still another embodiment, the nucleic acid encodes a second gRNA comprising a targeting domain that is 22 nucleotides in length. In still another embodiment, the nucleic acid encodes a second gRNA comprising a targeting domain that is 23 nucleotides in length. In still another embodiment, the nucleic acid encodes a second gRNA comprising a targeting domain that is 24 nucleotides in length. In still another embodiment, the nucleic acid encodes a second gRNA comprising a targeting domain that is 25 nucleotides in length. In still another embodiment, the nucleic acid encodes a second gRNA comprising a targeting domain that is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, a nucleic acid encodes a second, a third, and/or a fourth gRNA, each independently, comprising from 5' to 3': a targeting domain (comprising a "core domain", and optionally a "secondary domain"); a first complementarity domain; a linking domain; a second complementarity domain; a proximal domain; and a tail domain. In some embodiments, the proximal domain and tail domain are taken together as a single domain.

In an embodiment, a nucleic acid encodes a second, a third, and/or a fourth gRNA comprising a linking domain of no more than 25 nucleotides in length; a proximal and tail domain, that taken together, are at least 20 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 25 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 30 nucleotides in length; and a targeting domain equal to or greater than 16, 17, 18, 19, 20, 21, 22, 23, 24, 25 or 26 nucleotides in length.

In an embodiment, a nucleic acid encodes a second, a third, and/or a fourth gRNA comprising a linking domain of no more than 25 nucleotides in length; a proximal and tail domain, that taken together, are at least 40 nucleotides in length; and a targeting domain equal to or greater than 16, 17, 18, 19, 20, 21, 22, 23, 24, 25 or 26 nucleotides in length.

In an embodiment, when the MYOC gene is corrected by HDR, the nucleic acid encodes (a) a sequence that encodes a gRNA molecule comprising a targeting domain that is complementary with a target domain in the MYOC gene as disclosed herein; (b) a sequence that encodes a Cas9 molecule; optionally, (c)(i) a sequence that encodes a second gRNA molecule described herein having a targeting domain that is complementary to a second target domain of the MYOC gene, and further optionally, (c)(ii) a sequence that encodes a third gRNA molecule described herein having a targeting domain that is complementary to a third target domain of the MYOC gene; and still further optionally, (c)(iii) a sequence that encodes a fourth gRNA molecule described herein having a targeting domain that is complementary to a fourth target domain of the MYOC gene; and further may comprise (d) a template nucleic acid, e.g., a template nucleic acid described herein.

In an embodiment, the template nucleic acid is a single stranded nucleic acid. In another embodiment, the template nucleic acid is a double stranded nucleic acid. In another embodiment, the template nucleic acid comprises a nucleotide sequence, e.g., of one or more nucleotides, that will be added to or will template a change in the target nucleic acid. In another embodiment, the template nucleic acid comprises a nucleotide sequence that may be used to modify the target position. In another embodiment, the template nucleic acid comprises a nucleotide sequence, e.g., of one or more nucleotides, that corresponds to wild type sequence of the target nucleic acid, e.g., of the target position.

The template nucleic acid may comprise a replacement sequence, e.g., a replacement sequence from the Table 24. In some embodiments, the template nucleic acid comprises a 5' homology arm, e.g., a 5' homology arm from Table 24. In other embodiments, the template nucleic acid comprises a 3' homology arm, e.g., a 3' homology arm from Table 24.

In an embodiment, a nucleic acid encodes (a) a sequence that encodes a gRNA molecule comprising a targeting domain that is complementary with a target domain in the MYOC gene as disclosed herein, and (b) a sequence that encodes a Cas9 molecule, e.g., a Cas9 molecule described herein. In an embodiment, (a) and (b) are present on the same nucleic acid molecule, e.g., the same vector, e.g., the same viral vector, e.g., the same adeno-associated virus (AAV) vector. In an embodiment, the nucleic acid molecule is an AAV vector. Exemplary AAV vectors that may be used in any of the described compositions and methods include an AAV2 vector, a modified AAV2 vector, an AAV3 vector, a modified AAV3 vector, an AAV6 vector, a modified AAV6 vector, an AAV8 vector and an AAV9 vector.

In another embodiment, (a) is present on a first nucleic acid molecule, e.g. a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors.

In another embodiment, a nucleic acid encodes (a) a sequence that encodes a gRNA molecule comprising a targeting domain that is complementary with a target domain in the MYOC gene as disclosed herein, and (b) a sequence that encodes a Cas9 molecule, e.g., a Cas9 molecule described herein; and further comprise (c)(i) a sequence that encodes a second gRNA molecule as described herein and optionally, (c)(ii) a sequence that encodes a third gRNA molecule described herein having a targeting domain that is complementary to a third target domain of the MYOC gene; and optionally, (c)(iii) a sequence that encodes a fourth gRNA molecule described herein having a targeting domain that is complementary to a fourth target domain of the MYOC gene. In some embodiments, the nucleic acid comprises (a), (b) and (c)(i). In an embodiment, the nucleic acid comprises (a), (b), (c)(i) and (c)(ii). In an embodiment, the nucleic acid comprises (a), (b), (c)(i), (c)(ii) and (c)(iii). Each of (a) and (c)(i), (c)(ii) and/or (c)(iii) may be present on the same nucleic acid molecule, e.g., the same vector, e.g., the same viral vector, e.g., the same adeno-associated virus (AAV) vector. In an embodiment, the nucleic acid molecule is an AAV vector.

In another embodiment, (a) and (c)(i) are on different vectors. For example, (a) may be present on a first nucleic acid molecule, e.g. a first vector, e.g., a first viral vector, e.g., a first AAV vector; and (c)(i) may be present on a second nucleic acid molecule, e.g., a second vector, e.g., a second vector, e.g., a second AAV vector. In an embodiment, the first and second nucleic acid molecules are AAV vectors.

In another embodiment, each of (a), (b), and (c)(i) are present on the same nucleic acid molecule, e.g., the same vector, e.g., the same viral vector, e.g., an AAV vector. In an embodiment, the nucleic acid molecule is an AAV vector. In an alternate embodiment, one of (a), (b), and (c)(i) is encoded on a first nucleic acid molecule, e.g., a first vector, e.g., a first viral vector, e.g., a first AAV vector; and a second and third of (a), (b), and (c)(i) is encoded on a second nucleic acid molecule, e.g., a second vector, e.g., a second vector, e.g., a second AAV vector. The first and second nucleic acid molecule may be AAV vectors.

In an embodiment, (a) is present on a first nucleic acid molecule, e.g., a first vector, e.g., a first viral vector, a first AAV vector; and (b) and (c)(i) are present on a second nucleic acid molecule, e.g., a second vector, e.g., a second vector, e.g., a second AAV vector. The first and second nucleic acid molecule may be AAV vectors.

In another embodiment, (b) is present on a first nucleic acid molecule, e.g., a first vector, e.g., a first viral vector, e.g., a first AAV vector; and (a) and (c)(i) are present on a second nucleic acid molecule, e.g., a second vector, e.g., a second vector, e.g., a second AAV vector. The first and second nucleic acid molecule may be AAV vectors.

In another embodiment, (c)(i) is present on a first nucleic acid molecule, e.g., a first vector, e.g., a first viral vector, e.g., a first AAV vector; and (b) and (a) are present on a second nucleic acid molecule, e.g., a second vector, e.g., a second vector, e.g., a second AAV vector. The first and second nucleic acid molecule may be AAV vectors.

In another embodiment, each of (a), (b) and (c)(i) are present on different nucleic acid molecules, e.g., different vectors, e.g., different viral vectors, e.g., different AAV vector. For example, (a) may be on a first nucleic acid molecule, (b) on a second nucleic acid molecule, and (c)(i) on a third nucleic acid molecule. The first, second and third nucleic acid molecule may be AAV vectors.

In another embodiment, when a third and/or fourth gRNA molecule are present, each of (a), (b), (c)(i), (c)(ii) and (c)(iii) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii) and (c)(iii) may be present on the different nucleic acid molecules, e.g., different vectors, e.g., the different viral vectors, e.g., different AAV vectors. In a further embodiment, each of (a), (b), (c)(i), (c)(ii) and (c)(iii) may be present on more than one nucleic acid molecule, but fewer than five nucleic acid molecules, e.g., AAV vectors.

In another embodiment, when (d) a template nucleic acid is present, each of (a), (b), and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), and (d) may be present on the different nucleic acid molecules, e.g., different vectors, e.g., the different viral vectors, e.g., different AAV vectors. In a further embodiment, each of (a), (b), and (d) may be present on more than one nucleic acid molecule, but fewer than three nucleic acid molecules, e.g., AAV vectors.

In another embodiment, when (d) a template nucleic acid is present, each of (a), (b), (c)(i) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i) and (d) may be present on the different nucleic acid molecules, e.g., different vectors, e.g., the different viral vectors, e.g., different AAV vectors. In a further embodiment, each of (a), (b), (c)(i) and (d) may be present on more than one nucleic acid molecule, but fewer than four nucleic acid molecules, e.g., AAV vectors.

In another embodiment, when (d) a template nucleic acid is present, each of (a), (b), (c)(i), (c)(ii) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii) and (d) may be present on the different nucleic acid molecules, e.g., different vectors, e.g., the different viral vectors, e.g., different AAV vectors. In a further embodiment, each of (a), (b), (c)(i), (c)(ii) and (d) may be present on more than one nucleic acid molecule, but fewer than five nucleic acid molecules, e.g., AAV vectors.

In another embodiment, when (d) a template nucleic acid is present, each of (a), (b), (c)(i), (c)(ii), (c)(iii) and (d) may be present on the same nucleic acid molecule, e.g., the same vector, e.g., the same viral vector, e.g., an AAV vector. In an embodiment, the nucleic acid molecule is an AAV vector. In an alternate embodiment, each of (a), (b), (c)(i), (c)(ii), (c)(iii) and (d) may be present on the different nucleic acid molecules, e.g., different vectors, e.g., the different viral vectors, e.g., different AAV vectors. In a further embodiment, each of (a), (b), (c)(i), (c)(ii), (c)(iii) and (d) may be present on more than one nucleic acid molecule, but fewer than six nucleic acid molecules, e.g., AAV vectors.

The nucleic acids described herein may comprise a promoter operably linked to the sequence that encodes the gRNA molecule of (a), e.g., a promoter described herein. The nucleic acid may further comprise a second promoter operably linked to the sequence that encodes the second, third and/or fourth gRNA molecule of (c), e.g., a promoter described herein. The promoter and second promoter differ from one another. In some embodiments, the promoter and second promoter are the same.

The nucleic acids described herein may further comprise a promoter operably linked to the sequence that encodes the Cas9 molecule of (b), e.g., a promoter described herein.

In another aspect, disclosed herein is a composition comprising (a) a gRNA molecule comprising a targeting domain that is complementary with a target domain in the MYOC gene, as described herein. The composition of (a) may further comprise (b) a Cas9 molecule, e.g., a Cas9 molecule as described herein. A composition of (a) and (b) may further comprise (c) a second, third and/or fourth gRNA molecule, e.g., a second, third and/or fourth gRNA molecule described herein. A composition of (a), (b) and (c) a second, third and/or fourth gRNA molecule, e.g., a second, third and/or fourth gRNA molecule may further comprise (d) a template nucleic acid, e.g., a template nucleic acid described herein. In an embodiment, the composition is a pharmaceutical composition. The compositions described herein, e.g., pharmaceutical compositions described herein, can be used in the treatment or prevention of POAG in a subject, e.g., in accordance with a method disclosed herein.

In another aspect, disclosed herein is a method of altering a cell, e.g., altering the structure, e.g., altering the sequence, of a target nucleic acid of a cell, comprising contacting said cell with: (a) a gRNA that targets the MYOC gene, e.g., a gRNA as described herein; (b) a Cas9 molecule, e.g., a Cas9 molecule as described herein; and optionally, (c) a second, third and/or fourth gRNA that targets MYOC gene, e.g., a second third and/or fourth gRNA as described herein; and optionally, (d) a template nucleic acid, as described herein.

In an embodiment, the method comprises contacting said cell with (a) and (b).

In an embodiment, the method comprises contacting said cell with (a), (b), and (c).

In an embodiment, the method comprises contacting said cell with (a), (b), (c) and (d).

The gRNA of (a) and optionally (c) may be selected from any of 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B, or a gRNA that differs by no more than 1, 2, 3, 4, or 5 nucleotides from, a targeting domain sequence from any of 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B.

In an embodiment, the method comprises contacting a cell from a subject suffering from or likely to develop POAG. The cell may be from a subject having a mutation at a POAG target position in the MYOC gene.

In an embodiment, the cell being contacted in the disclosed method is a target cell from the eye of the subject. The cell may be a trabecular meshwork cell, retinal pigment epithelial cell, a retinal cell, an iris cell, a ciliary body cell and/or the optic nerve. The contacting may be performed ex vivo and the contacted cell may be returned to the subject's body after the contacting step. In other embodiments, the contacting step may be performed in vivo.

In an embodiment, the method of altering a cell as described herein comprises acquiring knowledge of the presence of a mutation at a POAG target position in said cell, prior to the contacting step. Acquiring knowledge of the presence of a mutation at a POAG target position in the cell may be by sequencing the MYOC gene, or a portion of the MYOC gene.

In an embodiment, the contacting step of the method comprises contacting the cell with a nucleic acid, e.g., a vector, e.g., an AAV vector, that expresses at least one of (a), (b), and (c). In an embodiment, the contacting step of the method comprises contacting the cell with a nucleic acid, e.g., a vector, e.g., an AAV vector, that expresses each of (a), (b), and (c). In another embodiment, the contacting step of the method comprises delivering to the cell a Cas9 molecule of (b) and a nucleic acid which encodes a gRNA (a) and optionally, a second gRNA (c)(i) (and further optionally, a third gRNA (c)(ii) and/or fourth gRNA (c)(iii).

In an embodiment, the contacting step of the method comprises contacting the cell with a nucleic acid, e.g., a vector, e.g., an AAV vector, that expresses at least one of (a), (b), (c) and (d). In an embodiment, the contacting step of the method comprises contacting the cell with a nucleic acid, e.g., a vector, e.g., an AAV vector, that expresses each of (a), (b), and (c). In another embodiment, the contacting step of the method comprises delivering to the cell a Cas9 molecule of (b), a nucleic acid which encodes a gRNA of (a) and a template nucleic acid of (d), and optionally, a second gRNA (c)(i) (and further optionally, a third gRNA (c)(ii) and/or fourth gRNA (c)(iii).

In an embodiment, contacting comprises contacting the cell with a nucleic acid, e.g., a vector, e.g., an AAV vector, e.g., an AAV2 vector, a modified AAV2 vector, an AAV3 vector, a modified AAV3 vector, an AAV6 vector, a modified AAV6 vector, an AAV8 vector or an AAV9 vector, as described herein.

In an embodiment, contacting comprises delivering to the cell a Cas9 molecule of (b), as a protein or an mRNA, and a nucleic acid which encodes a gRNA of (a) and optionally a second, third and/or fourth gRNA (c).

In an embodiment, contacting comprises delivering to the cell a Cas9 molecule of (b), as a protein or an mRNA, said gRNA of (a), as an RNA, and optionally said second, third and/or fourth gRNA of (c), as an RNA.

In an embodiment, contacting comprises delivering to the cell a gRNA of (a) as an RNA, optionally said second, third and/or fourth gRNA of (c) as an RNA, and a nucleic acid that encodes the Cas9 molecule of (b).

In another aspect, disclosed herein is a method of treating a subject suffering from or likely to develop POAG, e.g., altering the structure, e.g., sequence, of a target nucleic acid of the subject, comprising contacting the subject (or a cell from the subject) with:

(a) a gRNA that targets the MYOC gene, e.g., a gRNA disclosed herein;

(b) a Cas9 molecule, e.g., a Cas9 molecule disclosed herein; and optionally, (c)(i) a second gRNA that targets the MYOC gene, e.g., a second gRNA disclosed herein, and further optionally, (c)(ii) a third gRNA, and still further optionally, (c)(iii) a fourth gRNA that target the MYOC gene, e.g., a third and fourth gRNA disclosed herein.

The method of treating a subject may further comprise contacting the subject (or a cell from the subject) with (d) a template nucleic acid, e.g., a template nucleic acid disclosed herein. A template nucleic acid is used when the method of treating a subject uses HDR to alter the sequence of the target nucleic acid of the subject.

In some embodiments, contacting comprises contacting with (a) and (b).

In some embodiments, contacting comprises contacting with (a), (b), and (c)(i).

In some embodiments, contacting comprises contacting with (a), (b), (c)(i) and (c)(ii).

In some embodiments, contacting comprises contacting with (a), (b), (c)(i), (c)(ii) and (c)(iii).

In some embodiments, contacting comprises contacting with (a), (b), (c)(i) and (d).

In some embodiments, contacting comprises contacting with (a), (b), (c)(i), (c)(ii) and (d).

In some embodiments, contacting comprises contacting with (a), (b), (c)(i), (c)(ii), (c)(iii) and (d).

The gRNA of (a) or (c) (e.g., (c)(i), (c)(ii), or (c)(iii) may be selected from any of 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B, or a gRNA that differs by no more than 1, 2, 3, 4, or 5 nucleotides from, a targeting domain sequence from any of 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B.

In an embodiment, the method comprises acquiring knowledge of the presence of a mutation at a POAG target position in said subject.

In an embodiment, the method comprises acquiring knowledge of the presence of a mutation at a POAG target position in said subject by sequencing the MYOC gene or a portion of the MYOC gene.

In an embodiment, the method comprises correcting a mutation at a POAG target position.

In an embodiment, the method comprises correcting a mutation at a POAG target position by HDR.

In an embodiment, the method comprises correcting a mutation at a POAG target position by NHEJ.

When the method comprises correcting the mutation at a POAG target position by HDR, a Cas9 of (b), at least one guide RNA (e.g., a guide RNA of (a) and a template nucleic acid of (d) are included in the contacting step.

In an embodiment, a cell of the subject is contacted ex vivo with (a), (b), (d) and optionally (c). In an embodiment, said cell is returned to the subject's body.

In an embodiment, a cell of the subject is contacted is in vivo with (a), (b) (d) and optionally (c)(i), further optionally (c)(ii), and still further optionally (c)(iii).

In an embodiment, the cell of the subject is contacted in vivo by subretinal delivery of (a), (b), (d) and optionally (c)(i), further optionally (c)(ii), and still further optionally (c)(iii).

In an embodiment, the contacting step comprises contacting the subject with a nucleic acid, e.g., a vector, e.g., an AAV vector, described herein, e.g., a nucleic acid that encodes at least one of (a), (b), (d) and optionally (c)(i), further optionally (c)(ii), and still further optionally (c)(iii).

In an embodiment, the contacting step comprises delivering to said subject said Cas9 molecule of (b), as a protein or mRNA, and a nucleic acid which encodes (a), a nucleic acid of (d) and optionally (c)(i), further optionally (c)(ii), and still further optionally (c)(iii).

In an embodiment, the contacting step comprises delivering to the subject the Cas9 molecule of (b), as a protein or mRNA, the gRNA of (a), as an RNA, a nucleic acid of (d) and optionally the second gRNA of (c)(i), further optionally said third gRNA of (c)(ii), and still further optionally said fourth gRNA of (c)(iii), as an RNA.

In an embodiment, the contacting step comprises delivering to the subject the gRNA of (a), as an RNA, optionally said second gRNA of (c)(i), further optionally said third gRNA of (c)(ii), and still further optionally said fourth gRNA of (c)(iii), as an RNA, a nucleic acid that encodes the Cas9 molecule of (b), and a nucleic acid of (d).

When the method comprises (1) correcting the mutation at a POAG target position by NHEJ or (2) knocking down expression of the MYOC gene by targeting the promoter region, a Cas9 of (b) and at least one guide RNA (e.g., a guide RNA of (a) are included in the contacting step.

In an embodiment, a cell of the subject is contacted ex vivo with (a), (b) and optionally (c)(i), further optionally (c)(ii), and still further optionally (c)(iii). In an embodiment, said cell is returned to the subject's body.

In an embodiment, a cell of the subject is contacted is in vivo with (a), (b) and optionally (c)(i), further optionally (c)(ii), and still further optionally (c)(iii). In an embodiment, the cell of the subject is contacted in vivo by subretinal delivery of (a), (b) and optionally (c)(i), further optionally (c)(ii), and still further optionally (c)(iii).

In an embodiment, the contacting step comprises contacting the subject with a nucleic acid, e.g., a vector, e.g., an AAV vector, described herein, e.g., a nucleic acid that encodes at least one of (a), (b), and optionally (c)(i), further optionally (c)(ii), and still further optionally (c)(iii).

In an embodiment, the contacting step comprises delivering to said subject said Cas9 molecule of (b), as a protein or mRNA, and a nucleic acid which encodes (a) and optionally (c)(i), further optionally (c)(ii), and still further optionally (c)(iii).

In an embodiment, the contacting step comprises delivering to the subject the Cas9 molecule of (b), as a protein or mRNA, the gRNA of (a), as an RNA, and optionally the second gRNA of (c)(i), further optionally said third gRNA of (c)(ii), and still further optionally said fourth gRNA of (c)(iii), as an RNA.

In an embodiment, the contacting step comprises delivering to the subject the gRNA of (a), as an RNA, optionally said second gRNA of (c)(i), further optionally said third gRNA of (c)(ii), and still further optionally said fourth gRNA of (c)(iii), as an RNA, and a nucleic acid that encodes the Cas9 molecule of (b).

In another aspect, disclosed herein is a reaction mixture comprising a gRNA molecule, a nucleic acid, or a composition described herein, and a cell, e.g., a cell from a subject having, or likely to develop POAG, or a subject having a mutation at a POAG target position In another aspect, disclosed herein is a kit comprising, (a) a gRNA molecule described herein, or nucleic acid that encodes the gRNA, and one or more of the following:

(b) a Cas9 molecule, e.g., a Cas9 molecule described herein, or a nucleic acid or mRNA that encodes the Cas9;

(c)(i) a second gRNA molecule, e.g., a second gRNA molecule described herein or a nucleic acid that encodes (c)(i);

(c)(ii) a third gRNA molecule, e.g., a second gRNA molecule described herein or a nucleic acid that encodes (c)(ii);

(c)(iii) a fourth gRNA molecule, e.g., a second gRNA molecule described herein or a nucleic acid that encodes (c)(iii);

(d) a template nucleic acid, e.g, a template nucleic acid described herein.

In an embodiment, the kit comprises nucleic acid, e.g., an AAV vector, that encodes one or more of (a), (b), (c)(i), (c)(ii), (c)(iii) and (d).

In another aspect, disclosed herein is non-naturally occurring template nucleic acid described herein.

In yet another aspect, disclosed herein is a gRNA molecule, e.g., a gRNA molecule described herein, for use in treating or preventing POAG in a subject, e.g., in accordance with a method of treating or preventing POAG as described herein.

In an embodiment, the gRNA molecule in used in combination with a Cas9 molecule, e.g., a Cas9 molecule described herein. Additionally or alternatively, in an embodiment, the gRNA molecule is used in combination with a second, third and/or fourth gRNA molecule, e.g., a second, third and/or fourth gRNA molecule described herein.

In still another aspect, disclosed herein is use of a gRNA molecule, e.g., a gRNA molecule described herein, in the manufacture of a medicament for treating or preventing POAG in a subject, e.g., in accordance with a method of treating or preventing POAG as described herein.

In an embodiment, the medicament comprises a Cas9 molecule, e.g., a Cas9 molecule described herein. Additionally or alternatively, in an embodiment, the medicament comprises a second, third and/or fourth gRNA molecule, e.g., a second, third and/or fourth gRNA molecule described herein.

In an embodiment, the kit further comprises a governing gRNA molecule, or a nucleic acid that encodes a governing gRNA molecule.

In an aspect, the disclosure features a gRNA molecule, referred to herein as a governing gRNA molecule, comprising a targeting domain which is complementary to a target domain on a nucleic acid that encodes a component of the CRISPR/Cas system introduced into a cell or subject. In an embodiment, the governing gRNA molecule targets a nucleic acid that encodes a Cas9 molecule or a nucleic acid that encodes a target gene gRNA molecule. In an embodiment, the governing gRNA comprises a targeting domain that is complementary to a target domain in a sequence that encodes a Cas9 component, e.g., a Cas9 molecule or target gene gRNA molecule. In an embodiment, the target domain is designed with, or has, minimal homology to other nucleic acid sequences in the cell, e.g., to minimize off-target cleavage. For example, the targeting domain on the governing gRNA can be selected to reduce or minimize off-target effects. In an embodiment, a target domain for a governing gRNA can be disposed in the control or coding region of a Cas9 molecule or disposed between a control region and a transcribed region. In an embodiment, a target domain for a governing gRNA can be disposed in the control or coding region of a target gene gRNA molecule or disposed between a control region and a transcribed region for a target gene gRNA. While not wishing to be bound by theory, it is believed that altering, e.g., inactivating, a nucleic acid that encodes a Cas9 molecule or a nucleic acid that encodes a target gene gRNA molecule can be effected by cleavage of the targeted nucleic acid sequence or by binding of a Cas9 molecule/governing gRNA molecule complex to the targeted nucleic acid sequence.

The gRNA molecules and methods, as disclosed herein, can be used in combination with a governing gRNA molecule. The compositions and reaction mixtures, as disclosed herein, can also include a governing gRNA molecule, e.g., a governing gRNA molecule disclosed herein.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

BRIEF DESCRIPTION OF THE DRAWING

FIGS. 1A-1I are representations of several exemplary gRNAs.

FIG. 1A depicts a modular gRNA molecule derived in part (or modeled on a sequence in part) from *Streptococcus pyogenes* (*S. pyogenes*) as a duplexed structure (SEQ ID NOS: 42 and 43, respectively, in order of appearance);

FIG. 1B depicts a unimolecular (or chimeric) gRNA molecule derived in part from *S. pyogenes* as a duplexed structure (SEQ ID NO: 44);

FIG. 1C depicts a unimolecular gRNA molecule derived in part from *S. pyogenes* as a duplexed structure (SEQ ID NO: 45);

FIG. 1D depicts a unimolecular gRNA molecule derived in part from *S. pyogenes* as a duplexed structure (SEQ ID NO: 46);

FIG. 1E depicts a unimolecular gRNA molecule derived in part from *S. pyogenes* as a duplexed structure (SEQ ID NO: 47);

FIG. 1F depicts a modular gRNA molecule derived in part from *Streptococcus thermophilus* (*S. thermophilus*) as a duplexed structure (SEQ ID NOS: 48 and 49, respectively, in order of appearance);

FIG. 1G depicts an alignment of modular gRNA molecules of *S. pyogenes* and *S. thermophilus* (SEQ ID NOS: 50-53, respectively, in order of appearance).

FIGS. 1H-1I depicts additional exemplary structures of unimolecular gRNA molecules. FIG. 1H shows an exemplary structure of a unimolecular gRNA molecule derived in part from *S. pyogenes* as a duplexed structure (SEQ ID NO: 45). FIG. 1I shows an exemplary structure of a unimolecular gRNA molecule derived in part from *S. aureus* as a duplexed structure (SEQ ID NO: 40).

FIGS. 2A-2G depict an alignment of Cas9 sequences from Chylinski et al. (RNA Biol. 2013; 10(5): 726-737). The N-terminal RuvC-like domain is boxed and indicated with a "Y". The other two RuvC-like domains are boxed and indicated with a "B". The HNH-like domain is boxed and indicated by a "G". Sm: *S. mutans* (SEQ ID NO: 1); Sp: *S. pyogenes* (SEQ ID NO: 2); St: *S. thermophilus* (SEQ ID NO: 3); Li: *L. innocua* (SEQ ID NO: 4). Motif: this is a motif based on the four sequences: residues conserved in all four sequences are indicated by single letter amino acid abbreviation; "*" indicates any amino acid found in the corresponding position of any of the four sequences; and "–" indicates any amino acid, e.g., any of the 20 naturally occurring amino acids, or absent.

FIGS. 3A-3B show an alignment of the N-terminal RuvC-like domain from the Cas9 molecules disclosed in Chylinski et al (SEQ ID NOS: 54-103, respectively, in order of appearance). The last line of FIG. 3B identifies 4 highly conserved residues.

FIGS. 4A-4B show an alignment of the N-terminal RuvC-like domain from the Cas9 molecules disclosed in Chylinski et al. with sequence outliers removed (SEQ ID NOS: 104-177, respectively, in order of appearance). The last line of FIG. 4B identifies 3 highly conserved residues.

FIGS. 5A-5C show an alignment of the HNH-like domain from the Cas9 molecules disclosed in Chylinski et al (SEQ ID NOS: 178-252, respectively, in order of appearance). The last line of FIG. 5C identifies conserved residues.

FIGS. 6A-6B show an alignment of the HNH-like domain from the Cas9 molecules disclosed in Chylinski et al. with sequence outliers removed (SEQ ID NOS: 253-302, respectively, in order of appearance). The last line of FIG. 6B identifies 3 highly conserved residues.

FIGS. 7A-7B depict an alignment of Cas9 sequences from *S. pyogenes* and *Neisseria meningitidis* (*N. meningitidis*). The N-terminal RuvC-like domain is boxed and indicated with a "Y". The other two RuvC-like domains are boxed and indicated with a "B". The HNH-like domain is boxed and indicated with a "G". Sp: *S. pyogenes*; Nm: *N. meningitidis*. Motif: this is a motif based on the two sequences: residues conserved in both sequences are indicated by a single amino acid designation; "*" indicates any amino acid found in the corresponding position of any of the two sequences; "–" indicates any amino acid, e.g., any of the 20 naturally occurring amino acids, and "–" indicates any amino acid, e.g., any of the 20 naturally occurring amino acids, or absent.

FIG. 8 shows a nucleic acid sequence encoding Cas9 of *N. meningitidis* (SEQ ID NO: 303). Sequence indicated by an "R" is an SV40 NLS; sequence indicated as "G" is an HA tag; and sequence indicated by an "O" is a synthetic NLS sequence; the remaining (unmarked) sequence is the open reading frame (ORF).

FIG. 9A shows the organization of the Cas9 domains, including amino acid positions, in reference to the two lobes of Cas9 (recognition (REC) and nuclease (NUC) lobes). FIG. 9B shows the percent homology of each domain across 83 Cas9 orthologs.

DEFINITIONS

Figure 1A:
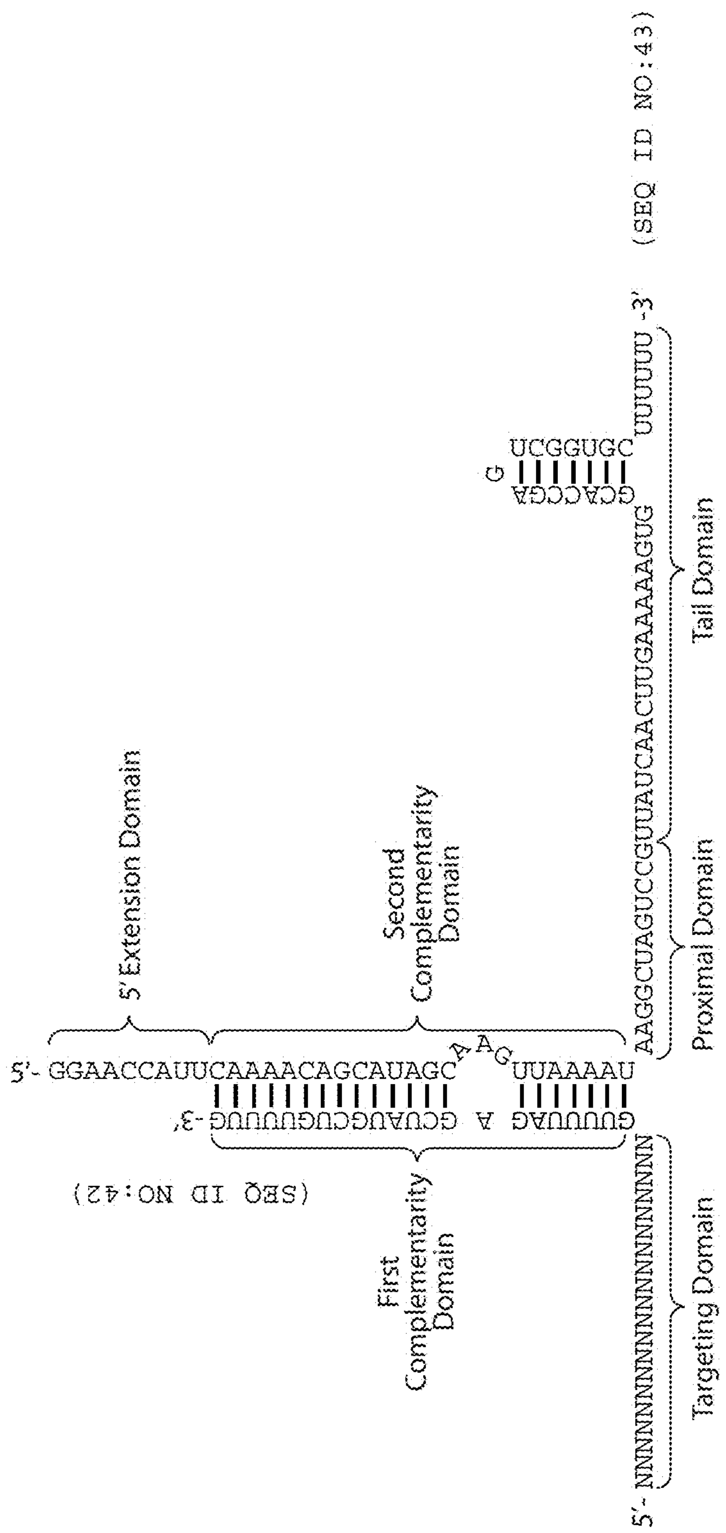

"Domain", as used herein, is used to describe segments of a protein or nucleic acid. Unless otherwise indicated, a domain is not required to have any specific functional property.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Governing gRNA molecule", as used herein, refers to a gRNA molecule that comprises a targeting domain that is complementary to a target domain on a nucleic acid that comprises a sequence that encodes a component of the CRISPR/Cas system that is introduced into a cell or subject. A governing gRNA does not target an endogenous cell or subject sequence. In an embodiment, a governing gRNA molecule comprises a targeting domain that is complementary with a target sequence on: (a) a nucleic acid that encodes a Cas9 molecule; (b) a nucleic acid that encodes a gRNA which comprises a targeting domain that targets the MYOC gene (a target gene gRNA); or on more than one nucleic acid that encodes a CRISPR/Cas component, e.g., both (a) and (b). In an embodiment, a nucleic acid molecule that encodes a CRISPR/Cas component, e.g., that encodes a Cas9 molecule or a target gene gRNA, comprises more than one target domain that is complementary with a governing gRNA targeting domain. While not wishing to be bound by theory, in an embodiment, it is believed that a governing gRNA molecule complexes with a Cas9 molecule and results in Cas9 mediated inactivation of the targeted nucleic acid, e.g., by cleavage or by binding to the nucleic acid, and results in cessation or reduction of the production of a CRISPR/Cas system component. In an embodiment, the Cas9 molecule forms two complexes: a complex comprising a Cas9 molecule with a target gene gRNA, which complex will alter the MYOC gene; and a complex comprising a Cas9 molecule with a governing gRNA molecule, which complex will act to prevent further production of a CRISPR/Cas system component, e.g., a Cas9 molecule or a target gene gRNA molecule. In an embodiment, a governing gRNA molecule/Cas9 molecule complex binds to or promotes cleavage of a control region sequence, e.g., a promoter, operably linked to a sequence that encodes a Cas9 molecule, a sequence that encodes a transcribed region, an exon, or an intron, for the Cas9 molecule. In an embodiment, a governing gRNA molecule/Cas9 molecule complex binds to or promotes cleavage of a control region sequence, e.g., a promoter, operably linked to a gRNA molecule, or a sequence that encodes the gRNA molecule. In an embodiment, the governing gRNA, e.g., a Cas9-targeting governing gRNA molecule, or a target gene gRNA-targeting governing gRNA molecule, limits the effect of the Cas9 molecule/target gene gRNA molecule complex-mediated gene targeting. In an embodiment, a governing gRNA places temporal, level of expression, or other limits, on activity of the Cas9 molecule/target gene gRNA molecule complex. In an embodiment, a governing gRNA reduces off-target or other unwanted activity. In an embodiment, a governing gRNA molecule inhibits, e.g., entirely or substantially entirely inhibits, the production of a component of the Cas9 system and thereby limits, or governs, its activity.

"Modulator", as used herein, refers to an entity, e.g., a drug, that can alter the activity (e.g., enzymatic activity, transcriptional activity, or translational activity), amount, distribution, or structure of a subject molecule or genetic sequence. In an embodiment, modulation comprises cleavage, e.g., breaking of a covalent or non-covalent bond, or the forming of a covalent or non-covalent bond, e.g., the attachment of a moiety, to the subject molecule. In an embodiment, a modulator alters the, three dimensional, secondary, tertiary, or quaternary structure, of a subject molecule. A modulator can increase, decrease, initiate, or eliminate a subject activity.

"Large molecule", as used herein, refers to a molecule having a molecular weight of at least 2, 3, 5, 10, 20, 30, 40, 50, 60, 70, 80, 90, or 100 kD. Large molecules include proteins, polypeptides, nucleic acids, biologics, and carbohydrates.

"Polypeptide", as used herein, refers to a polymer of amino acids having less than 100 amino acid residues. In an embodiment, it has less than 50, 20, or 10 amino acid residues.

"Reference molecule", e.g., a reference Cas9 molecule or reference gRNA, as used herein, refers to a molecule to which a subject molecule, e.g., a subject Cas9 molecule of subject gRNA molecule, e.g., a modified or candidate Cas9 molecule is compared. For example, a Cas9 molecule can be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of *S. pyogenes, S. aureus* or *S. thermophilus*. In an embodiment, the reference Cas9 molecule is the naturally occurring Cas9 molecule having the closest sequence identity or homology with the Cas9 molecule to which it is being compared. In an embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Small molecule", as used herein, refers to a compound having a molecular weight less than about 2 kD, e.g., less than about 2 kD, less than about 1.5 kD, less than about 1 kD, or less than about 0.75 kD.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In an embodiment, the subject is a human. In other embodiments, the subject is poultry.

"Treat", "treating" and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

"Prevent", "preventing" and "prevention", as used herein, means the prevention of a disease in a mammal, e.g., in a human, including (a) avoiding or precluding the disease; (2) affecting the predisposition toward the disease, e.g., preventing at least one symptom of the disease or to delay onset of at least one symptom of the disease.

"X" as used herein in the context of an amino acid sequence, refers to any amino acid (e.g., any of the twenty natural amino acids) unless otherwise specified.

Primary Open Angel Glaucoma (POAG)

Glaucoma is the second leading cause of blindness in the world. Primary Open Angle Glaucoma (POAG) is the leading cause of glaucoma and affects approximately 1% of patients ages 40-89.

POAG develops due to an imbalance between the production and outflow of aqueous humor within the eye. Aqueous humor (AH) is produced by the ciliary body located in the posterior chamber. The vast majority (approximately 80%) of AH drains through the trabecular meshwork (TM) to the episcleral venous system. A minority (approximately 20%) of AH drains through the interstitium between the iris root and ciliary muscle (Feisal 2005). POAG is likely due to decreased drainage through the trabecular meshwork; decreased outflow of AH results in increased intraocular pressure (IOP) and IOP causes damage to the optic nerve and leads to progressive blindness.

The etiology of POAG is multi-factorial and complex. However, mutations in the MYOC gene (also known as GLC1A, JOAG1 and TIGR) have been shown to be a leading genetic cause of POAG and of juvenile-onset POAG. Mutations in MYOC have been shown to account for 3% of POAG. Many patients with MYOC mutations develop rapidly advancing disease and/or earlier presentation of POAG, including juvenile-onset POAG.

The MYOC gene, also called the trabecular meshwork-induced glucocorticoid receptor (TIGR), encodes myocilin, a 504 amino acid protein encoded by 3 exons. Myocilin is found in the trabecular meshwork and plays a role in cytoskeletal function and in the regulation of IOP.

Methods to Treat or Prevent POAG

Methods and compositions described herein provide for a therapy, e.g., a one-time therapy, or a multi-dose therapy, that prevents or treats primary open-angle glaucoma (POAG). In an embodiment, a disclosed therapy prevents, inhibits, or reduces the production of mutant myocilin protein in cells of the anterior and posterior chamber of the eye in a subject who has POAG.

While not wishing to be bound by theory, in an embodiment, it is believed that knocking out MYOC on ciliary body cells, iris cells, trabecular meshwork cells, retinal cells, e.g. e.g., a rod photoreceptor cell, e.g., a cone photoreceptor cell, e.g., a retinal pigment epithelium cell, e.g., a horizontal cell, e.g., an amacrine cell, e.g., a ganglion cell, will prevent the progression of eye disease in subjects with POAG.

While not wishing to be bound by theory, in an embodiment, it is believed that correction of MYOC in ciliary body cells, iris cells, trabecular meshwork cells, retinal cells, e.g. e.g., a rod photoreceptor cell, e.g., a cone photoreceptor cell, e.g., a retinal pigment epithelium cell, e.g., a horizontal cell, e.g., an amacrine cell, e.g., a ganglion cell, will prevent the progression of eye disease in subjects with POAG. Corrected cells will not undergo apoptosis, will not cause inflammation and will produce wild-type, non-aggregating myocilin. In an embodiment, the disease is cured, does not progress or has delayed progression compared to a subject who has not received the therapy.

Myocilin is expressed in the eye, primarily by trabecular meshwork cells and the ciliary body. It is also expressed in the retina. Research indicates that MYOC mutations exert a toxic gain of function effect within trabecular meshwork cells. Mutant myocilin, especially mutants with missense or nonsense mutations in exon 3, e.g., a mutation at T377 (e.g., T377R), a mutation at I477 (e.g., I477N), or a mutation at P370 (e.g., P370L), may misfold and aggregate in the endoplasmic reticulum (ER). Misfolding and aggregation within the ER elicits the ER stress and unfold protein response, which can lead to apoptosis and inflammation within trabecular meshwork cells. In addition, mutant myocilin protein may aggregate in the trabecular meshwork with other mutant proteins and/or with wild-type myocilin (in heterozygotes). Mutant myocilin aggregates may interfere with the outflow of aqueous humor to the episcleral venous system. Decreased aqueous humor outflow causes increased intraocular pressure, leading to POAG.

The elimination of mutant myocilin production in subjects with a mutation, e.g., a mutation at T377 (e.g., T377R), a mutation at I477 (e.g., I477N), or a mutation at P370 (e.g., P370L) mutations or other mutant MYOC alleles through knock out of MYOC on ciliary body cells, iris cells, trabecular meshwork cells and retinal cells will prevent the production of the myocilin proteins. Corrected cells will not undergo apoptosis and will not increase inflammation. In an embodiment, POAG does not progress or has delayed progression compared to a subject who has not received the therapy.

Described herein are methods for treating or delaying the onset or progression of POAG caused by mutations in the MYOC gene, including but not limited to mutations in exon 3, e.g., a mutation at T377 (e.g., T377R), a mutation at I477 (e.g., I477N), or a mutation at P370 (e.g., P370L). The disclosed methods for treating or delaying the onset or progression of POAG alter the MYOC gene by genome editing using a gRNA targeting the POAG target position and a Cas9 enzyme. Details on gRNAs targeting the POAG target position and Cas9 enzymes are provided below.

Current treatments to prevent the progression of POAG include treatments that reduce IOP. For example, trabeculectomy surgery and eye drops, including alpha-adrenergic antagonists and beta-adrenergic antagonists, are both effective in preventing POAG progression. However, further treatments are needed to reduce IOP and prevent progression of POAG. Disclosed herein are methods that correct the underlying mutations that lead to POAG. Also disclosed herein are methods that knockdown or knockout a MYOC gene. Targeted knockdown or knockout of the MYOC gene includes targeting one or both alleles of the MYOC gene. The disclosed methods may be useful to permanently decrease IOP and prevent the progressive visual loss of POAG. Further, the disclosed methods are more convenient than taking daily eye drops or having surgery.

Disclosed herein are multiple approaches to altering or modifying, i.e., correcting, the MYOC gene, using the CRIPSR/Cas system to treat POAG.

In an embodiment, one approach is to repair (i.e., correct) one or more mutations in the MYOC gene by HDR. In an embodiment, mutant MYOC allele(s) are corrected and restored to wild type state, which preserves myocilin function, restores homeostasis within the TM and preserves IOP, which reverses or prevents progression of POAG.

In another embodiment, the MYOC gene is targeted as a targeted knockout or knockdown. A knockout or knockdown of the MYOC gene may offer a benefit to subjects with POAG who have a mutation in the MYOC gene as well as subjects with POAG without a known MYOC mutation. There is evidence that MYOC mutations are gain of function mutations leading to altered TM function and the development of IOP. There is further evidence that patients with heterozygous early truncating mutations (Arg46stop) do not develop disease. MYOC knock-out mice do not develop POAG and have no detected eye abnormalities. Further, a few patients have been identified who express no myocilin in the eye and have no phenotype. Without wishing to be bound by theory, it is contemplated herein that a knock out or knock down of MYOC gene in the eye prevents the development of POAG.

There is also evidence to support a dominant negative effect of certain heterozygous mutations on the wild-type allele (Kuchtey J et al., 2013 Eur J Med Genet. b56(6):292-6. doi: 10.1016/j.ejmg.2013.03.002. Epub 2013 Mar. 19). Without wishing to be bound by theory, it is contemplated herein that a knockout of both alleles reverses the dominant negative effect and is beneficial for patients.

Correction of a mutation in the MYOC gene or knockdown or knockout of one or both MYOC alleles may be performed prior to disease onset or after disease onset, but preferably early in the disease course.

In an embodiment, treatment is initiated prior to onset of the disease.

In an embodiment, treatment is initiated after onset of the disease, but early in the course of disease progression (e.g., prior to vision loss, a decrease in visual acuity and/or an increase in IOP).

In an embodiment, treatment is initiated after onset of the disease, but prior to a measurable increase in IOP.

In an embodiment, treatment is initiated prior to loss of visual acuity.

In an embodiment, treatment is initiated at onset of loss of visual acuity.

In an embodiment, treatment is initiated after onset of loss of visual acuity.

In an embodiment, treatment is initiated in a subject who has tested positive for a mutation in the MYOC gene, e.g., prior to disease onset or in the earliest stages of disease.

In an embodiment, a subject has a family member that has been diagnosed with POAG. For example, the subject has a family member that has been diagnosed with POAG, and the subject demonstrates a symptom or sign of the disease or has been found to have a mutation in the MYOC gene.

In an embodiment, treatment is initiated in a subject who has no MYOC mutation but has increased intraocular pressure.

In an embodiment, treatment is initiated in a subject at onset of an increase in intraocular pressure.

In an embodiment, treatment is initiated in a subject after onset of an increase in intraocular pressure.

In an embodiment, treatment is initiated in a subject with signs consistent with POAG on ophthalmologic exam, including but not limited to: increased intraocular pressure; cupping of the optic nerve on slit lamp exam, stereobiomicroscopy or ophthalmoscopy; pallor of the optic disk; thinning or notching of the optic disk rim; hemorrhages of the optic disc; vertical cup-to-disk ratio of >0.6 or cup-to-disk asymmetry between eyes of greater than 0.2; peripapillary atrophy.

A subject's vision can evaluated, e.g., prior to treatment, or after treatment, e.g., to monitor the progress of the treatment. In an embodiment, the subject's vision is evaluated prior to treatment, e.g., to determine the need for treatment. In an embodiment, the subject's vision is evaluated after treatment has been initiated, e.g., to access the effectiveness of the treatment. Vision can be evaluated by one or more of: evaluation of increased IOP; evaluating changes in function relative to the contralateral eye, e.g., by utilizing retinal analytical techniques; by evaluating mean, median and distribution of change in best corrected visual acuity (BCVA); evaluation by Optical Coherence Tomography; evaluation of changes in visual field using perimetry; evaluation by full-field electroretinography (ERG); evaluation by slit lamp examination; evaluation of intraocular pressure; evaluation of autofluorescence, evaluation with fundoscopy; evaluation with fundus photography; evaluation with fluorescein angiography (FA); or evaluation of visual field sensitivity (FFST).

In other embodiments, a subject's vision may be assessed by measuring the subject's mobility, e.g., the subject's ability to maneuver in space.

Methods of Altering MYOC

As disclosed herein, a POAG target position, e.g., MYOC gene, can be altered by gene editing, e.g., using CRISPR-Cas9 mediated methods as described herein.

An alteration of the MYOC gene can be mediated by any mechanism. Exemplary mechanisms that can be associated with an alteration of the MYOC gene include, but are not limited to, non-homologous end joining (e.g., classical or alternative), microhomology-mediated end joining (MMEJ), homology-directed repair (e.g., endogenous donor template mediated), SDSA (synthesis dependent strand annealing), single strand annealing or single strand invasion.

In an embodiment, altering the POAG target position is achieved, e.g., by:

(1) correcting a POAG target position (e.g., a point mutation) in the MYOC gene (e.g., HDR-mediated correction with a donor template that corrects the mutation, e.g., the point mutation);
(2) knocking out the MYOC gene:
  (a) insertion or deletion (e.g., NHEJ-mediated insertion or deletion) of one or more nucleotides in close proximity to or within an early coding region of the MYOC gene, or
  (b) deletion (e.g., NHEJ-mediated deletion) of genomic sequence including a POAG knockout target position of the MYOC gene, or
(3) knocking down the MYOC gene mediated by enzymatically inactive Cas9 (eiCas9) molecule or an eiCas9-fusion protein by targeting the promoter region of the gene.

All approaches give rise to alteration of the MYOC gene. In one embodiment, methods described herein introduce one or more breaks near a POAG target position in at least one allele of the MYOC gene. In another embodiment, methods described herein introduce two or more breaks to flank a POAG target position, e.g., POAG knockout target position or a point mutation in the MYOC gene. The two or more breaks remove (e.g., delete) genomic sequence including the POAG target position, e.g., POAG knockout target position or point mutation in the MYOC gene. In another embodiment, methods described herein comprises knocking down the MYOC gene mediated by enzymatically inactive Cas9 (eiCas9) molecule or an eiCas9-fusion protein by targeting the promoter region of a POAG knockdown target position. All methods described herein result in alteration of the MYOC gene.

HDR-Mediated Repair of MYOC

The methods and compositions described herein introduce one or more breaks near a POAG target position, e.g., Q368 (e.g., Q368stop), P370 (e.g., P370L), T377 (e.g., T377R), I477 (e.g., I477N or I477S) or the 477-502 mutation hotspot region in the MYOC gene. In an embodiment, a mutation (e.g., Q368 (e.g., Q368stop), P370 (e.g., P370L), T377 (e.g., T377R), I477 (e.g., I477N or I477S) or the 477-502 mutation hotspot region the substitution T377R), or I477 (e.g., the substitution I477N or I477S) is targeted by cleaving with either one or more nucleases, one or more nickases or any combination thereof to induce HDR with a donor template that corrects the point mutation (e.g., the single nucleotide, e.g., Q368 (e.g., Q368stop), P370 (e.g., P370L), T377 (e.g., T377R), I477 (e.g., I477N or I477S) or the 477-502 mutation hotspot region. The method can include acquiring knowledge of the mutation carried by the subject, e.g., by sequencing the appropriate portion of the MYOC gene.

In an embodiment, guide RNAs were designed to target a mutation (e.g., Q368 (e.g., Q368stop), P370 (e.g., P370L), T377 (e.g., T377R), I477 (e.g., I477N or I477S) or the 477-502 mutation hotspot region) in the MYOC gene. A single gRNA with a Cas9 nuclease or a Cas9 nickase could be used to generate a break (e.g., a single strand break or a double strand break) in close proximity to a mutation (e.g., Q368 (e.g., Q368stop), P370 (e.g., P370L), T377 (e.g., T377R), I477 (e.g., I477N or I477S) or the 477-502 mutation hotspot region). While not bound by theory, in an embodiment, it is believed that HDR-mediated repair (e.g., with a donor template) of the break (e.g., a single strand break or a double strand break) allow for the correction of the mutation (e.g., Q368 (e.g., Q368stop), P370 (e.g., P370L), T377 (e.g., T377R), I477 (e.g., I477N or I477S) or the 477-502 mutation hotspot region), which results in restoration of a functional MYOC protein.

In another embodiment, two gRNAs with two Cas9 nickases could be used to generate two single strand breaks in close proximity to a mutation (e.g., Q368 (e.g., Q368stop), P370 (e.g., P370L), T377 (e.g., T377R), I477 (e.g., I477N or I477S) or the 477-502 mutation hotspot region). While not bound by theory, in an embodiment, it is believed that HDR-mediated repair (e.g., with a donor template) of the breaks (e.g., the two single strand breaks) allow for the correction of the mutation (e.g., Q368 (e.g., Q368stop), P370 (e.g., P370L), T377 (e.g., T377R), I477 (e.g., I477N or I477S) or the 477-502 mutation hotspot region), which results in restoration of a functional MYOC protein.

In another embodiment, more than two gRNAs may be used in a dual-targeting approach to generate two sets of breaks (e.g., two double strand breaks, one double strand break and a pair of single strand breaks or two pairs of single strand breaks) in close proximity to a mutation (e.g., Q368 (e.g., Q368stop), P370 (e.g., P370L), T377 (e.g., T377R), I477 (e.g., I477N or I477S) or the 477-502 mutation hotspot region) or delete a genomic sequence containing a mutation (e.g., Q368 (e.g., Q368stop), P370 (e.g., P370L), T377 (e.g., T377R), I477 (e.g., I477N or I477S) or the 477-502 mutation hotspot region) in the MYOC gene. While not bound by theory, in an embodiment, it is believed that HDR-mediated repair (e.g., with a donor template) of the breaks (e.g., two double strand breaks, one double strand break and a pair of single strand breaks or two pairs of single strand breaks) allow for the correction of the mutation (e.g., Q368 (e.g., Q368stop), P370 (e.g., P370L), T377 (e.g., T377R), I477 (e.g., I477N or I477S) or the 477-502 mutation hotspot region), which results in restoration of a functional MYOC protein.

In an embodiment, a single strand break is introduced (e.g., positioned by one gRNA molecule) at or in close proximity to a POAG target position in the MYOC gene. In an embodiment, a single gRNA molecule (e.g., with a Cas9 nickase) is used to create a single strand break at or in close proximity to the POAG target position, e.g., the gRNA is configured such that the single strand break is positioned either upstream (e.g., within 200 bp upstream) or downstream (e.g., within 200 bp downstream) of the POAG target position. In an embodiment, the break is positioned to avoid unwanted target chromosome elements, such as repeat elements, e.g., an Alu repeat.

In an embodiment, a double strand break is introduced (e.g., positioned by one gRNA molecule) at or in close proximity to a POAG target position in the MYOC gene. In an embodiment, a single gRNA molecule (e.g., with a Cas9 nuclease other than a Cas9 nickase) is used to create a double strand break at or in close proximity to the POAG target position, e.g., the gRNA molecule is configured such that the double strand break is positioned either upstream (e.g., within 200 bp upstream) or downstream of (e.g., within 200 bp downstream) of a POAG target position. In an embodiment, the break is positioned to avoid unwanted target chromosome elements, such as repeat elements, e.g., an Alu repeat.

In an embodiment, two single strand breaks are introduced (e.g., positioned by two gRNA molecules) at or in close proximity to a POAG target position in the MYOC gene. In an embodiment, two gRNA molecules (e.g., with one or two Cas9 nickases) are used to create two single strand breaks at or in close proximity to the POAG target position, e.g., the gRNAs molecules are configured such that both of the single strand breaks are positioned upstream (e.g., within 200 bp upstream) or downstream (e.g., within 200 bp downstream) of the POAG target position. In another embodiment, two gRNA molecules (e.g., with two Cas9 nickases) are used to create two single strand breaks at or in close proximity to the POAG target position, e.g., the gRNAs molecules are configured such that one single strand break is positioned upstream (e.g., within 200 bp upstream) and a second single strand break is positioned downstream (e.g., within 200 bp downstream) of the POAG target position. In an embodiment, the breaks are positioned to avoid unwanted target chromosome elements, such as repeat elements, e.g., an Alu repeat.

In an embodiment, two double strand breaks are introduced (e.g., positioned by two gRNA molecules) at or in close proximity to a POAG target position in the MYOC gene. In an embodiment, two gRNA molecules (e.g., with one or two Cas9 nucleases that are not Cas9 nickases) are used to create two double strand breaks to flank a POAG target position, e.g., the gRNA molecules are configured such that one double strand break is positioned upstream (e.g., within 200 bp upstream) and a second double strand break is positioned downstream (e.g., within 200 bp downstream) of the POAG target position. In an embodiment, the breaks are positioned to avoid unwanted target chromosome elements, such as repeat elements, e.g., an Alu repeat.

In an embodiment, one double strand break and two single strand breaks are introduced (e.g., positioned by three gRNA molecules) at or in close proximity to a POAG target position in the MYOC gene. In an embodiment, three gRNA molecules (e.g., with a Cas9 nuclease other than a Cas9 nickase and one or two Cas9 nickases) to create one double strand break and two single strand breaks to flank a POAG target position, e.g., the gRNA molecules are configured such that the double strand break is positioned upstream or downstream of (e.g., within 200 bp upstream or downstream) of the POAG target position, and the two single strand breaks are positioned at the opposite site, e.g., downstream or upstream (within 200 bp downstream or upstream), of the POAG target position. In an embodiment, the breaks are positioned to avoid unwanted target chromosome elements, such as repeat elements, e.g., an Alu repeat.

In an embodiment, four single strand breaks are introduced (e.g., positioned by four gRNA molecules) at or in close proximity to a POAG target position in the MYOC gene. In an embodiment, four gRNA molecule (e.g., with one or more Cas9 nickases are used to create four single strand breaks to flank a POAG target position in the MYOC gene, e.g., the gRNA molecules are configured such that a first and second single strand breaks are positioned upstream (e.g., within 200 bp upstream) of the POAG target position, and a third and a fourth single stranded breaks are positioned downstream (e.g., within 200 bp downstream) of the POAG target position. In an embodiment, the breaks are positioned to avoid unwanted target chromosome elements, such as repeat elements, e.g., an Alu repeat.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

NHEJ-Mediated Introduction of an Indel in Close Proximity to or within the Early Coding Region of the POAG Target Knockout Position In an embodiment, the method comprises introducing a NHEJ-mediated insertion or deletion of one more nucleotides in close proximity to the POAG target knockout position (e.g., the early coding region) of the MYOC gene. As described herein, in one embodiment, the method comprises the introduction of one or more breaks (e.g., single strand breaks or double strand breaks) sufficiently close to (e.g., either 5' or 3' to) the early coding region of the POAG knockout target position, such that the break-induced indel could be reasonably expected to span the POAG target knockout position (e.g., the early coding region). While not wishing to be bound by theory, it is believed that NHEJ-mediated repair of the break(s) allows for the NHEJ-mediated introduction of an indel in close proximity to within the early coding region of the POAG target knockout position.

In an embodiment, the targeting domain of the gRNA molecule is configured to provide a cleavage event, e.g., a double strand break or a single strand break, sufficiently close to the early coding region in the MYOC gene to allow alteration, e.g., alteration associated with NHEJ in the MYOC gene. In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of a POAG target knockout position. The break, e.g., a double strand or single strand break, can be positioned upstream or downstream of a POAG target knockout position in the MYOC gene.

In an embodiment, a second gRNA molecule comprising a second targeting domain is configured to provide a cleavage event, e.g., a double strand break or a single strand break, sufficiently close to the early coding region in the MYOC gene, to allow alteration, e.g., alteration associated with NHEJ in the MYOC gene, either alone or in combination with the break positioned by said first gRNA molecule. In an embodiment, the targeting domains of the first and second gRNA molecules are configured such that a cleavage event, e.g., a double strand or single strand break, is positioned, independently for each of the gRNA molecules, within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position. In an embodiment, the breaks, e.g., double strand or single strand breaks, are positioned on both sides of a nucleotide of a POAG target knockout position in the MYOC gene. In an embodiment, the breaks, e.g., double strand or single strand breaks, are positioned on one side, e.g., upstream or downstream, of a nucleotide of a POAG target knockout position in the MYOC gene.

In an embodiment, a single strand break is accompanied by an additional single strand break, positioned by a second gRNA molecule, as discussed below. For example, the targeting domains are configured such that a cleavage event, e.g., the two single strand breaks, are positioned within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the early coding region in the MYOC gene. In an embodiment, the first and second gRNA molecules are configured such, that when guiding a Cas9 nickase, a single strand break will be accompanied by an additional single strand break, positioned by a second gRNA, sufficiently close to one another to result in alteration of the early coding region in the MYOC gene. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 molecule is a nickase. In an embodiment, the two gRNA molecules are configured to position cuts at the same position, or within a few nucleotides of one another, on different strands, e.g., essentially mimicking a double strand break.

In an embodiment, a double strand break can be accompanied by an additional double strand break, positioned by a second gRNA molecule, as is discussed below. For example, the targeting domain of a first gRNA molecule is configured such that a double strand break is positioned upstream of the early coding region in the MYOC gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position; and the targeting domain of a second gRNA molecule is configured such that a double strand break is positioned downstream of the early coding region in the MYOC gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position.

In an embodiment, a double strand break can be accompanied by two additional single strand breaks, positioned by a second gRNA molecule and a third gRNA molecule. For example, the targeting domain of a first gRNA molecule is configured such that a double strand break is positioned upstream of the early coding region in the MYOC gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position; and the targeting domains of a second and third gRNA molecule are configured such that two single strand breaks are positioned downstream of the early coding region in the MYOC gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the target position. In an embodiment, the targeting domain of the first, second and third gRNA molecules are configured such that a cleavage event, e.g., a double strand or single strand break, is positioned, independently for each of the gRNA molecules.

In an embodiment, a first and second single strand breaks can be accompanied by two additional single strand breaks positioned by a third gRNA molecule and a fourth gRNA molecule. For example, the targeting domain of a first and second gRNA molecule are configured such that two single strand breaks are positioned upstream of the early coding region in the MYOC gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the early coding region in the MYOC gene; and the targeting domains of a third and fourth gRNA molecule are configured such that two single strand breaks are positioned downstream of the early coding region in the MYOC gene, e.g., within 1, 2, 3, 4, 5, 10, 15, 20, 25, 30, 35, 40, 45, 50, 60, 70, 80, 90, 100, 150, 200, 250, 300, 350, 400, 450 or 500 nucleotides of the early coding region in the MYOC gene.

In an embodiment, a single strand break is introduced (e.g., positioned by one gRNA molecule) at or in close proximity to a POAG target position in the MYOC gene. In an embodiment, a single gRNA molecule (e.g., with a Cas9 nickase) is used to create a single strand break at or in close proximity to the POAG target position, e.g., the gRNA is configured such that the single strand break is positioned either upstream (e.g., within 500 bp upstream) or downstream (e.g., within 500 bp downstream) of the POAG target position. In an embodiment, the break is positioned to avoid unwanted target chromosome elements, such as repeat elements, e.g., an Alu repeat.

In an embodiment, a double strand break is introduced (e.g., positioned by one gRNA molecule) at or in close proximity to a POAG target position in the MYOC gene. In an embodiment, a single gRNA molecule (e.g., with a Cas9 nuclease other than a Cas9 nickase) is used to create a double strand break at or in close proximity to the POAG target position, e.g., the gRNA molecule is configured such that the double strand break is positioned either upstream (e.g., within 500 bp upstream) or downstream of (e.g., within 500 bp downstream) of a POAG target position. In an embodiment, the break is positioned to avoid unwanted target chromosome elements, such as repeat elements, e.g., an Alu repeat.

In an embodiment, two single strand breaks are introduced (e.g., positioned by two gRNA molecules) at or in close proximity to a POAG target position in the MYOC gene. In an embodiment, two gRNA molecules (e.g., with one or two Cas9 nickases) are used to create two single strand breaks at or in close proximity to the POAG target position, e.g., the gRNAs molecules are configured such that both of the single strand breaks are positioned upstream (e.g., within 500 bp upstream) or downstream (e.g., within 500 bp downstream) of the POAG target position. In another embodiment, two gRNA molecules (e.g., with two Cas9 nickases) are used to create two single strand breaks at or in close proximity to the POAG target position, e.g., the gRNAs molecules are configured such that one single strand break is positioned upstream (e.g., within 500 bp upstream) and a second single strand break is positioned downstream (e.g., within 500 bp downstream) of the POAG target position. In an embodiment, the breaks are positioned to avoid unwanted target chromosome elements, such as repeat elements, e.g., an Alu repeat.

In an embodiment, two double strand breaks are introduced (e.g., positioned by two gRNA molecules) at or in close proximity to a POAG target position in the MYOC gene. In an embodiment, two gRNA molecules (e.g., with one or two Cas9 nucleases that are not Cas9 nickases) are used to create two double strand breaks to flank a POAG target position, e.g., the gRNA molecules are configured such that one double strand break is positioned upstream (e.g., within 500 bp upstream) and a second double strand break is positioned downstream (e.g., within 500 bp downstream) of the POAG target position. In an embodiment, the breaks are positioned to avoid unwanted target chromosome elements, such as repeat elements, e.g., an Alu repeat.

In an embodiment, one double strand break and two single strand breaks are introduced (e.g., positioned by three gRNA molecules) at or in close proximity to a POAG target position in the MYOC gene. In an embodiment, three gRNA molecules (e.g., with a Cas9 nuclease other than a Cas9 nickase and one or two Cas9 nickases) to create one double strand break and two single strand breaks to flank a POAG target position, e.g., the gRNA molecules are configured such that the double strand break is positioned upstream or downstream of (e.g., within 500 bp upstream or downstream) of the POAG target position, and the two single strand breaks are positioned at the opposite site, e.g., downstream or upstream (within 500 bp downstream or upstream), of the POAG target position. In an embodiment, the breaks are positioned to avoid unwanted target chromosome elements, such as repeat elements, e.g., an Alu repeat.

Knocking Down the MYOC Gene Mediated by an Enzymatically Inactive Cas9 (eiCas9) Molecule or an eiCas9-Fusion Protein by Targeting the Promoter Region of the Gene.

A targeted knockdown approach reduces or eliminates expression of functional MYOC gene product. As described herein, in an embodiment, a targeted knockdown is mediated by targeting an enzymatically inactive Cas9 (eiCas9) molecule or an eiCas9 fused to a transcription repressor domain or chromatin modifying protein to alter transcription, e.g., to block, reduce, or decrease transcription, of the MYOC gene.

Methods and compositions discussed herein may be used to alter the expression of the MYOC gene to treat or prevent POAG by targeting a promoter region of the MYOC gene. In an embodiment, the promoter region, e.g., at least 2 kb, at least 1.5 kb, at least 1.0 kb, or at least 0.5 kb upstream or downstream of the transcription start site (TSS) is targeted to knockdown expression of the MYOC gene. In an embodiment, the methods and compositions discussed herein may be used to knock down the MYOC gene to treat or prevent BT by targeting 0.5 kb upstream or downstream of the TSS. A targeted knockdown approach reduces or eliminates expression of functional MYOC gene product. As described herein, in an embodiment, a targeted knockdown is mediated by targeting an enzymatically inactive Cas9 (eiCas9) or an eiCas9 fused to a transcription repressor domain or chromatin modifying protein to alter transcription, e.g., to block, reduce, or decrease transcription, of the MYOC gene. In an embodiment, one or more eiCas9 molecules may be used to block binding of one or more endogenous transcription factors. In another embodiment, an eiCas9 molecule can be fused to a chromatin modifying protein. Altering chromatin status can result in decreased expression of the target gene. One or more eiCas9 molecules fused to one or more chromatin modifying proteins may be used to alter chromatin status While some of the disclosure herein is presented in the context of the mutation in the MYOC gene that gives rise to an T377 mutant protein (e.g., T377R mutant protein) or a 1477 mutant protein (e.g., I477N mutant protein, e.g., I477S mutant protein) or a P370 mutant protein (e.g., P370L mutant protein), the methods and compositions herein are broadly applicable to any mutation, e.g., a point mutation or a nonsense mutation or a deletion mutation, in the MYOC gene that gives rise to POAG.

I. gRNA Molecules

A gRNA molecule, as that term is used herein, refers to a nucleic acid that promotes the specific targeting or homing of a gRNA molecule/Cas9 molecule complex to a target nucleic acid. gRNA molecules can be unimolecular (having a single RNA molecule), sometimes referred to herein as "chimeric" gRNAs, or modular (comprising more than one, and typically two, separate RNA molecules). A gRNA molecule comprises a number of domains. The gRNA molecule domains are described in more detail below.

Several exemplary gRNA structures, with domains indicated thereon, are provided in FIGS. 1A-1G. While not wishing to be bound by theory, in an embodiment, with regard to the three dimensional form, or intra- or inter-strand interactions of an active form of a gRNA, regions of high complementarity are sometimes shown as duplexes in FIGS. 1A-1G and other depictions provided herein.

In an embodiment, a unimolecular, or chimeric, gRNA comprises, preferably from 5' to 3':

- a targeting domain (which is complementary to a target nucleic acid in the MYOC gene, e.g., a targeting domain from any of 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B);
- a first complementarity domain;
- a linking domain;
- a second complementarity domain (which is complementary to the first complementarity domain);
- a proximal domain; and
- optionally, a tail domain.

In an embodiment, a modular gRNA comprises:

- a first strand comprising, preferably from 5' to 3';
  - a targeting domain (which is complementary to a target nucleic acid in the MYOC gene, e.g., a targeting domain from 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B); and
  - a first complementarity domain; and
- a second strand, comprising, preferably from 5' to 3':
  - optionally, a 5' extension domain;
  - a second complementarity domain;
  - a proximal domain; and
  - optionally, a tail domain.

The domains are discussed briefly below.

The Targeting Domain

FIGS. 1A-1G provide examples of the placement of targeting domains.

The targeting domain comprises a nucleotide sequence that is complementary, e.g., at least 80, 85, 90, or 95% complementary, e.g., fully complementary, to the target sequence on the target nucleic acid. The targeting domain is part of an RNA molecule and will therefore comprise the base uracil (U), while any DNA encoding the gRNA molecule will comprise the base thymine (T). While not wishing to be bound by theory, in an embodiment, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence. In an embodiment, the target domain itself comprises in the 5' to 3' direction, an optional secondary domain, and a core domain. In an embodiment, the core domain is fully complementary with the target sequence. In an embodiment, the targeting domain is 5 to 50 nucleotides in length. The strand of the target nucleic acid with which the targeting domain is complementary is referred to herein as the complementary strand. Some or all of the nucleotides of the domain can have a modification, e.g., a modification found in Section VIII herein.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

Targeting domains are discussed in more detail below.

The First Complementarity Domain

FIGS. 1A-1G provide examples of first complementarity domains.

The first complementarity domain is complementary with the second complementarity domain, and in an embodiment, has sufficient complementarity to the second complementarity domain to form a duplexed region under at least some physiological conditions. In an embodiment, the first complementarity domain is 5 to 30 nucleotides in length. In an embodiment, the first complementarity domain is 5 to 25 nucleotides in length. In an embodiment, the first complementary domain is 7 to 25 nucleotides in length. In an embodiment, the first complementary domain is 7 to 22 nucleotides in length. In an embodiment, the first complementary domain is 7 to 18 nucleotides in length. In an embodiment, the first complementary domain is 7 to 15 nucleotides in length. In an embodiment, the first complementary domain is 5, 6, 7, 8, 9, 10, 11, 12, 13, 14, 15, 16, 17, 18, 19, 20, 21, 22, 23, 24, or 25 nucleotides in length.

In an embodiment, the first complementarity domain comprises 3 subdomains, which, in the 5' to 3' direction are: a 5' subdomain, a central subdomain, and a 3' subdomain. In an embodiment, the 5' subdomain is 4 to 9, e.g., 4, 5, 6, 7, 8 or 9 nucleotides in length. In an embodiment, the central subdomain is 1, 2, or 3, e.g., 1, nucleotide in length. In an embodiment, the 3' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length.

The first complementarity domain can share homology with, or be derived from, a naturally occurring first complementarity domain. In an embodiment, it has at least 50% homology with a first complementarity domain disclosed herein, e.g., an *S. pyogenes, S. aureus* or *S. thermophilus*, first complementarity domain.

Some or all of the nucleotides of the domain can have a modification, e.g., a modification found in Section VIII herein.

First complementarity domains are discussed in more detail below.

The Linking Domain

FIGS. 1A-1G provide examples of linking domains.

A linking domain serves to link the first complementarity domain with the second complementarity domain of a unimolecular gRNA. The linking domain can link the first and second complementarity domains covalently or non-covalently. In an embodiment, the linkage is covalent. In an embodiment, the linking domain covalently couples the first and second complementarity domains, see, e.g., FIGS. 1B-1E. In an embodiment, the linking domain is, or comprises, a covalent bond interposed between the first complementarity domain and the second complementarity domain. Typically the linking domain comprises one or more, e.g., 2, 3, 4, 5, 6, 7, 8, 9, or 10 nucleotides.

In modular gRNA molecules the two molecules are associated by virtue of the hybridization of the complementarity domains see e.g., FIG. 1A.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In an embodiment, a linking domain is 2, 3, 4, 5, 6, 7, 8, 9, 10, 15, 20, or 25 or more nucleotides in length. In an embodiment, a linking domain is 2 to 50, 2 to 40, 2 to 30, 2 to 20, 2 to 10, or 2 to 5 nucleotides in length. In an embodiment, a linking domain shares homology with, or is derived from, a naturally occurring sequence, e.g., the sequence of a tracrRNA that is 5' to the second complementarity domain. In an embodiment, the linking domain has at least 50% homology with a linking domain disclosed herein.

Some or all of the nucleotides of the domain can have a modification, e.g., modification found in Section VIII herein.

Linking domains are discussed in more detail below.

The 5' Extension Domain

In an embodiment, a modular gRNA can comprise additional sequence, 5' to the second complementarity domain, referred to herein as the 5' extension domain, see, e.g., FIG. 1A. In an embodiment, the 5' extension domain is, 2 to 10, 2 to 9, 2 to 8, 2 to 7, 2 to 6, 2 to 5, 2 to 4 nucleotides in length. In an embodiment, the 5' extension domain is 2, 3, 4, 5, 6, 7, 8, 9, or 10 or more nucleotides in length.

The Second Complementarity Domain

FIGS. 1A-1G provide examples of second complementarity domains.

Figure 1B:
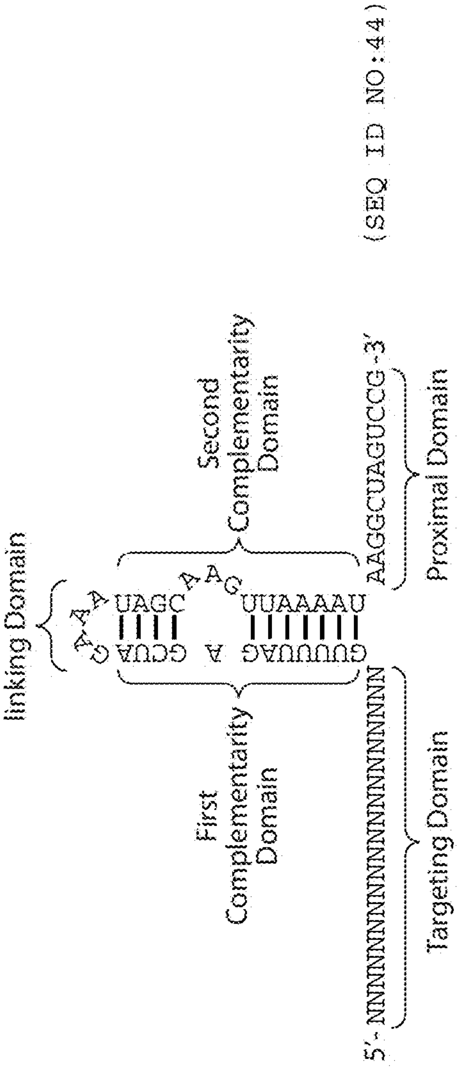
Figure 1C:
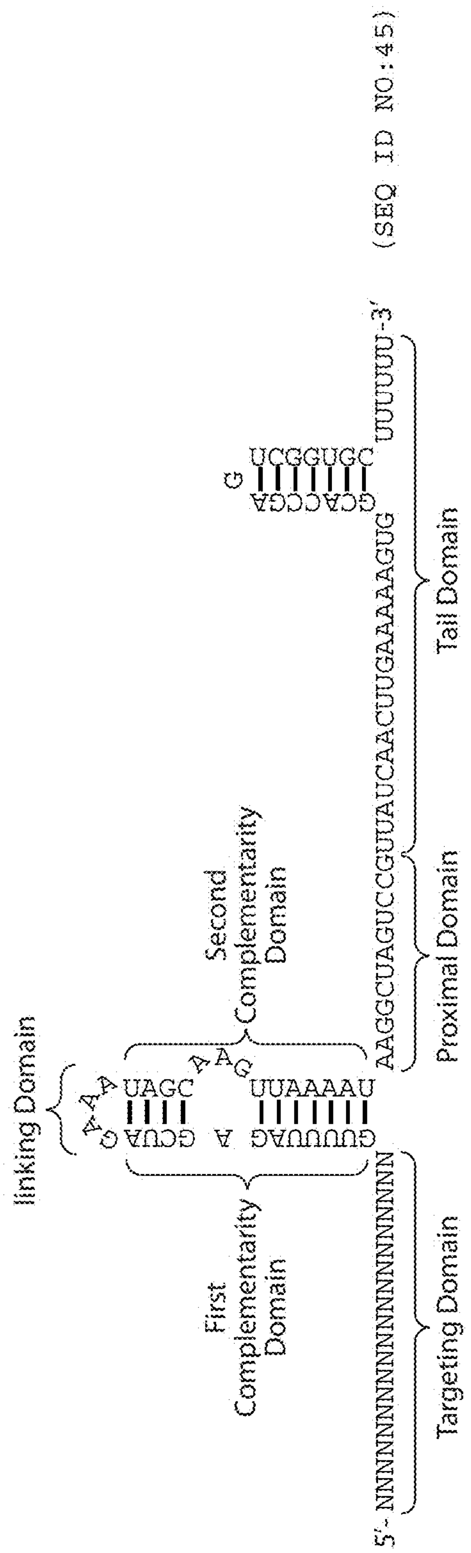
Figure 1D:
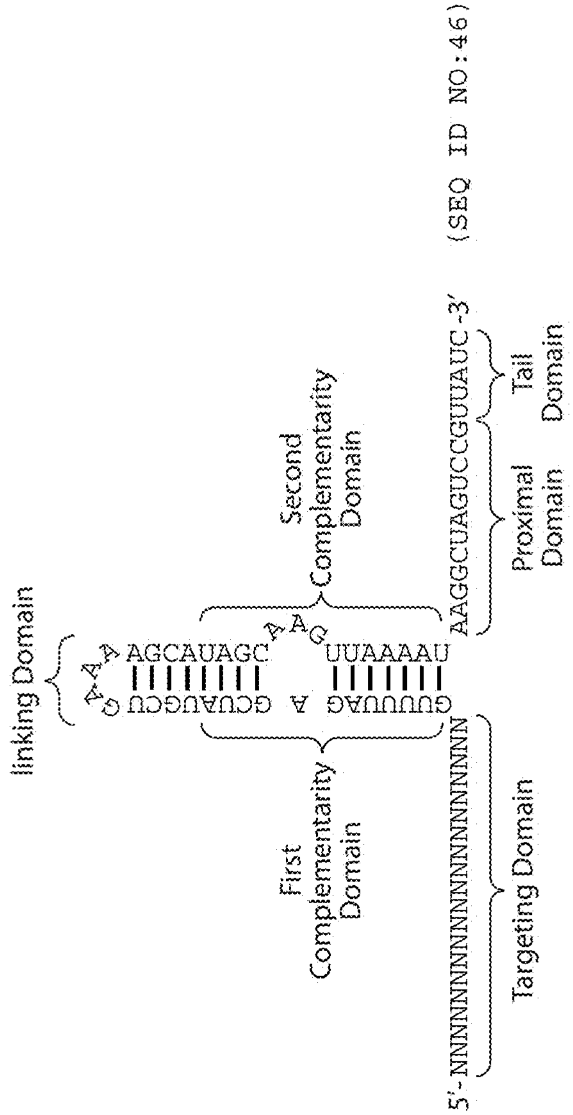
Figure 1E:
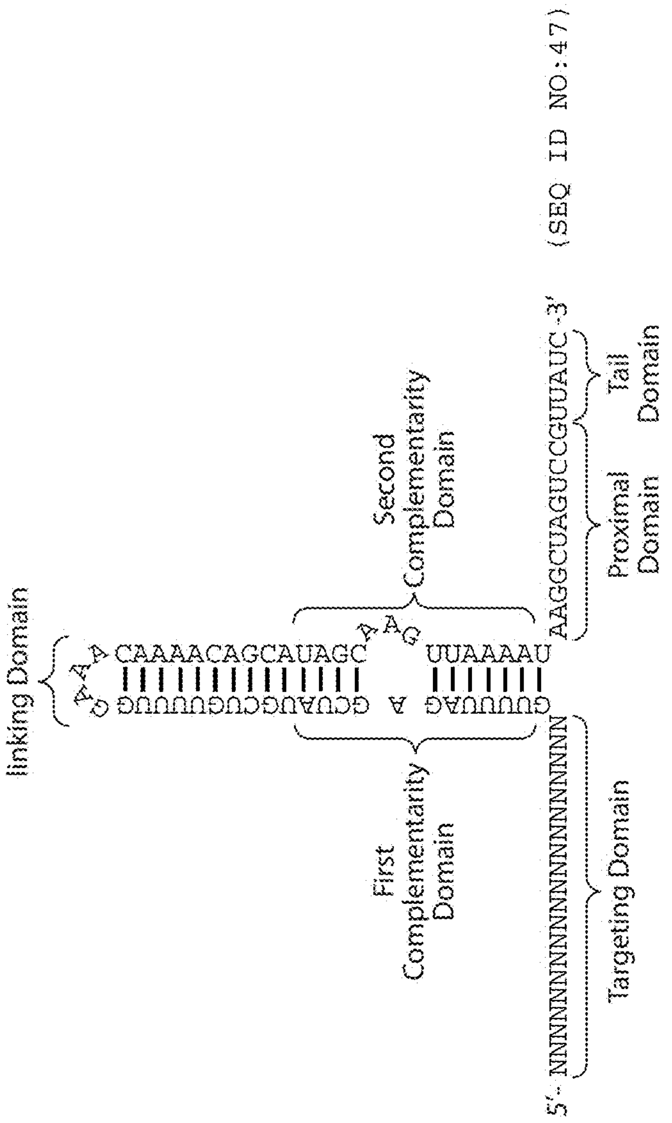
Figure 1H:
Figure 1I:
Figure 2D:
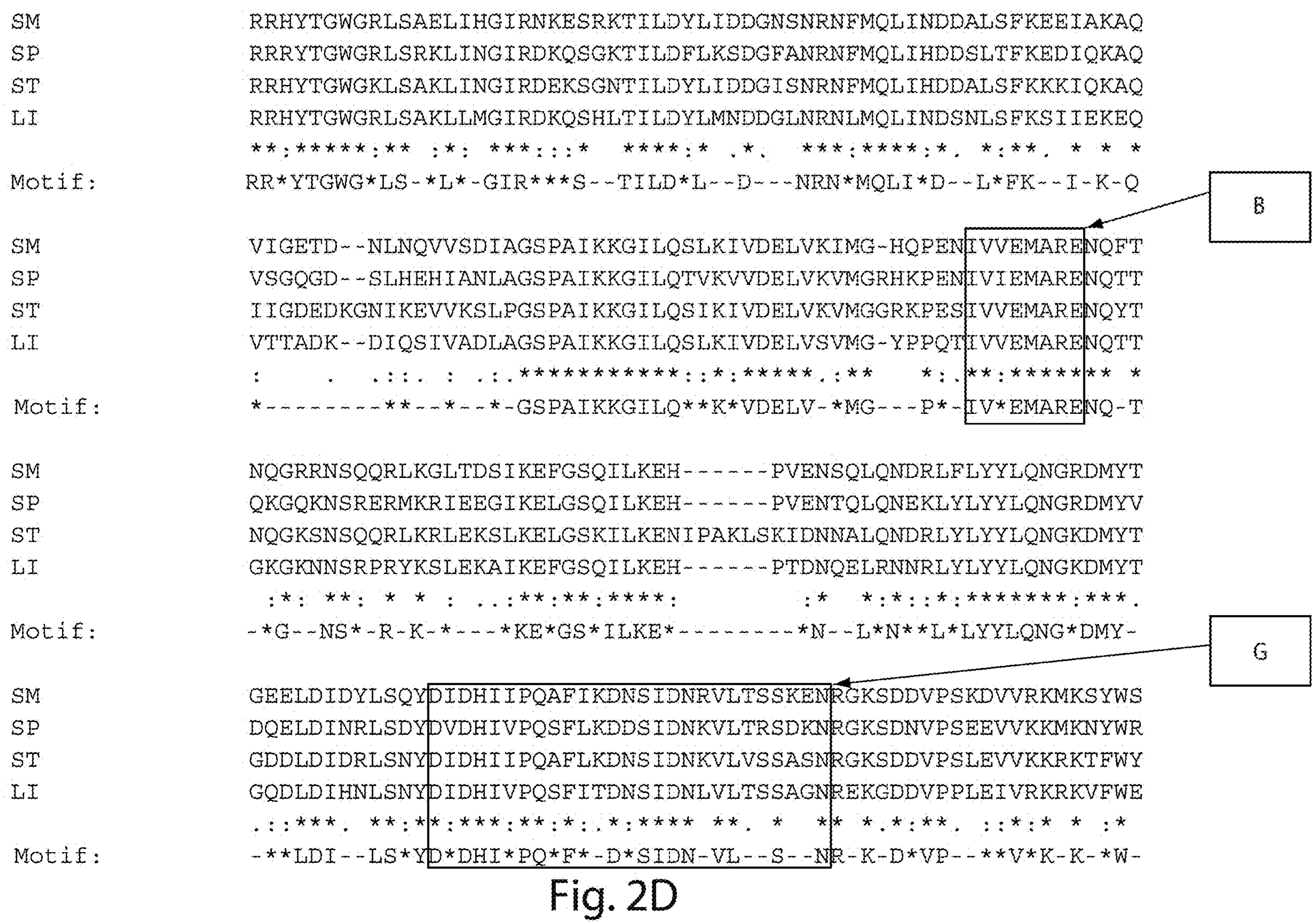

The second complementarity domain is complementary with the first complementarity domain, and in an embodiment, has sufficient complementarity to the second complementarity domain to form a duplexed region under at least some physiological conditions. In an embodiment, e.g., as shown in FIGS. 1A-1B, the second complementarity domain can include sequence that lacks complementarity with the first complementarity domain, e.g., sequence that loops out from the duplexed region.

In an embodiment, the second complementarity domain is 5 to 27 nucleotides in length. In an embodiment, it is longer than the first complementarity region. In an embodiment the second complementary domain is 7 to 27 nucleotides in length. In an embodiment, the second complementary domain is 7 to 25 nucleotides in length. In an embodiment, the second complementary domain is 7 to 20 nucleotides in length. In an embodiment, the second complementary domain is 7 to 17 nucleotides in length. In an embodiment, the complementary domain is 5, 6, 7, 8, 9, 10, 11, 12, 13, 14, 15, 16, 17, 18, 19, 20, 21, 22, 23, 24 or 25 nucleotides in length.

In an embodiment, the second complementarity domain comprises 3 subdomains, which, in the 5' to 3' direction are: a 5' subdomain, a central subdomain, and a 3' subdomain. In an embodiment, the 5' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length. In an embodiment, the central subdomain is 1, 2, 3, 4 or 5, e.g., 3, nucleotides in length. In an embodiment, the 3' subdomain is 4 to 9, e.g., 4, 5, 6, 7, 8 or 9 nucleotides in length.

In an embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In an embodiment, it has at least 50% homology with a second complementarity domain disclosed herein, e.g., an *S. pyogenes, S. aureus* or *S. thermophilus*, first complementarity domain.

Some or all of the nucleotides of the domain can have a modification, e.g., a modification found in Section VIII herein.

A Proximal Domain

FIGS. 1A-1G provide examples of proximal domains.

In an embodiment, the proximal domain is 5 to 20 nucleotides in length. In an embodiment, the proximal domain can share homology with or be derived from a naturally occurring proximal domain. In an embodiment, it has at least 50% homology with a proximal domain disclosed herein, e.g., an *S. pyogenes, S. aureus* or *S. thermophilus*, proximal domain.

Some or all of the nucleotides of the domain can have a modification, e.g., a modification found in Section VIII herein.

A Tail Domain

FIGS. 1A-1G provide examples of tail domains.

As can be seen by inspection of the tail domains in FIGS. 1A-1E, a broad spectrum of tail domains are suitable for use in gRNA molecules. In an embodiment, the tail domain is 0 (absent), 1, 2, 3, 4, 5, 6, 7, 8, 9, or 10 nucleotides in length. In embodiment, the tail domain nucleotides are from or share homology with sequence from the 5' end of a naturally occurring tail domain, see e.g., FIG. 1D or FIG. 1E. In an embodiment, the tail domain includes sequences that are complementary to each other and which, under at least some physiological conditions, form a duplexed region.

In an embodiment, the tail domain is absent or is 1 to 50 nucleotides in length. In an embodiment, the tail domain can share homology with or be derived from a naturally occurring proximal tail domain. In an embodiment, it has at least 50% homology with a tail domain disclosed herein, e.g., an *S. pyogenes, S. aureus* or *S. thermophilus*, tail domain.

In an embodiment, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When alternate pol-III promoters are used, these nucleotides may be various numbers or uracil bases or may include alternate bases.

The domains of gRNA molecules are described in more detail below.

The Targeting Domain

The “targeting domain” of the gRNA is complementary to the “target domain” on the target nucleic acid. The strand of the target nucleic acid comprising the nucleotide sequence complementary to the core domain of the gRNA is referred to herein as the “complementary strand” of the target nucleic acid. Guidance on the selection of targeting domains can be found, e.g., in Fu Y et al., Nat Biotechnol 2014 (doi: 10.1038/nbt.2808) and Sternberg S H et al., Nature 2014 (doi: 10.1038/nature13011).

In an embodiment, the targeting domain is 16, 17, 18, 19, 20, 21, 22, 23, 24, 25 or 26 nucleotides in length.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, the targeting domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the targeting domain is 20+/−5 nucleotides in length.

In an embodiment, the targeting domain is 20+/−10, 30+/−10, 40+/−10, 50+/−10, 60+/−10, 70+/−10, 80+/−10, 90+/−10, or 100+/−10 nucleotides, in length.

In an embodiment, the targeting domain is 30+/−10 nucleotides in length.

In an embodiment, the targeting domain is 10 to 100, 10 to 90, 10 to 80, 10 to 70, 10 to 60, 10 to 50, 10 to 40, 10 to 30, 10 to 20 or 10 to 15 nucleotides in length. In another embodiment, the targeting domain is 20 to 100, 20 to 90, 20 to 80, 20 to 70, 20 to 60, 20 to 50, 20 to 40, 20 to 30, or 20 to 25 nucleotides in length.

Typically the targeting domain has full complementarity with the target sequence. In an embodiment, the targeting domain has or includes 1, 2, 3, 4, 5, 6, 7 or 8 nucleotides that are not complementary with the corresponding nucleotide of the targeting domain.

In an embodiment, the target domain includes 1, 2, 3, 4 or 5 nucleotides that are complementary with the corresponding nucleotide of the targeting domain within 5 nucleotides of its 5' end. In an embodiment, the target domain includes 1, 2, 3, 4 or 5 nucleotides that are complementary with the corresponding nucleotide of the targeting domain within 5 nucleotides of its 3' end.

In an embodiment, the target domain includes 1, 2, 3, or 4 nucleotides that are not complementary with the corresponding nucleotide of the targeting domain within 5 nucleotides of its 5' end. In an embodiment, the target domain includes 1, 2, 3, or 4 nucleotides that are not complementary with the corresponding nucleotide of the targeting domain within 5 nucleotides of its 3' end.

In an embodiment, the degree of complementarity, together with other properties of the gRNA, is sufficient to allow targeting of a Cas9 molecule to the target nucleic acid.

In an embodiment, the targeting domain comprises two consecutive nucleotides that are not complementary to the target domain ("non-complementary nucleotides"), e.g., two consecutive noncomplementary nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides within 5 nucleotides of the 5' end of the targeting domain, within 5 nucleotides of the 3' end of the targeting domain, or within a region that is more than 5 nucleotides away from one or both ends of the targeting domain, are not complementary to the targeting domain.

In an embodiment, there are no noncomplementary nucleotides within 5 nucleotides of the 5' end of the targeting domain, within 5 nucleotides of the 3' end of the targeting domain, or within a region that is more than 5 nucleotides away from one or both ends of the targeting domain.

In an embodiment, the targeting domain nucleotides do not comprise modifications, e.g., modifications of the type provided in Section VIII. However, in an embodiment, the targeting domain comprises one or more modifications, e.g., modifications that render it less susceptible to degradation or more bio-compatible, e.g., less immunogenic. By way of example, the backbone of the targeting domain can be modified with a phosphorothioate, or other modification(s) from Section VIII. In an embodiment, a nucleotide of the targeting domain can comprise a 2' modification, e.g., a 2-acetylation, e.g., a 2' methylation, or other modification(s) from Section VIII.

In an embodiment, the targeting domain includes 1, 2, 3, 4, 5, 6, 7 or 8 or more modifications. In an embodiment, the targeting domain includes 1, 2, 3, or 4 modifications within 5 nucleotides of its 5' end. In an embodiment, the targeting domain comprises as many as 1, 2, 3, or 4 modifications within 5 nucleotides of its 3' end.

In an embodiment, the targeting domain comprises modifications at two consecutive nucleotides, e.g., two consecutive nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides are modified within 5 nucleotides of the 5' end of the targeting domain, within 5 nucleotides of the 3' end of the targeting domain, or within a region that is more than 5 nucleotides away from one or both ends of the targeting domain. In an embodiment, no nucleotide is modified within 5 nucleotides of the 5' end of the targeting domain, within 5 nucleotides of the 3' end of the targeting domain, or within a region that is more than 5 nucleotides away from one or both ends of the targeting domain.

Modifications in the targeting domain can be selected so as to not interfere with targeting efficacy, which can be evaluated by testing a candidate modification in the system described in Section IV. gRNAs having a candidate targeting domain having a selected length, sequence, degree of complementarity, or degree of modification, can be evaluated in a system in Section IV. The candidate targeting domain can be placed, either alone, or with one or more other candidate changes in a gRNA molecule/Cas9 molecule system known to be functional with a selected target and evaluated.

In an embodiment, all of the modified nucleotides are complementary to and capable of hybridizing to corresponding nucleotides present in the target domain. In another embodiment, 1, 2, 3, 4, 5, 6, 7 or 8 or more modified nucleotides are not complementary to or capable of hybridizing to corresponding nucleotides present in the target domain.

In an embodiment, the targeting domain comprises, preferably in the 5'→3' direction: a secondary domain and a core domain. These domains are discussed in more detail below.

The Core Domain and Secondary Domain of the Targeting Domain

The "core domain" of the targeting domain is complementary to the "core domain target" on the target nucleic acid. In an embodiment, the core domain comprises about 8 to about 13 nucleotides from the 3' end of the targeting domain (e.g., the most 3' 8 to 13 nucleotides of the targeting domain).

In an embodiment, the core domain and targeting domain, are independently, 6+/−2, 7+/−2, 8+/−2, 9+/−2, 10+/−2, 11+/−2, 12+/−2, 13+/−2, 14+/−2, 15+/−2, or 16+−2, nucleotides in length.

In an embodiment, the core domain and targeting domain, are independently, 10+/−2 nucleotides in length.

In an embodiment, the core domain and targeting domain, are independently, 10+/−4 nucleotides in length.

In an embodiment, the core domain and targeting domain are independently 6, 7, 8, 9, 10, 11, 12, 13, 14, 15, 16, 17, or 18 nucleotides in length.

In an embodiment, the core domain and targeting domain are independently 3 to 20, 4 to 20, 5 to 20, 6 to 20, 7 to 20, 8 to 20, 9 to 20 10 to 20 or 15 to 20 nucleotides in length.

In an embodiment, the core domain and targeting domain are independently 3 to 15, e.g., 6 to 15, 7 to 14, 7 to 13, 6 to 12, 7 to 12, 7 to 11, 7 to 10, 8 to 14, 8 to 13, 8 to 12, 8 to 11, 8 to 10 or 8 to 9 nucleotides in length.

The core domain is complementary with the core domain target. Typically the core domain has exact complementarity with the core domain target. In some embodiments, the core domain can have 1, 2, 3, 4 or 5 nucleotides that are not complementary with the corresponding nucleotide of the core domain. In an embodiment, the degree of complementarity, together with other properties of the gRNA, is sufficient to allow targeting of a Cas9 molecule to the target nucleic acid.

The "secondary domain" of the targeting domain of the gRNA is complementary to the "secondary domain target" of the target nucleic acid.

In an embodiment, the secondary domain is positioned 5' to the core domain.

In an embodiment, the secondary domain is absent or optional.

In an embodiment, if the targeting domain is 26 nucleotides in length and the core domain (counted from the 3' end of the targeting domain) is 8 to 13 nucleotides in length, the secondary domain is 12 to 17 nucleotides in length.

In an embodiment, if the targeting domain is 25 nucleotides in length and the core domain (counted from the 3' end of the targeting domain) is 8 to 13 nucleotides in length, the secondary domain is 12 to 17 nucleotides in length.

In an embodiment, if the targeting domain is 24 nucleotides in length and the core domain (counted from the 3' end of the targeting domain) is 8 to 13 nucleotides in length, the secondary domain is 11 to 16 nucleotides in length.

In an embodiment, if the targeting domain is 23 nucleotides in length and the core domain (counted from the 3' end of the targeting domain) is 8 to 13 nucleotides in length, the secondary domain is 10 to 15 nucleotides in length.

In an embodiment, if the targeting domain is 22 nucleotides in length and the core domain (counted from the 3' end of the targeting domain) is 8 to 13 nucleotides in length, the secondary domain is 9 to 14 nucleotides in length.

In an embodiment, if the targeting domain is 21 nucleotides in length and the core domain (counted from the 3' end of the targeting domain) is 8 to 13 nucleotides in length, the secondary domain is 8 to 13 nucleotides in length.

In an embodiment, if the targeting domain is 20 nucleotides in length and the core domain (counted from the 3' end of the targeting domain) is 8 to 13 nucleotides in length, the secondary domain is 7 to 12 nucleotides in length.

In an embodiment, if the targeting domain is 19 nucleotides in length and the core domain (counted from the 3' end of the targeting domain) is 8 to 13 nucleotides in length, the secondary domain is 6 to 11 nucleotides in length.

In an embodiment, if the targeting domain is 18 nucleotides in length and the core domain (counted from the 3' end of the targeting domain) is 8 to 13 nucleotides in length, the secondary domain is 5 to 10 nucleotides in length.

In an embodiment, if the targeting domain is 17 nucleotides in length and the core domain (counted from the 3' end of the targeting domain) is 8 to 13 nucleotides in length, the secondary domain is 4 to 9 nucleotides in length.

In an embodiment, if the targeting domain is 16 nucleotides in length and the core domain (counted from the 3' end of the targeting domain) is 8 to 13 nucleotides in length, the secondary domain is 3 to 8 nucleotides in length.

In an embodiment, the secondary domain is 0, 1, 2, 3, 4, 5, 6, 7, 8, 9, 10, 11, 12, 13, 14 or 15 nucleotides in length.

The secondary domain is complementary with the secondary domain target. Typically the secondary domain has exact complementarity with the secondary domain target. In an embodiment, the secondary domain can have 1, 2, 3, 4 or 5 nucleotides that are not complementary with the corresponding nucleotide of the secondary domain. In an embodiment, the degree of complementarity, together with other properties of the gRNA, is sufficient to allow targeting of a Cas9 molecule to the target nucleic acid.

In an embodiment, the core domain nucleotides do not comprise modifications, e.g., modifications of the type provided in Section VIII. However, in an embodiment, the core domain comprises one or more modifications, e.g., modifications that render it less susceptible to degradation or more bio-compatible, e.g., less immunogenic. By way of example, the backbone of the core domain can be modified with a phosphorothioate, or other modification(s) from Section VIII. In an embodiment a nucleotide of the core domain can comprise a 2' modification, e.g., a 2-acetylation, e.g., a 2' methylation, or other modification(s) from Section VIII. Typically, a core domain will contain no more than 1, 2, or 3 modifications.

Modifications in the core domain can be selected so as to not interfere with targeting efficacy, which can be evaluated by testing a candidate modification in the system described in Section IV. gRNAs having a candidate core domain having a selected length, sequence, degree of complementarity, or degree of modification, can be evaluated in the system described at Section IV. The candidate core domain can be placed, either alone, or with one or more other candidate changes in a gRNA molecule/Cas9 molecule system known to be functional with a selected target and evaluated.

In an embodiment, the secondary domain nucleotides do not comprise modifications, e.g., modifications of the type provided in Section VIII. However, in an embodiment, the secondary domain comprises one or more modifications, e.g., modifications that render it less susceptible to degradation or more bio-compatible, e.g., less immunogenic. By way of example, the backbone of the secondary domain can be modified with a phosphorothioate, or other modification(s) from Section VIII. In an embodiment a nucleotide of the secondary domain can comprise a 2' modification, e.g., a 2-acetylation, e.g., a 2' methylation, or other modification(s) from Section VIII. Typically, a secondary domain will contain no more than 1, 2, or 3 modifications.

Modifications in the secondary domain can be selected so as to not interfere with targeting efficacy, which can be evaluated by testing a candidate modification in the system described in Section IV. gRNAs having a candidate secondary domain having a selected length, sequence, degree of complementarity, or degree of modification, can be evaluated in the system described at Section IV. The candidate secondary domain can be placed, either alone, or with one or more other candidate changes in a gRNA molecule/Cas9 molecule system known to be functional with a selected target and evaluated.

In an embodiment, (1) the degree of complementarity between the core domain and its target, and (2) the degree of complementarity between the secondary domain and its target, may differ. In an embodiment, (1) may be greater than (2). In an embodiment, (1) may be less than (2). In an embodiment, (1) and (2) are the same, e.g., each may be completely complementary with its target.

In an embodiment, (1) the number of modifications (e.g., modifications from Section VIII) of the nucleotides of the core domain and (2) the number of modification (e.g., modifications from Section VIII) of the nucleotides of the secondary domain, may differ. In an embodiment, (1) may be less than (2). In an embodiment, (1) may be greater than (2). In an embodiment, (1) and (2) may be the same, e.g., each may be free of modifications.

The First and Second Complementarity Domains

The first complementarity domain is complementary with the second complementarity domain.

Typically the first domain does not have exact complementarity with the second complementarity domain target. In some embodiments, the first complementarity domain can have 1, 2, 3, 4 or 5 nucleotides that are not complementary with the corresponding nucleotide of the second complementarity domain. In an embodiment, 1, 2, 3, 4, 5 or 6, e.g., 3 nucleotides, will not pair in the duplex, and, e.g., form a non-duplexed or looped-out region. In an embodiment, an unpaired, or loop-out, region, e.g., a loop-out of 3 nucleotides, is present on the second complementarity domain. In an embodiment, the unpaired region begins 1, 2, 3, 4, 5, or 6, e.g., 4, nucleotides from the 5' end of the second complementarity domain.

In an embodiment, the degree of complementarity, together with other properties of the gRNA, is sufficient to allow targeting of a Cas9 molecule to the target nucleic acid.

In an embodiment, the first and second complementarity domains are:

- independently, 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length;
- independently, 6, 7, 8, 9, 10, 11, 12, 13, 14, 14, 16, 17, 18, 19, 20, 21, 22, 23, 24, 25, or 26, nucleotides in length; or
- independently, 5 to 24, 5 to 23, 5 to 22, 5 to 21, 5 to 20, 7 to 18, 9 to 16, or 10 to 14 nucleotides in length.

In an embodiment, the second complementarity domain is longer than the first complementarity domain, e.g., 2, 3, 4, 5, or 6, e.g., 6, nucleotides longer.

In an embodiment, the first and second complementary domains, independently, do not comprise modifications, e.g., modifications of the type provided in Section VIII.

In an embodiment, the first and second complementary domains, independently, comprise one or more modifications, e.g., modifications that the render the domain less susceptible to degradation or more bio-compatible, e.g., less immunogenic. By way of example, the backbone of the domain can be modified with a phosphorothioate, or other modification(s) from Section VIII. In an embodiment a nucleotide of the domain can comprise a 2' modification, e.g., a 2-acetylation, e.g., a 2' methylation, or other modification(s) from Section VIII.

In an embodiment, the first and second complementary domains, independently, include 1, 2, 3, 4, 5, 6, 7 or 8 or more modifications. In an embodiment, the first and second complementary domains, independently, include 1, 2, 3, or 4 modifications within 5 nucleotides of its 5' end. In an embodiment, the first and second complementary domains, independently, include as many as 1, 2, 3, or 4 modifications within 5 nucleotides of its 3' end.

In an embodiment, the first and second complementary domains, independently, include modifications at two consecutive nucleotides, e.g., two consecutive nucleotides that are within 5 nucleotides of the 5' end of the domain, within 5 nucleotides of the 3' end of the domain, or more than 5 nucleotides away from one or both ends of the domain. In an embodiment, the first and second complementary domains, independently, include no two consecutive nucleotides that are modified, within 5 nucleotides of the 5' end of the domain, within 5 nucleotides of the 3' end of the domain, or within a region that is more than 5 nucleotides away from one or both ends of the domain. In an embodiment, the first and second complementary domains, independently, include no nucleotide that is modified within 5 nucleotides of the 5' end of the domain, within 5 nucleotides of the 3' end of the domain, or within a region that is more than 5 nucleotides away from one or both ends of the domain.

Modifications in a complementarity domain can be selected so as to not interfere with targeting efficacy, which can be evaluated by testing a candidate modification in the system described in Section IV. gRNAs having a candidate complementarity domain having a selected length, sequence, degree of complementarity, or degree of modification, can be evaluated in the system described in Section IV. The candidate complementarity domain can be placed, either alone, or with one or more other candidate changes in a gRNA molecule/Cas9 molecule system known to be functional with a selected target and evaluated.

In an embodiment, the first complementarity domain has at least 60, 70, 80, 85%, 90% or 95% homology with, or differs by no more than 1, 2, 3, 4, 5, or 6 nucleotides from, a reference first complementarity domain, e.g., a naturally occurring, e.g., an *S. pyogenes, S. aureus* or *S. thermophilus*, first complementarity domain, or a first complementarity domain described herein, e.g., from FIGS. 1A-1G.

In an embodiment, the second complementarity domain has at least 60, 70, 80, 85%, 90%, or 95% homology with, or differs by no more than 1, 2, 3, 4, 5, or 6 nucleotides from, a reference second complementarity domain, e.g., a naturally occurring, e.g., an *S. pyogenes, S. aureus* or *S. thermophilus*, second complementarity domain, or a second complementarity domain described herein, e.g., from FIGS. 1A-1G.

The duplexed region formed by first and second complementarity domains is typically 6, 7, 8, 9, 10, 11, 12, 13, 14, 15, 16, 17, 18, 19, 20, 21 or 22 base pairs in length (excluding any looped out or unpaired nucleotides).

In some embodiments, the first and second complementarity domains, when duplexed, comprise 11 paired nucleotides, for example, in the gRNA sequence (one paired strand underlined, one bolded):

(SEQ ID NO: 5)
NNNNNNNNNNNNNNNNNNNNGUUUUAGAGCUAGAAAUAGCAAGUUAAAAU
AAGGCUAGUCCGUUAUCAACUUGAAAAAGUGGCACCGAGUCGGUGC.

In some embodiments, the first and second complementarity domains, when duplexed, comprise 15 paired nucleotides, for example in the gRNA sequence (one paired strand underlined, one bolded):

(SEQ ID NO: 27)
NNNNNNNNNNNNNNNNNNNNGUUUUAGAGCUAUGCUGAAAAGCAUAGCAA
GUUAAAAUAAGGCUAGUCCGUUAUCAACUUGAAAAAGUGGCACCGAGUCG
GUGC.

In some embodiments the first and second complementarity domains, when duplexed, comprise 16 paired nucleotides, for example in the gRNA sequence (one paired strand underlined, one bolded):

(SEQ ID NO: 28)
NNNNNNNNNNNNNNNNNNNNGUUUUAGAGCUAUGCUGGAAACAGCAUAGC
AAGUUAAAAUAAGGCUAGUCCGUUAUCAACUUGAAAAAGUGGCACCGAGU
CGGUGC.

In some embodiments the first and second complementarity domains, when duplexed, comprise 21 paired nucleotides, for example in the gRNA sequence (one paired strand underlined, one bolded):

(SEQ ID NO: 29)
NNNNNNNNNNNNNNNNNNNNGUUUUAGAGCUAUGCUGUUUUGGAAACAAA
ACAGCAUAGCAAGUUAAAAUAAGGCUAGUCCGUUAUCAACUUGAAAAAGU
GGCACCGAGUCGGUGC.

In some embodiments, nucleotides are exchanged to remove poly-U tracts, for example in the gRNA sequences (exchanged nucleotides underlined):

(SEQ ID NO: 30)
NNNNNNNNNNNNNNNNNNNNGUAUUAGAGCUAGAAAUAGCAAGUUAAUAU
AAGGCUAGUCCGUUAUCAACUUGAAAAAGUGGCACCGAGUCGGUGC;

(SEQ ID NO: 31)
NNNNNNNNNNNNNNNNNNNNGUUUAAGAGCUAGAAAUAGCAAGUUUAAAU
AAGGCUAGUCCGUUAUCAACUUGAAAAAGUGGCACCGAGUCGGUGC;
or (SEQ ID NO: 32)
NNNNNNNNNNNNNNNNNNNNGUAUUAGAGCUAUGCUGUAUUGGAAACAAU
ACAGCAUAGCAAGUUAAUAUAAGGCUAGUCCGUUAUCAACUUGAAAAAGU
GGCACCGAGUCGGUGC.

The 5' Extension Domain

In an embodiment, a modular gRNA can comprise additional sequence, 5' to the second complementarity domain. In an embodiment, the 5' extension domain is 2 to 10, 2 to 9, 2 to 8, 2 to 7, 2 to 6, 2 to 5, or 2 to 4 nucleotides in length. In an embodiment, the 5' extension domain is 2, 3, 4, 5, 6, 7, 8, 9, or 10 or more nucleotides in length.

In an embodiment, the 5' extension domain nucleotides do not comprise modifications, e.g., modifications of the type provided in Section VIII. However, in an embodiment, the 5' extension domain comprises one or more modifications, e.g., modifications that render it less susceptible to degradation or more bio-compatible, e.g., less immunogenic. By way of example, the backbone of the 5' extension domain can be modified with a phosphorothioate, or other modification(s) from Section VIII. In an embodiment, a nucleotide of the 5' extension domain can comprise a 2' modification, e.g., a 2-acetylation, e.g., a 2' methylation, or other modification(s) from Section VIII.

In an embodiment, the 5' extension domain can comprise as many as 1, 2, 3, 4, 5, 6, 7 or 8 modifications. In an embodiment, the 5' extension domain comprises as many as 1, 2, 3, or 4 modifications within 5 nucleotides of its 5' end, e.g., in a modular gRNA molecule. In an embodiment, the 5' extension domain comprises as many as 1, 2, 3, or 4 modifications within 5 nucleotides of its 3' end, e.g., in a modular gRNA molecule.

In an embodiment, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In an embodiment, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In an embodiment, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in the system described in Section IV. gRNAs having a candidate 5' extension domain having a selected length, sequence, degree of complementarity, or degree of modification, can be evaluated in the system described at Section IV. The candidate 5' extension domain can be placed, either alone, or with one or more other candidate changes in a gRNA molecule/Cas9 molecule system known to be functional with a selected target and evaluated.

In an embodiment, the 5' extension domain has at least 60, 70, 80, 85, 90 or 95% homology with, or differs by no more than 1, 2, 3, 4, 5, or 6 nucleotides from, a reference 5' extension domain, e.g., a naturally occurring, e.g., an *S. pyogenes, S. aureus* or *S. thermophilus,* 5' extension domain, or a 5' extension domain described herein, e.g., from FIGS. 1A-1G.

The Linking Domain

In a unimolecular gRNA molecule the linking domain is disposed between the first and second complementarity domains. In a modular gRNA molecule, the two molecules are associated with one another by the complementarity domains.

In an embodiment, the linking domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the linking domain is 20+/−10, 30+/−10, 40+/−10, 50+/−10, 60+/−10, 70+/−10, 80+/−10, 90+/−10, or 100+/−10 nucleotides, in length.

In an embodiment, the linking domain is 10 to 100, 10 to 90, 10 to 80, 10 to 70, 10 to 60, 10 to 50, 10 to 40, 10 to 30, 10 to 20 or 10 to 15 nucleotides in length. In other embodiments, the linking domain is 20 to 100, 20 to 90, 20 to 80, 20 to 70, 20 to 60, 20 to 50, 20 to 40, 20 to 30, or 20 to 25 nucleotides in length.

In an embodiment, the linking domain is 1, 2, 3, 4, 5, 6, 7, 8, 9, 10, 11, 12, 13, 14, 15, 16 17, 18, 19, or 20 nucleotides in length.

In an embodiment, the linking domain is a covalent bond.

In an embodiment, the linking domain comprises a duplexed region, typically adjacent to or within 1, 2, or 3 nucleotides of the 3' end of the first complementarity domain and/or the 5-end of the second complementarity domain. In an embodiment, the duplexed region can be 20+/−10 base pairs in length. In an embodiment, the duplexed region can be 10+/−5, 15+/−5, 20+/−5, or 30+/−5 base pairs in length. In an embodiment, the duplexed region can be 1, 2, 3, 4, 5, 6, 7, 8, 9, 10, 11, 12, 13, 14, or 15 base pairs in length.

Typically the sequences forming the duplexed region have exact complementarity with one another, though in some embodiments as many as 1, 2, 3, 4, 5, 6, 7 or 8 nucleotides are not complementary with the corresponding nucleotides.

In an embodiment, the linking domain nucleotides do not comprise modifications, e.g., modifications of the type provided in Section VIII. However, in an embodiment, the linking domain comprises one or more modifications, e.g., modifications that render it less susceptible to degradation or more bio-compatible, e.g., less immunogenic. By way of example, the backbone of the linking domain can be modified with a phosphorothioate, or other modification(s) from Section VIII. In an embodiment a nucleotide of the linking domain can comprise a 2' modification, e.g., a 2-acetylation, e.g., a 2' methylation, or other modification(s) from Section VIII. In some embodiments, the linking domain can comprise as many as 1, 2, 3, 4, 5, 6, 7 or 8 modifications.

Modifications in a linking domain can be selected so as to not interfere with targeting efficacy, which can be evaluated by testing a candidate modification in the system described in Section IV. gRNAs having a candidate linking domain having a selected length, sequence, degree of complementarity, or degree of modification, can be evaluated a system described in Section IV. A candidate linking domain can be placed, either alone, or with one or more other candidate changes in a gRNA molecule/Cas9 molecule system known to be functional with a selected target and evaluated.

In an embodiment, the linking domain has at least 60, 70, 80, 85, 90 or 95% homology with, or differs by no more than 1, 2, 3, 4, 5, or 6 nucleotides from, a reference linking domain, e.g., a linking domain described herein, e.g., from FIGS. 1A-1G.

The Proximal Domain

In an embodiment, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length.

In an embodiment, the proximal domain is 6, 7, 8, 9, 10, 11, 12, 13, 14, 15, 16, 17, 18, 19, 20, 21, 22, 23, 24, 25 or 26 nucleotides in length.

In an embodiment, the proximal domain is 5 to 20, 7, to 18, 9 to 16, or 10 to 14 nucleotides in length.

In an embodiment, the proximal domain nucleotides do not comprise modifications, e.g., modifications of the type provided in Section VIII. However, in an embodiment, the proximal domain comprises one or more modifications, e.g., modifications that render it less susceptible to degradation or more bio-compatible, e.g., less immunogenic. By way of example, the backbone of the proximal domain can be modified with a phosphorothioate, or other modification(s) from Section VIII. In an embodiment a nucleotide of the proximal domain can comprise a 2' modification, e.g., a 2-acetylation, e.g., a 2' methylation, or other modification(s) from Section VIII.

In an embodiment, the proximal domain can comprise as many as 1, 2, 3, 4, 5, 6, 7 or 8 modifications. In an embodiment, the proximal domain comprises as many as 1, 2, 3, or 4 modifications within 5 nucleotides of its 5' end, e.g., in a modular gRNA molecule. In an embodiment, the target domain comprises as many as 1, 2, 3, or 4 modifications within 5 nucleotides of its 3' end, e.g., in a modular gRNA molecule.

In an embodiment, the proximal domain comprises modifications at two consecutive nucleotides, e.g., two consecutive nucleotides that are within 5 nucleotides of the 5' end of the proximal domain, within 5 nucleotides of the 3' end of the proximal domain, or more than 5 nucleotides away from one or both ends of the proximal domain. In an embodiment, no two consecutive nucleotides are modified within 5 nucleotides of the 5' end of the proximal domain, within 5 nucleotides of the 3' end of the proximal domain, or within a region that is more than 5 nucleotides away from one or both ends of the proximal domain. In an embodiment, no nucleotide is modified within 5 nucleotides of the 5' end of the proximal domain, within 5 nucleotides of the 3' end of the proximal domain, or within a region that is more than 5 nucleotides away from one or both ends of the proximal domain.

Modifications in the proximal domain can be selected so as to not interfere with gRNA molecule efficacy, which can be evaluated by testing a candidate modification in the system described in Section IV. gRNAs having a candidate proximal domain having a selected length, sequence, degree of complementarity, or degree of modification, can be evaluated in the system described at Section IV. The candidate proximal domain can be placed, either alone, or with one or more other candidate changes in a gRNA molecule/Cas9 molecule system known to be functional with a selected target and evaluated.

In an embodiment, the proximal domain has at least 60, 70, 80, 85 90 or 95% homology with, or differs by no more than 1, 2, 3, 4, 5, or 6 nucleotides from, a reference proximal domain, e.g., a naturally occurring, e.g., an *S. pyogenes, S. aureus* or *S. thermophilus*, proximal domain, or a proximal domain described herein, e.g., from FIGS. 1A-1G.

The Tail Domain

In an embodiment, the tail domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the tail domain is 20+/−5 nucleotides in length.

In an embodiment, the tail domain is 20+/−10, 30+/−10, 40+/−10, 50+/−10, 60+/−10, 70+/−10, 80+/−10, 90+/−10, or 100+/−10 nucleotides, in length.

In an embodiment, the tail domain is 25+/−10 nucleotides in length.

In an embodiment, the tail domain is 10 to 100, 10 to 90, 10 to 80, 10 to 70, 10 to 60, 10 to 50, 10 to 40, 10 to 30, 10 to 20 or 10 to 15 nucleotides in length.

In other embodiments, the tail domain is 20 to 100, 20 to 90, 20 to 80, 20 to 70, 20 to 60, 20 to 50, 20 to 40, 20 to 30, or 20 to 25 nucleotides in length.

In an embodiment, the tail domain is 1 to 20, 1 to 15, 1 to 10, or 1 to 5 nucleotides in length.

In an embodiment, the tail domain nucleotides do not comprise modifications, e.g., modifications of the type provided in Section VIII. However, in an embodiment, the tail domain comprises one or more modifications, e.g., modifications that render it less susceptible to degradation or more bio-compatible, e.g., less immunogenic. By way of example, the backbone of the tail domain can be modified with a phosphorothioate, or other modification(s) from Section VIII. In an embodiment a nucleotide of the tail domain can comprise a 2' modification, e.g., a 2-acetylation, e.g., a 2' methylation, or other modification(s) from Section VIII.

In some embodiments, the tail domain can have as many as 1, 2, 3, 4, 5, 6, 7 or 8 modifications. In an embodiment, the target domain comprises as many as 1, 2, 3, or 4 modifications within 5 nucleotides of its 5' end. In an embodiment, the target domain comprises as many as 1, 2, 3, or 4 modifications within 5 nucleotides of its 3' end.

In an embodiment, the tail domain comprises a tail duplex domain, which can form a tail duplexed region. In an embodiment, the tail duplexed region can be 3, 4, 5, 6, 7, 8, 9, 10, 11, or 12 base pairs in length. In an embodiment, a further single stranded domain, exists 3' to the tail duplexed domain. In an embodiment, this domain is 3, 4, 5, 6, 7, 8, 9, or 10 nucleotides in length. In an embodiment it is 4 to 6 nucleotides in length.

In an embodiment, the tail domain has at least 60, 70, 80, or 90% homology with, or differs by no more than 1, 2, 3, 4, 5, or 6 nucleotides from, a reference tail domain, e.g., a naturally occurring, e.g., an *S. pyogenes, S. aureus* or *S. thermophilus*, tail domain, or a tail domain described herein, e.g., from FIGS. 1A-1G.

In an embodiment, the proximal and tail domain, taken together, comprise the following sequences:

```
                                          (SEQ ID NO: 33)
AAGGCUAGUCCGUUAUCAACUUGAAAAAGUGGCACCGAGUCGGUGCU,
or

                                          (SEQ ID NO: 34)
AAGGCUAGUCCGUUAUCAACUUGAAAAAGUGGCACCGAGUCGGUGGUGC,
or

                                          (SEQ ID NO: 35)
AAGGCUAGUCCGUUAUCAACUUGAAAAAGUGGCACCGAGUCGGUGCGGAU

C,
or

                                          (SEQ ID NO: 36)
AAGGCUAGUCCGUUAUCAACUUGAAAAAGUG,
or

                                          (SEQ ID NO: 37)
AAGGCUAGUCCGUUAUCA,
or

                                          (SEQ ID NO: 38)
AAGGCUAGUCCG.
```

In an embodiment, the tail domain comprises the 3' sequence UUUUUU, e.g., if a U6 promoter is used for transcription.

In an embodiment, the tail domain comprises the 3' sequence UUUU, e.g., if an H1 promoter is used for transcription.

In an embodiment, tail domain comprises variable numbers of 3' Us depending, e.g., on the termination signal of the pol-III promoter used.

In an embodiment, the tail domain comprises variable 3' sequence derived from the DNA template if a T7 promoter is used.

In an embodiment, the tail domain comprises variable 3' sequence derived from the DNA template, e.g., if in vitro transcription is used to generate the RNA molecule.

In an embodiment, the tail domain comprises variable 3' sequence derived from the DNA template, e.g., if a pol-II promoter is used to drive transcription.

Modifications in the tail domain can be selected so as to not interfere with targeting efficacy, which can be evaluated by testing a candidate modification in the system described in Section IV. gRNAs having a candidate tail domain having a selected length, sequence, degree of complementarity, or degree of modification, can be evaluated in the system described in Section IV. The candidate tail domain can be placed, either alone, or with one or more other candidate changes in a gRNA molecule/Cas9 molecule system known to be functional with a selected target and evaluated.

In some embodiments, the tail domain comprises modifications at two consecutive nucleotides, e.g., two consecutive nucleotides that are within 5 nucleotides of the 5' end of the tail domain, within 5 nucleotides of the 3' end of the tail domain, or more than 5 nucleotides away from one or both ends of the tail domain. In an embodiment, no two consecutive nucleotides are modified within 5 nucleotides of the 5' end of the tail domain, within 5 nucleotides of the 3' end of the tail domain, or within a region that is more than 5 nucleotides away from one or both ends of the tail domain. In an embodiment, no nucleotide is modified within 5 nucleotides of the 5' end of the tail domain, within 5 nucleotides of the 3' end of the tail domain, or within a region that is more than 5 nucleotides away from one or both ends of the tail domain.

In an embodiment a gRNA has the following structure:

5' [targeting domain]-[first complementarity domain]-[linking domain]-[second complementarity domain]-[proximal domain]-[tail domain]-3' wherein, the targeting domain comprises a core domain and optionally a secondary domain, and is 10 to 50 nucleotides in length;

the first complementarity domain is 5 to 25 nucleotides in length and, In an embodiment has at least 50, 60, 70, 80, 85, 90 or 95% homology with a reference first complementarity domain disclosed herein;

the linking domain is 1 to 5 nucleotides in length;

the second complementarity domain is 5 to 27 nucleotides in length and, in an embodiment has at least 50, 60, 70, 80, 85, 90 or 95% homology with a reference second complementarity domain disclosed herein;

the proximal domain is 5 to 20 nucleotides in length and, in an embodiment has at least 50, 60, 70, 80, 85, 90 or 95% homology with a reference proximal domain disclosed herein; and the tail domain is absent or a nucleotide sequence is 1 to 50 nucleotides in length and, in an embodiment has at least 50, 60, 70, 80, 85, 90 or 95% homology with a reference tail domain disclosed herein.

Exemplary Chimeric gRNAs

In an embodiment, a unimolecular, or chimeric, gRNA comprises, preferably from 5' to 3':

a targeting domain (which is complementary to a target nucleic acid);

a first complementarity domain, e.g., comprising 15, 16, 17, 18, 19, 20, 21, 22, 23, 24, 25, or 26 nucleotides;

a linking domain;

a second complementarity domain (which is complementary to the first complementarity domain);

a proximal domain; and a tail domain, wherein, (a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number:

(SEQ ID NO: 45)
NNNNNNNNNNNNNNNNNNNNGUUUUAGAGCUAGAAAUAGCAAGUUAAAAU
AAGGCUAGUCCGUUAUCAACUUGAAAAAGUGGCACCGAGUCGGUGCUUUU
UU.

In an embodiment, the unimolecular, or chimeric, gRNA molecule is a *S. pyogenes* gRNA molecule.

In some embodiments, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number:

(SEQ ID NO: 40)
NNNNNNNNNNNNNNNNNNNNGUUUUAGUACUCUGGAAACAGAAUCUACUA
AAACAAGGCAAAAUGCCGUGUUUAUCUCGUCAACUUGUUGGCGAGAUUUU
UU.

In an embodiment, the unimolecular, or chimeric, gRNA molecule is a *S. aureus* gRNA molecule.

Exemplary Modular gRNAs

In an embodiment, a modular gRNA comprises:

a first strand comprising, preferably from 5' to 3';
 a targeting domain, e.g., comprising 15, 16, 17, 18, 19, 20, 21, 22, 23, 24, 25, or 26 nucleotides;
 a first complementarity domain; and
 a second strand, comprising, preferably from 5' to 3':
 optionally a 5' extension domain;
 a second complementarity domain;
 a proximal domain; and
 a tail domain, wherein:

(a) the proximal and tail domain, when taken together, comprise at least 15, 18, 20, 25, 30, 31, 35, 40, 45, 49, 50, or 53 nucleotides;

(b) there are at least 15, 18, 20, 25, 30, 31, 35, 40, 45, 49, 50, or 53 nucleotides 3' to the last nucleotide of the second complementarity domain; or (c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

II. Methods for Designing gRNAs

Methods for designing gRNAs are described herein, including methods for selecting, designing and validating target domains. Exemplary targeting domains are also provided herein. Targeting Domains discussed herein can be incorporated into the gRNAs described herein.

Methods for selection and validation of target sequences as well as off-target analyses are described, e.g., in Mali et al., 2013 Science 339(6121): 823-826; Hsu et al. Nat Biotechnol, 31(9): 827-32; Fu et al., 2014 Nat Biotechnol, doi: 10.1038/nbt.2808. PubMed PMID: 24463574; Heigwer et al., 2014 Nat Methods 11(2):122-3. doi: 10.1038/nmeth.2812. PubMed PMID: 24481216; Bae et al., 2014 Bioinformatics PubMed PMID: 24463181; Xiao A et al., 2014 Bioinformatics PubMed PMID: 24389662.

For example, a software tool can be used to optimize the choice of gRNA within a user's target sequence, e.g., to minimize total off-target activity across the genome. Off target activity may be other than cleavage. For each possible gRNA choice using *S. pyogenes* Cas9, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA is then ranked according to its total predicted off-target cleavage; the top-ranked gRNAs represent those that are likely to have the greatest on-target and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate gRNA molecules can be evaluated by art-known methods or as described in Section IV herein.

The Targeting Domains discussed herein can be incorporated into the gRNAs described herein.

Strategies to Identify gRNAs for *S. pyogenes, S. aureus*, and *N. meningitidis* to Knock Out the MYOC Gene As an example, three strategies were utilized to identify gRNAs for use with *S. pyogenes, S. aureus* and *N. meningitidis* Cas9 enzymes.

In the first strategy, guide RNAs (gRNAs) for use with the *S. pyogenes* Cas9 (Tables 4A-4C) were identified using the publically available web-based ZiFiT server (Fu et al., Improving CRISPR-Cas nuclease specificity using truncated guide RNAs. Nat Biotechnol. 2014 Jan. 26. doi: 10.1038/nbt.2808. PubMed PMID: 24463574, for the original references see Sander et al., 2007, NAR 35:W599-605; Sander et al., 2010, NAR 38: W462-8). In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMmasker searches input DNA sequences for repeated elements and regions of low complexity. The output is a detailed annotation of the repeats present in a given query sequence. Following identification, gRNAs for use with a *S. pyogenes* Cas9 were ranked into 3 or 4 tiers, as described below.

The gRNAs in tier 1 were selected based on their distance to the target site and their orthogonality in the genome (based on the ZiFiT identification of close matches in the human genome containing an NGG PAM). As an example, for all targets, both 17-mer and 20-mer gRNAs were designed. gRNAs were also selected both for single-gRNA nuclease cutting and for the dual gRNA nickase strategy. Criteria for selecting gRNAs and the determination for which gRNAs can be used for which strategy is based on several considerations:

1. For the dual nickase strategy, gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, it will also often result in indel mutations at the site of only one of the gRNAs. Candidate pair members can be tested for how efficiently they remove the entire sequence versus just causing indel mutations at the site of one gRNA.

In order to find a pair for the dual-nickase strategy it was necessary to either extend the distance from the mutation or remove the requirement for the 5'G. For selection of tier 2 gRNAs, the distance restriction was relaxed in some cases such that a longer sequence was scanned, but the 5'G was required for all gRNAs. Whether or not the distance requirement was relaxed depended on how many sites were found within the original search window. Tier 3 uses the same distance restriction as tier 2, but removes the requirement for a 5'G. Note that tiers are non-inclusive (each gRNA is listed only once).

As discussed above, gRNAs were identified for single-gRNA nuclease cleavage as well as for a dual-gRNA paired "nickase" strategy, as indicated.

gRNAs for use with the *N. meningitidis* (Tables 4E) and *S. aureus* (Tables 4D) Cas9s were identified manually by scanning genomic DNA sequence for the presence of PAM sequences. These gRNAs were not separated into tiers, but are provided in single lists for each species.

In a second strategy, Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference: Cas-OFFinder: a fast and versatile algorithm that searches for potential off-target sites of Cas9 RNA-guided endonucleases, Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 6A-6E, 7A-7G or 8A-8E, e.g., the targeting domains of 18 or more nucleotides may comprise the 17-mer gRNAs described in Tables 6A-6E, 7A-7G or 8A-8E. Targeting domains, disclosed herein, may comprises the 18-mer described in Tables 6A-6E, 7A-7G or 8A-8E, e.g., the targeting domains of 19 or more nucleotides may comprise the 18-mer gRNAs described in Tables 6A-6E, 7A-7G or 8A-8E. Targeting domains, disclosed herein, may comprises the 19-mer described in Tables 6A-6E, 7A-7G or 8A-8E, e.g., the targeting domains of 20 or more nucleotides may comprise the 19-mer gRNAs described in Tables 6A-6E, 7A-7G or 8A-8E. Targeting domains, disclosed herein, may comprises the 20-mer gRNAs described in Tables 6A-6E, 7A-7G or 8A-8E, e.g., the targeting domains of 21 or more nucleotides may comprise the 20-mer gRNAs described in Tables 6A-6E, 7A-7G or 8A-8E. Targeting domains, disclosed herein, may comprises the 21-mer described in Tables 6A-6E, 7A-7G or 8A-8E, e.g., the targeting domains of 22 or more nucleotides may comprise the 21-mer gRNAs described in Tables 6A-6E, 7A-7G or 8A-8E. Targeting domains, disclosed herein, may comprises the 22-mer described in Tables 6A-6E, 7A-7G or 8A-8E, e.g., the targeting domains of 23 or more nucleotides may comprise the 22-mer gRNAs described in Tables 6A-6E, 7A-7G or 8A-8E. Targeting domains, disclosed herein, may comprises the 23-mer described in Tables 6A-6E, 7A-7G or 8A-8E, e.g., the targeting domains of 24 or more nucleotides may comprise the 23-mer gRNAs described in Tables 6A-6E, 7A-7G or 8A-8E. Targeting domains, disclosed herein, may comprises the 24-mer described in Tables 6A-6E, 7A-7G or 8A-8E, e.g., the targeting domains of 25 or more nucleotides may comprise the 24-mer gRNAs described in Tables 6A-6E, 7A-7G or 8A-8E. gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

gRNAs were identified and ranked into 5 tiers for *S. pyogenes* (Tables 6A-6E), and *N. meningitidis* (Tables 8A-8E); and 7 tiers for *S. aureus* (Tables 7A-7G). For *S. pyogenes*, and *N. meningitidis*, the targeting domain for tier 1 gRNA molecules were selected based on (1) distance to a target site (e.g., start codon), e.g., within 500 bp (e.g., downstream) of the target site (e.g., start codon), (2) a high level of orthogonality and (3) the presence of 5'G. The targeting domain for tier 2 gRNA molecules were selected based on (1) distance to a target site (e.g., start codon), e.g., within 500 bp (e.g., downstream) of the target site (e.g., start codon) and (2) a high level of orthogonality. The targeting domain for tier 3 gRNA molecules were selected based on (1) distance to a target site (e.g., start codon), e.g., within 500 bp (e.g., downstream) of the target site (e.g., start codon) and (2) the presence of 5'G. The targeting domain for tier 4 gRNA molecules were selected based on distance to a target site (e.g., start codon), e.g., within 500 bp (e.g., downstream) of the target site (e.g., start codon). The targeting domain for tier 5 gRNA molecules were selected based on distance to the target site (e.g., start codon), e.g., within reminder of the coding sequence, e.g., downstream of the first 500 bp of coding sequence (e.g., anywhere from +500 (relative to the start codon) to the stop codon). For *S. aureus*, the targeting domain for tier 1 gRNA molecules were selected based on (1) distance to a target site (e.g., start codon), e.g., within 500 bp (e.g., downstream) of the target site (e.g., start codon), (2) a high level of orthogonality, (3) the presence of 5'G and (4) PAM is NNGRRT. The targeting domain for tier 2 gRNA molecules were selected based on (1) distance to a target site (e.g., start codon), e.g., within 500 bp (e.g., downstream) of the target site (e.g., start codon), (2) a high level of orthogonality, and (3) PAM is NNGRRT. The targeting domain for tier 3 gRNA molecules were selected based on (1) distance to a target site (e.g., start codon), e.g., within 500 bp (e.g., downstream) of the target site (e.g., start codon) and (2) PAM is NNGRRT. The targeting domain for tier 4 gRNA molecules were selected based on (1) distance to a target site (e.g., start codon), e.g., within 500 bp (e.g., downstream) of the target site (e.g., start codon) and (2) PAM is NNGRRV. The targeting domain for tier 5 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon), (2) the presence of 5'G and (3) PAM is NNGRRT. The targeting domain for tier 6 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) PAM is NNGRRT. The targeting domain for tier 7 gRNA molecules were selected based on (1) distance to the target site (e.g., start codon), e.g., within reminder of the coding sequence, e.g., downstream of the first 500 bp of coding sequence (e.g., anywhere from +500 (relative to the start codon) to the stop codon) and (2) PAM is NNGRRV. Note that tiers are non-inclusive (each gRNA is listed only once for the strategy). In certain instances, no gRNA was identified based on the criteria of the particular tier.

Strategies to Identify gRNAs for *S. pyogenes, S. aureus*, and *N. meningitidis* to Knock Down the MYOC Gene As an example, three strategies were utilized to identify gRNAs for use with *S. pyogenes, S. aureus* and *N. meningitidis* Cas9 enzymes.

In the first strategy, guide RNAs (gRNAs) for use with the *S. pyogenes* Cas9 (Tables 5A-5D) were identified using the publically available web-based ZiFiT server (Fu et al., Improving CRISPR-Cas nuclease specificity using truncated guide RNAs. Nat Biotechnol. 2014 Jan. 26. doi: 10.1038/nbt.2808. PubMed PMID: 24463574, for the original references see Sander et al., 2007, NAR 35:W599-605; Sander et al., 2010, NAR 38: W462-8). In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMmasker searches input DNA sequences for repeated elements and regions of low complexity. The output is a detailed annotation of the repeats present in a given query sequence. Following identification, gRNAs for use with a *S. pyogenes* Cas9 were ranked into 3 or 4 tiers, as described below.

The gRNAs in tier 1 were selected based on their distance to the target site and their orthogonality in the genome (based on the ZiFiT identification of close matches in the human genome containing an NGG PAM). As an example, for all targets, both 17-mer and 20-mer gRNAs were designed. For selection of tier 2 gRNAs, the distance restriction was relaxed in some cases such that a longer sequence was scanned, but the 5'G was required for all gRNAs. Whether or not the distance requirement was relaxed depended on how many sites were found within the original search window. Tier 3 uses the same distance restriction as tier 2, but removes the requirement for a 5'G. Note that tiers are non-inclusive (each gRNA is listed only once).

gRNAs for use with the *N. meningitidis* (Tables 5E) and *S. aureus* (Tables 5D) Cas9s were identified manually by scanning genomic DNA sequence for the presence of PAM sequences. These gRNAs were not separated into tiers, but are provided in single lists for each species.

In a second strategy, Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference: Cas-OFFinder: a fast and versatile algorithm that searches for potential off-target sites of Cas9 RNA-guided endonucleases, Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 9A-9E, 10A-10G or 11A-11E, e.g., the targeting domains of 18 or more nucleotides may comprise the 17-mer gRNAs described in Tables 9A-9E, 10A-10G or 11A-11E. Targeting domains, disclosed herein, may comprises the 18-mer described in Tables 9A-9E, 10A-10G or 11A-11E, e.g., the targeting domains of 19 or more nucleotides may comprise the 18-mer gRNAs described in Tables 9A-9E, 10A-10G or 11A-11E. Targeting domains, disclosed herein, may comprises the 19-mer described in Tables 9A-9E, 10A-10G or 11A-11E, e.g., the targeting domains of 20 or more nucleotides may comprise the 19-mer gRNAs described in Tables 9A-9E, 10A-10G or 11A-11E. Targeting domains, disclosed herein, may comprises the 20-mer gRNAs described in Tables 9A-9E, 10A-10G or 11A-11E, e.g., the targeting domains of 21 or more nucleotides may comprise the 20-mer gRNAs described in Tables 9A-9E, 10A-10G or 11A-11E. Targeting domains, disclosed herein, may comprises the 21-mer described in Tables 9A-9E, 10A-10G or 11A-11E, e.g., the targeting domains of 22 or more nucleotides may comprise the 21-mer gRNAs described in Tables 9A-9E, 10A-10G or 11A-11E. Targeting domains, disclosed herein, may comprises the 22-mer described in Tables 9A-9E, 10A-10G or 11A-11E, e.g., the targeting domains of 23 or more nucleotides may comprise the 22-mer gRNAs described in Tables 9A-9E, 10A-10G or 11A-11E. Targeting domains, disclosed herein, may comprises the 23-mer described in Tables 9A-9E, 10A-10G or 11A-11E, e.g., the targeting domains of 24 or more nucleotides may comprise the 23-mer gRNAs described in Tables 9A-9E, 10A-10G or 11A-11E. Targeting domains, disclosed herein, may comprises the 24-mer described in Tables 9A-9E, 10A-10G or 11A-11E, e.g., the targeting domains of 25 or more nucleotides may comprise the 24-mer gRNAs described in Tables 9A-9E, 10A-10G or 11A-11E.

The targeting domains discussed herein can be incorporated into the gRNAs described herein.

gRNAs were identified and ranked into 5 tiers for *S. pyogenes* (Tables 9A-9E), and *N. meningitidis* (Tables 11A-11E); and 7 tiers for *S. aureus* (Tables 10A-10G). For *S. pyogenes*, and *N. meningitidis*, the targeting domain for tier 1 gRNA molecules were selected based on (1) distance to a target site, e.g., within 3454-2454 bp upstream of transcription start site or 500 bp upstream and downstream of transcription start site, (2) a high level of orthogonality and (3) the presence of 5'G. The targeting domain for tier 2 gRNA molecules were selected based on (1) distance to a target site, e.g., within 3454-2454 bp upstream of transcription start site or 500 bp upstream and downstream of transcription start site and (2) a high level of orthogonality. The targeting domain for tier 3 gRNA molecules were selected based on (1) distance to a target site, e.g., within 3454-2454 bp upstream of transcription start site or 500 bp upstream and downstream of transcription start site and (2) the presence of 5'G. The targeting domain for tier 4 gRNA molecules were selected based on distance to a target site, e.g., within 3454-2454 bp upstream of transcription start site or 500 bp upstream and downstream of transcription start site. The targeting domain for tier 5 gRNA molecules were selected based on distance to the target site, e.g., within 2484-903 bp upstream of transcription start site or the additional 500 bp upstream and downstream of transcription start site (extending to 1 kb up and downstream of the transcription start site). For *S. aureus*, the targeting domain for tier 1 gRNA molecules were selected based on (1) distance to a target site, e.g., within 3454-2454 bp upstream of transcription start site or 500 bp upstream and downstream of transcription start site, (2) a high level of orthogonality, (3) the presence of 5'G and (4) PAM is NNGRRT. The targeting domain for tier 2 gRNA molecules were selected based on (1) distance to a target site, e.g., within 3454-2454 bp upstream of transcription start site or 500 bp upstream and downstream of transcription start site, (2) a high level of orthogonality, and (3) PAM is NNGRRT. The targeting domain for tier 3 gRNA molecules were selected based on (1) distance to a target site, e.g., within 3454-2454 bp upstream of transcription start site or 500 bp upstream and downstream of transcription start site and (2) PAM is NNGRRT. The targeting domain for tier 4 gRNA molecules were selected based on (1) distance to a target site, e.g., within 3454-2454 bp upstream of transcription start site or 500 bp upstream and downstream of transcription start site and (2) PAM is NNGRRV. The targeting domain for tier 5 gRNA molecules were selected based on (1) distance to the target site, e.g., within 2484-903 bp upstream of transcription start site or the additional 500 bp upstream and downstream of transcription start site (extending to 1 kb up and downstream of the transcription start site), (2) the presence of 5'G and (3) PAM is NNGRRT. The targeting domain for tier 6 gRNA molecules were selected based on (1) distance to the target site, e.g., within 2484-903 bp upstream of transcription start site or the additional 500 bp upstream and downstream of transcription start site (extending to 1 kb up and downstream of the transcription start site) and (2) PAM is NNGRRT. The targeting domain for tier 7 gRNA molecules were selected based on (1) distance to the target site, e.g., within 2484-903 bp upstream of transcription start site or the additional 500 bp upstream and downstream of transcription start site (extending to 1 kb up and downstream of the transcription start site) and (2) PAM is NNGRRV. Note that tiers are non-inclusive (each gRNA is listed only once for the strategy). In certain instances, no gRNA was identified based on the criteria of the particular tier.

Strategies to Identify gRNAs for *S. pyogenes, S. Aureus*, and N. for the Mutational Hotspot 477-502 Target Site in the MYOC Gene As an example, three strategies were utilized to identify gRNAs for use with *S. pyogenes, S. aureus* and *N. meningitidis* Cas9 enzymes.

In the first strategy, guide RNAs (gRNAs) for use with the *S. pyogenes* Cas9 (Tables 3A-3C) were identified using the publically available web-based ZiFiT server (Fu et al., Improving CRISPR-Cas nuclease specificity using truncated guide RNAs. Nat Biotechnol. 2014 Jan. 26. doi: 10.1038/nbt.2808. PubMed PMID: 24463574, for the original references see Sander et al., 2007, NAR 35:W599-605; Sander et al., 2010, NAR 38: W462-8). In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMmasker searches input DNA sequences for repeated elements and regions of low complexity. The output is a detailed annotation of the repeats present in a given query sequence. Following identification, gRNAs for use with a *S. pyogenes* Cas9 were ranked into 3 or 4 tiers, as described below.

The gRNAs in tier 1 were selected based on their distance to the target site and their orthogonality in the genome (based on the ZiFiT identification of close matches in the human genome containing an NGG PAM). As an example, for all targets, both 17-mer and 20-mer gRNAs were designed. gRNAs were also selected both for single-gRNA nuclease cutting and for the dual gRNA nickase strategy. Criteria for selecting gRNAs and the determination for which gRNAs can be used for which strategy is based on several considerations:

1. For the dual nickase strategy, gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, it will also often result in indel mutations at the site of only one of the gRNAs. Candidate pair members can be tested for how efficiently they remove the entire sequence versus just causing indel mutations at the site of one gRNA.

While it can be desirable to have gRNAs start with a 5' G, this requirement was relaxed for some gRNAs in tier 1 in order to identify guides in the correct orientation, within a reasonable distance to the mutation and with a high level of orthogonality. In order to find a pair for the dual-nickase strategy it was necessary to either extend the distance from the mutation or remove the requirement for the 5'G. For selection of tier 2 gRNAs, the distance restriction was relaxed in some cases such that a longer sequence was scanned, but the 5'G was required for all gRNAs. Whether or not the distance requirement was relaxed depended on how many sites were found within the original search window. Tier 3 uses the same distance restriction as tier 2, but removes the requirement for a 5'G. Note that tiers are non-inclusive (each gRNA is listed only once).

As discussed above, gRNAs were identified for single-gRNA nuclease cleavage as well as for a dual-gRNA paired "nickase" strategy, as indicated.

gRNAs for use with the *N. meningitidis* (Tables 3E) and *S. aureus* (Tables 3D) Cas9s were identified manually by scanning genomic DNA sequence for the presence of PAM sequences. These gRNAs were not separated into tiers, but are provided in single lists for each species.

In a second strategy, Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference: Cas-OFFinder: a fast and versatile algorithm that searches for potential off-target sites of Cas9 RNA-guided endonucleases, Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 12A-12D, 13A-13E, 14A-14C, 15A-15D, 16A-16E, or 17A-17B, e.g., the targeting domains of 18 or more nucleotides may comprise the 17-mer gRNAs described in Tables 12A-12D, 13A-13E, 14A-14C, 15A-15D, 16A-16E, or 17A-17B. Targeting domains, disclosed herein, may comprises the 18-mer described in Tables 12A-12D, 13A-13E, 14A-14C, 15A-15D, 16A-16E, or 17A-17B, e.g., the targeting domains of 19 or more nucleotides may comprise the 18-mer gRNAs described in Tables 12A-12D, 13A-13E, 14A-14C, 15A-15D, 16A-16E, or 17A-17B. Targeting domains, disclosed herein, may comprises the 19-mer described in Tables 12A-12D, 13A-13E, 14A-14C, 15A-15D, 16A-16E, or 17A-17B, e.g., the targeting domains of 20 or more nucleotides may comprise the 19-mer gRNAs described in Tables 12A-12D, 13A-13E, 14A-14C, 15A-15D, 16A-16E, or 17A-17B. Targeting domains, disclosed herein, may comprises the 20-mer gRNAs described in Tables 12A-12D, 13A-13E, 14A-14C, 15A-15D, 16A-16E, or 17A-17B, e.g., the targeting domains of 21 or more nucleotides may comprise the 20-mer gRNAs described in Tables 12A-12D, 13A-13E, 14A-14C, 15A-15D, 16A-16E, or 17A-17B. Targeting domains, disclosed herein, may comprises the 21-mer described in Tables 12A-12D, 13A-13E, 14A-14C, 15A-15D, 16A-16E, or 17A-17B, e.g., the targeting domains of 22 or more nucleotides may comprise the 21-mer gRNAs described in Tables 12A-12D, 13A-13E, 14A-14C, 15A-15D, 16A-16E, or 17A-17B. Targeting domains, disclosed herein, may comprises the 22-mer described in Tables 12A-12D, 13A-13E, 14A-14C, 15A-15D, 16A-16E, or 17A-17B, e.g., the targeting domains of 23 or more nucleotides may comprise the 22-mer gRNAs described in Tables 12A-12D, 13A-13E, 14A-14C, 15A-15D, 16A-16E, or 17A-17B. Targeting domains, disclosed herein, may comprises the 23-mer described in Tables 12A-12D, 13A-13E, 14A-14C, 15A-15D, 16A-16E, or 17A-17B, e.g., the targeting domains of 24 or more nucleotides may comprise the 23-mer gRNAs described in Tables 12A-12D, 13A-13E, 14A-14C, 15A-15D, 16A-16E, or 17A-17B. Targeting domains, disclosed herein, may comprises the 24-mer described in Tables 12A-12D, 13A-13E, 14A-14C, 15A-15D, 16A-16E, or 17A-17B, e.g., the targeting domains of 25 or more nucleotides may comprise the 24-mer gRNAs described in Tables 12A-12D, 13A-13E, 14A-14C, 15A-15D, 16A-16E, or 17A-17B.

gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

In an embodiment, gRNAs were identified and ranked into 4 tiers for *S. pyogenes* (Tables 12A-12D), and *N. meningitidis* (Tables 14A-14C); and 5 tiers for *S. aureus* (Tables 13A-13E). For *S. pyogenes*, and *N. meningitidis*, the targeting domain for tier 1 gRNA molecules were selected based on (1) distance to a POAG target position, e.g., within 200 bp upstream from the mutational hotspot 477-502 target site, (2) a high level of orthogonality and (3) the presence of 5'G. The targeting domain for tier 2 gRNA molecules were selected based on (1) distance to a POAG target position, e.g., within 200 bp upstream from the mutational hotspot 477-502 target site and (2) a high level of orthogonality. The targeting domain for tier 3 gRNA molecules were selected based on (1) distance to a POAG target position, e.g., within 200 bp upstream from the mutational hotspot 477-502 target site and (2) the presence of 5'G. The targeting domain for tier 4 gRNA molecules were selected based on distance to a POAG target position, e.g., within 200 bp upstream from the mutational hotspot 477-502 target site. For *S. aureus*, the targeting domain for tier 1 gRNA molecules were selected based on (1) distance to a POAG target position, e.g., within 200 bp upstream from the mutational hotspot 477-502 target site, (2) a high level of orthogonality, (3) the presence of 5'G and (4) PAM is NNGRRT. The targeting domain for tier 2 gRNA molecules were selected based on (1) distance to a POAG target position, e.g., within 200 bp upstream from the mutational hotspot 477-502 target site, (2) a high level of orthogonality, and (3) PAM is NNGRRT. The targeting domain for tier 3 gRNA molecules were selected based on (1) distance to a POAG target position, e.g., within 200 bp upstream from the mutational hotspot 477-502 target site, (2) the presence of a 5'G and (2) PAM is NNGRRT. The targeting domain for tier 4 gRNA molecules were selected based on (1) distance to a POAG target position, e.g., within 200 bp upstream from the mutational hotspot 477-502 target site and (2) PAM is NNGRRT. The targeting domain for tier 5 gRNA molecules were selected based on (1) (1) distance to a POAG target position, e.g., within 200 bp upstream from the mutational hotspot 477-502 target site and (2) PAM is NNGRRV. Note that tiers are non-inclusive (each gRNA is listed only once for the strategy). In certain instances, no gRNA was identified based on the criteria of the particular tier.

In another embodiment, gRNAs were identified and ranked into 4 tiers for *S. pyogenes* (Tables 15A-15D), and *N. meningitidis* (Tables 17A-17B); and 5 tiers for *S. aureus* (Tables 16A-16E). For *S. pyogenes*, and *N. meningitidis*, the targeting domain for tier 1 gRNA molecules were selected based on (1) distance to a POAG target position, e.g., within 200 bp downstream from the mutational hotspot 477-502 target site, (2) a high level of orthogonality and (3) the presence of 5'G. The targeting domain for tier 2 gRNA molecules were selected based on (1) distance to a POAG target position, e.g., within 200 bp downstream from the mutational hotspot 477-502 target site and (2) a high level of orthogonality. The targeting domain for tier 3 gRNA molecules were selected based on (1) distance to a POAG target position, e.g., within 200 bp downstream from the mutational hotspot 477-502 target site and (2) the presence of 5'G. The targeting domain for tier 4 gRNA molecules were selected based on distance to a POAG target position, e.g., within 200 bp downstream from the mutational hotspot 477-502 target site. For *S. aureus*, the targeting domain for tier 1 gRNA molecules were selected based on (1) distance to a POAG target position, e.g., within 200 bp downstream from the mutational hotspot 477-502 target site, (2) a high level of orthogonality, (3) the presence of 5'G and (4) PAM is NNGRRT. The targeting domain for tier 2 gRNA molecules were selected based on (1) distance to a POAG target position, e.g., within 200 bp downstream from the mutational hotspot 477-502 target site, (2) a high level of orthogonality, and (3) PAM is NNGRRT. The targeting domain for tier 3 gRNA molecules were selected based on (1) distance to a POAG target position, e.g., within 200 bp downstream from the mutational hotspot 477-502 target site, (2) the presence of a 5'G and (2) PAM is NNGRRT. The targeting domain for tier 4 gRNA molecules were selected based on (1) distance to a POAG target position, e.g., within 200 bp downstream from the mutational hotspot 477-502 target site and (2) PAM is NNGRRT. The targeting domain for tier 5 gRNA molecules were selected based on (1) (1) distance to a POAG target position, e.g., within 200 bp downstream from the mutational hotspot 477-502 target site and (2) PAM is NNGRRV. Note that tiers are non-inclusive (each gRNA is listed only once for the strategy). In certain instances, no gRNA was identified based on the criteria of the particular tier.

Strategies to Identify gRNAs for *S. pyogenes, S. aureus*, and N. for Correcting a Mutation (e.g., I477N) in the MYOC Gene As an example, three strategies were utilized to identify gRNAs for use with *S. pyogenes, S. aureus* and *N. meningitidis* Cas9 enzymes.

In the first strategy, guide RNAs (gRNAs) for use with the *S. pyogenes* Cas9 (Tables 2A-2C) were identified using the publically available web-based ZiFiT server (Fu et al., Improving CRISPR-Cas nuclease specificity using truncated guide RNAs. Nat Biotechnol. 2014 Jan. 26. doi: 10.1038/nbt.2808. PubMed PMID: 24463574, for the original references see Sander et al., 2007, NAR 35:W599-605; Sander et al., 2010, NAR 38: W462-8). In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMmasker searches input DNA sequences for repeated elements and regions of low complexity. The output is a detailed annotation of the repeats present in a given query sequence. Following identification, gRNAs for use with a *S. pyogenes* Cas9 were ranked into 3 or 4 tiers, as described below.

The gRNAs in tier 1 were selected based on their distance to the target site and their orthogonality in the genome (based on the ZiFiT identification of close matches in the human genome containing an NGG PAM). As an example, for all targets, both 17-mer and 20-mer gRNAs were designed. gRNAs were also selected both for single-gRNA nuclease cutting and for the dual gRNA nickase strategy. Criteria for selecting gRNAs and the determination for which gRNAs can be used for which strategy is based on several considerations:

1. For the dual nickase strategy, gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, it will also often result in indel mutations at the site of only one of the gRNAs. Candidate pair members can be tested for how efficiently they remove the entire sequence versus just causing indel mutations at the site of one gRNA.

While it can be desirable to have gRNAs start with a 5' G, this requirement was relaxed for some gRNAs in tier 1 in order to identify guides in the correct orientation, within a reasonable distance to the mutation and with a high level of orthogonality. In order to find a pair for the dual-nickase strategy it was necessary to either extend the distance from the mutation or remove the requirement for the 5'G. For selection of tier 2 gRNAs, the distance restriction was relaxed in some cases such that a longer sequence was scanned, but the 5'G was required for all gRNAs. Whether or not the distance requirement was relaxed depended on how many sites were found within the original search window. Tier 3 uses the same distance restriction as tier 2, but removes the requirement for a 5'G. Note that tiers are non-inclusive (each gRNA is listed only once).

As discussed above, gRNAs were identified for single-gRNA nuclease cleavage as well as for a dual-gRNA paired "nickase" strategy, as indicated.

gRNAs for use with the *N. meningitidis* (Tables 2E) and *S. aureus* (Tables 2D) Cas9s were identified manually by scanning genomic DNA sequence for the presence of PAM sequences. These gRNAs were not separated into tiers, but are provided in single lists for each species.

In a second strategy, Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference: Cas-OFFinder: a fast and versatile algorithm that searches for potential off-target sites of Cas9 RNA-guided endonucleases, Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 18A-18D, 19A-19E, or 20A-20D, e.g., the targeting domains of 18 or more nucleotides may comprise the 17-mer gRNAs described in Tables 18A-18D, 19A-19E, or 20A-20D. Targeting domains, disclosed herein, may comprises the 18-mer described in Tables 18A-18D, 19A-19E, or 20A-20D, e.g., the targeting domains of 19 or more nucleotides may comprise the 18-mer gRNAs described in Tables 18A-18D, 19A-19E, or 20A-20D. Targeting domains, disclosed herein, may comprises the 19-mer described in Tables 18A-18D, 19A-19E, or 20A-20D, e.g., the targeting domains of 20 or more nucleotides may comprise the 19-mer gRNAs described in Tables 18A-18D, 19A-19E, or 20A-20D. Targeting domains, disclosed herein, may comprises the 20-mer gRNAs described in Tables 18A-18D, 19A-19E, or 20A-20D, e.g., the targeting domains of 21 or more nucleotides may comprise the 20-mer gRNAs described in Tables 18A-18D, 19A-19E, or 20A-20D. Targeting domains, disclosed herein, may comprises the 21-mer described in Tables 18A-18D, 19A-19E, or 20A-20D, e.g., the targeting domains of 22 or more nucleotides may comprise the 21-mer gRNAs described in Tables 18A-18D, 19A-19E, or 20A-20D. Targeting domains, disclosed herein, may comprises the 22-mer described in Tables 18A-18D, 19A-19E, or 20A-20D, e.g., the targeting domains of 23 or more nucleotides may comprise the 22-mer gRNAs described in Tables 18A-18D, 19A-19E, or 20A-20D. Targeting domains, disclosed herein, may comprises the 23-mer described in Tables 18A-18D, 19A-19E, or 20A-20D, e.g., the targeting domains of 24 or more nucleotides may comprise the 23-mer gRNAs described in Tables 18A-18D, 19A-19E, or 20A-20D. Targeting domains, disclosed herein, may comprises the 24-mer described in Tables 18A-18D, 19A-19E, or 20A-20D, e.g., the targeting domains of 25 or more nucleotides may comprise the 24-mer gRNAs described in Tables 18A-18D, 19A-19E, or 20A-20D.

gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

In an embodiment, gRNAs were identified and ranked into 4 tiers for *S. pyogenes* (Tables 18A-18D), and *N. meningitidis* (Tables 20A-20DC); and 5 tiers for *S. aureus* (Tables 19A-19D). For *S. pyogenes*, and *N. meningitidis*, the targeting domain for tier 1 gRNA molecules were selected based on (1) distance to a target site, e.g., within 200 bp from a mutation (e.g., I477N), (2) a high level of orthogonality and (3) the presence of 5'G. The targeting domain for tier 2 gRNA molecules were selected based on (1) distance to a target site, e.g., within 200 bp from a mutation (e.g., I477N)

and (2) a high level of orthogonality. The targeting domain for tier 3 gRNA molecules were selected based on (1) distance to a target site, e.g., within 200 bp from a mutation (e.g., I477N) and (2) the presence of 5'G. The targeting domain for tier 4 gRNA molecules were selected based on distance to a target site, e.g., within 200 bp from a mutation (e.g., I477N). For *S. aureus*, the targeting domain for tier 1 gRNA molecules were selected based on (1) distance to a target site, e.g., within 200 bp from a mutation (e.g., I477N), (2) a high level of orthogonality, (3) the presence of 5'G and (4) PAM is NNGRRT. The targeting domain for tier 2 gRNA molecules were selected based on (1) distance to a target site, e.g., within 200 bp from a mutation (e.g., I477N), (2) a high level of orthogonality, and (3) PAM is NNGRRT. The targeting domain for tier 3 gRNA molecules were selected based on (1) distance to a target site, e.g., within 200 bp from a mutation (e.g., I477N), (2) the presence of a 5'G and (2) PAM is NNGRRT. The targeting domain for tier 4 gRNA molecules were selected based on (1) distance to a target site, e.g., within 200 bp from a mutation (e.g., I477N) and (2) PAM is NNGRRT. The targeting domain for tier 5 gRNA molecules were selected based on (1) (1) distance to a target site, e.g., within 200 bp from a mutation (e.g., I477N) and (2) PAM is NNGRRV. Note that tiers are non-inclusive (each gRNA is listed only once for the strategy). In certain instances, no gRNA was identified based on the criteria of the particular tier.

Strategies to Identify gRNAs for *S. pyogenes, S. aureus*, and N. for Correcting a Mutation (e.g., P370L) in the MYOC Gene As an example, three strategies were utilized to identify gRNAs for use with *S. pyogenes, S. aureus* and *N. meningitidis* Cas9 enzymes.

In the first strategy, guide RNAs (gRNAs) for use with the *S. pyogenes* Cas9 (Tables 1A-1C) were identified using the publically available web-based ZiFiT server (Fu et al., Improving CRISPR-Cas nuclease specificity using truncated guide RNAs. Nat Biotechnol. 2014 Jan. 26. doi: 10.1038/nbt.2808. PubMed PMID: 24463574, for the original references see Sander et al., 2007, NAR 35:W599-605; Sander et al., 2010, NAR 38: W462-8). In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMmasker searches input DNA sequences for repeated elements and regions of low complexity. The output is a detailed annotation of the repeats present in a given query sequence. Following identification, gRNAs for use with a *S. pyogenes* Cas9 were ranked into 3 or 4 tiers, as described below.

The gRNAs in tier 1 were selected based on their distance to the target site and their orthogonality in the genome (based on the ZiFiT identification of close matches in the human genome containing an NGG PAM). As an example, for all targets, both 17-mer and 20-mer gRNAs were designed. gRNAs were also selected both for single-gRNA nuclease cutting and for the dual gRNA nickase strategy. Criteria for selecting gRNAs and the determination for which gRNAs can be used for which strategy is based on several considerations:

1. For the dual nickase strategy, gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, it will also often result in indel mutations at the site of only one of the gRNAs. Candidate pair members can be tested for how efficiently they remove the entire sequence versus just causing indel mutations at the site of one gRNA.

While it can be desirable to have gRNAs start with a 5' G, this requirement was relaxed for some gRNAs in tier 1 in order to identify guides in the correct orientation, within a reasonable distance to the mutation and with a high level of orthogonality. In order to find a pair for the dual-nickase strategy it was necessary to either extend the distance from the mutation or remove the requirement for the 5'G. For selection of tier 2 gRNAs, the distance restriction was relaxed in some cases such that a longer sequence was scanned, but the 5'G was required for all gRNAs. Whether or not the distance requirement was relaxed depended on how many sites were found within the original search window. Tier 3 uses the same distance restriction as tier 2, but removes the requirement for a 5'G. Note that tiers are non-inclusive (each gRNA is listed only once).

As discussed above, gRNAs were identified for single-gRNA nuclease cleavage as well as for a dual-gRNA paired "nickase" strategy, as indicated.

gRNAs for use with the *N. meningitidis* (Tables 1E) and *S. aureus* (Tables 1D) Cas9s were identified manually by scanning genomic DNA sequence for the presence of PAM sequences. These gRNAs were not separated into tiers, but are provided in single lists for each species.

In a second strategy, Guide RNAs (gRNAs) for use with *S. pyogenes, S. aureus* and *N. meningitidis* Cas9s were identified using a DNA sequence searching algorithm. Guide RNA design was carried out using a custom guide RNA design software based on the public tool cas-offinder (reference: Cas-OFFinder: a fast and versatile algorithm that searches for potential off-target sites of Cas9 RNA-guided endonucleases, Bioinformatics. 2014 Feb. 17. Bae S, Park J, Kim J S. PMID:24463181). Said custom guide RNA design software scores guides after calculating their genomewide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs were ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT or NNGRRV PAM, and in the case of *N. meningitidis*, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

As an example, for *S. pyogenes* and *N. meningitidis* targets, 17-mer, or 20-mer gRNAs were designed. As another example, for *S. aureus* targets, 18-mer, 19-mer, 20-mer, 21-mer, 22-mer, 23-mer and 24-mer gRNAs were designed. Targeting domains, disclosed herein, may comprise the 17-mer described in Tables 21A-21D, 22A-22E, or 23A-23B, e.g., the targeting domains of 18 or more nucleotides may comprise the 17-mer gRNAs described in Tables 21A-21D, 22A-22E, or 23A-23B. Targeting domains, disclosed herein, may comprises the 18-mer described in Tables 21A-21D, 22A-22E, or 23A-23B, e.g., the targeting domains of 19 or more nucleotides may comprise the 18-mer gRNAs described in Tables 21A-21D, 22A-22E, or 23A-23B. Targeting domains, disclosed herein, may comprises the 19-mer described in Tables 21A-21D, 22A-22E, or 23A-23B, e.g., the targeting domains of 20 or more nucleotides may comprise the 19-mer gRNAs described in Tables 21A-21D, 22A-22E, or 23A-23B. Targeting domains, disclosed herein, may comprises the 20-mer gRNAs described in Tables 21A-21D, 22A-22E, or 23A-23B, e.g., the targeting domains of 21 or more nucleotides may comprise the 20-mer gRNAs described in Tables 21A-21D, 22A-22E, or 23A-23B. Targeting domains, disclosed herein, may comprises the 21-mer described in Tables 21A-21D, 22A-22E, or 23A-23B, e.g., the targeting domains of 22 or more nucleotides may comprise the 21-mer gRNAs described in Tables 21A-21D, 22A-22E, or 23A-23B. Targeting domains, disclosed herein, may comprises the 22-mer described in Tables 21A-21D, 22A-22E, or 23A-23B, e.g., the targeting domains of 23 or more nucleotides may comprise the 22-mer gRNAs described in Tables 21A-21D, 22A-22E, or 23A-23B. Targeting domains, disclosed herein, may comprises the 23-mer described in Tables 21A-21D, 22A-22E, or 23A-23B, e.g., the targeting domains of 24 or more nucleotides may comprise the 23-mer gRNAs described in Tables 21A-21D, 22A-22E, or 23A-23B. Targeting domains, disclosed herein, may comprises the 24-mer described in Tables 21A-21D, 22A-22E, or 23A-23B, e.g., the targeting domains of 25 or more nucleotides may comprise the 24-mer gRNAs described in Tables 21A-21D, 22A-22E, or 23A-23B. gRNAs were identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

In an embodiment, gRNAs were identified and ranked into 4 tiers for *S. pyogenes* (Tables 21A-21D), and *N. meningitidis* (Tables 23A-23B); and 5 tiers for *S. aureus* (Tables 22A-22E). For *S. pyogenes*, and *N. meningitidis*, the targeting domain for tier 1 gRNA molecules were selected based on (1) distance to a target site, e.g., within 200 bp from a mutation (e.g., P370L), (2) a high level of orthogonality and (3) the presence of 5'G. The targeting domain for tier 2 gRNA molecules were selected based on (1) distance to a target site, e.g., within 200 bp from a mutation (e.g., P370L) and (2) a high level of orthogonality. The targeting domain for tier 3 gRNA molecules were selected based on (1) distance to a target site, e.g., within 200 bp from a mutation (e.g., P370L) and (2) the presence of 5'G. The targeting domain for tier 4 gRNA molecules were selected based on distance to a target site, e.g., within 200 bp from a mutation (e.g., P370L). For *S. aureus*, the targeting domain for tier 1 gRNA molecules were selected based on (1) distance to a target site, e.g., within 200 bp from a mutation (e.g., P370L), (2) a high level of orthogonality, (3) the presence of 5'G and (4) PAM is NNGRRT. The targeting domain for tier 2 gRNA molecules were selected based on (1) distance to a target site, e.g., within 200 bp from a mutation (e.g., P370L), (2) a high level of orthogonality, and (3) PAM is NNGRRT. The targeting domain for tier 3 gRNA molecules were selected based on (1) distance to a target site, e.g., within 200 bp from a mutation (e.g., P370L), (2) the presence of a 5'G and (2) PAM is NNGRRT. The targeting domain for tier 4 gRNA molecules were selected based on (1) distance to a target site, e.g., within 200 bp from a mutation (e.g., P370L) and (2) PAM is NNGRRT. The targeting domain for tier 5 gRNA molecules were selected based on (1) (1) distance to a target site, e.g., within 200 bp from a mutation (e.g., P370L) and (2) PAM is NNGRRV. Note that tiers are non-inclusive (each gRNA is listed only once for the strategy). In certain instances, no gRNA was identified based on the criteria of the particular tier.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

Any of the targeting domains in the tables described herein can be used with a Cas9 nickase molecule to generate a single strand break.

Any of the targeting domains in the tables described herein can be used with a Cas9 nuclease molecule to generate a double strand break.

When two gRNAs designed for use to target two Cas9 molecules, one Cas9 can be one species, the second Cas9 can be from a different species. Both Cas9 species are used to generate a single or double-strand break, as desired.

It is contemplated herein that any upstream gRNA described herein may be paired with any downstream gRNA described herein. When an upstream gRNA designed for use with one species of Cas9 is paired with a downstream gRNA designed for use from a different species of Cas9, both Cas9 species are used to generate a single or double-strand break, as desired.

Exemplary Targeting Domains

Table 1A provides exemplary targeting domains for the P370L target site selected according to the first tier parameters, and are selected based on the presence of a 5' G (except for MYOC-37, -46, -48, and -50), close proximity and orientation to mutation and orthogonality in the human genome. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases).

In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, two 20-mer guide RNAs are used to target two *S. pyogenes* Cas9 nucleases or two *S. pyogenes* Cas9 nickases, e.g., MYOC-24 and MYOC-10, MYOC-20 and MYOC-16, or MYOC-24 and MYOC-16 are used. In an embodiment, two 17-mer RNAs are used to target two Cas9 nucleases or two Cas9 nickases, e.g., MYOC-50 and MYOC-32, MYOC-50 and MYOC-37, or MYOC-48 and MYOC-37 are used.

TABLE 1A

1st Tier selected based on the presence of a 5' G (except for #37, 46, 48, 50), close proximity and orientation to mutation and orthogonality in the human genome

| gRNA Name | DNA Strand | Targeting Domain | Target Site Length | SEQ ID NO |
|---|---|---|---|---|
| myoC-8 | − | GGACAGUUCCUGUAUUCUUG | 20 | 387 |
| myoC-10 | − | GUAUUCUUGGGGUGGCUACA | 20 | 388 |
| myoC-16 | − | GGUCAUUUACAGCACCGAUG | 20 | 389 |
| myoC-20 | + | GUGUAGCCACCCCAAGAAUA | 20 | 390 |
| myoC-24 | + | GUCCGUGGUAGCCAGCUCCA | 20 | 391 |
| myoC-27 | − | GAAUACCGAGACAGUGA | 17 | 392 |
| myoC-32 | − | GACAGUUCCUGUAUUCU | 17 | 393 |
| myoC-37 | − | CUACACGGACAUUGACU | 17 | 394 |
| myoC-46 | + | UAGCCACCCCAAGAAUA | 17 | 395 |
| myoC-48 | + | AAUACAGGAACUGUCCG | 17 | 396 |
| myoC-50 | + | CGUGGUAGCCAGCUCCA | 17 | 397 |

Table 1B provides exemplary targeting domains for the P370L target site selected according to the second tier parameters and are selected based on the presence of a 5' G and reasonable proximity to mutation. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 1B

2nd Tier selected based on the presence of a 5' G and reasonable proximity to mutation

| gRNA Name | DNA Strand | Targeting Domain | Target Site Length | SEQ ID NO |
|---|---|---|---|---|
| myoC-1 | − | GCUGAAUACCGAGACAGUGA | 20 | 398 |
| myoC-4 | − | GAGAAGGAAAUCCCUGGAGC | 20 | 399 |
| myoC-13 | − | GACUUGGCUGUGGAUGAAGC | 20 | 400 |
| myoC-28 | − | GACAGUGAAGGCUGAGA | 17 | 401 |
| myoC-38 | − | GGACAUUGACUUGGCUG | 17 | 402 |
| myoC-41 | − | GGAUGAAGCAGGCCUCU | 17 | 403 |
| myoC-44 | + | GGCACCUUUGGCCUCAU | 17 | 404 |

Table 1C provides exemplary targeting domains for the P370L target site selected according to the third tier parameters and are selected based on reasonable proximity to mutation. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 1C

3rd Tier selected based on reasonable proximity to mutation

| gRNA Name | DNA Strand | Targeting Domain | Target Site Length | SEQ ID NO |
|---|---|---|---|---|
| myoC-2 | − | CGAGACAGUGAAGGCUGAGA | 20 | 405 |
| myoC-3 | − | AAGGCUGAGAAGGAAAUCCC | 20 | 406 |
| myoC-5 | − | AUCCCUGGAGCUGGCUACCA | 20 | 407 |
| myoC-6 | − | ACGGACAGUUCCCGUAUUCU | 20 | 408 |
| myoC-7 | − | CGGACAGUUCCCGUAUUCUU | 20 | 409 |
| myoC-9 | − | CAGUUCCCGUAUUCUUGGGG | 20 | 410 |
| myoC-11 | − | UGGCUACACGGACAUUGACU | 20 | 411 |
| myoC-12 | − | CACGGACAUUGACUUGGCUG | 20 | 412 |
| myoC-14 | − | CUGUGGAUGAAGCAGGCCUC | 20 | 413 |

TABLE 1C-continued

| 3rd Tier | | | | |
|---|---|---|---|---|
| | selected based on reasonable proximity to mutation | | | |
| gRNA Name | DNA Strand | Targeting Domain | Target Site Length | SEQ ID NO |
| myoC-15 | − | UGUGGAUGAAGCAGGCCUCU | 20 | 414 |
| myoC-17 | − | UACAGCACCGAUGAGGCCAA | 20 | 415 |
| myoC-18 | + | AAUGGCACCUUUGGCCUCAU | 20 | 416 |
| myoC-19 | + | CGGUGCUGUAAAUGACCCAG | 20 | 417 |
| myoC-21 | + | UGUAGCCACCCCAAGAAUAC | 20 | 418 |
| myoC-22 | + | AAGAAUACGGGAACUGUCCG | 20 | 419 |
| myoC-23 | + | UGUCCGUGGUAGCCAGCUCC | 20 | 420 |
| myoC-25 | + | CUUCUCAGCCUUCACUGUCU | 20 | 421 |
| myoC-26 | + | CUCAUAUCUUAUGACAGUUC | 20 | 422 |
| myoC-29 | − | GCUGAGAAGGAAAUCCC | 17 | 423 |
| myoC-30 | − | AAGGAAAUCCCUGGAGC | 17 | 424 |
| myoC-31 | − | CCUGGAGCUGGCUACCA | 17 | 425 |
| myoC-33 | − | ACAGUUCCCGUAUUCUU | 17 | 426 |
| myoC-34 | − | CAGUUCCCGUAUUCUUG | 17 | 427 |
| myoC-35 | − | UUCCCGUAUUCUUGGGG | 17 | 428 |
| myoC-36 | − | UUCUUGGGGUGGCUACA | 17 | 429 |
| myoC-39 | − | UUGGCUGUGGAUGAAGC | 17 | 430 |
| myoC-40 | − | UGGAUGAAGCAGGCCUC | 17 | 431 |
| myoC-42 | − | CAUUUACAGCACCGAUG | 17 | 432 |
| myoC-43 | − | AGCACCGAUGAGGCCAA | 17 | 433 |
| myoC-45 | + | UGCUGUAAAUGACCCAG | 17 | 434 |
| myoC-47 | + | AGCCACCCCAAGAAUAC | 17 | 435 |
| myoC-49 | + | CCGUGGUAGCCAGCUCC | 17 | 436 |
| myoC-51 | + | CUCAGCCUUCACUGUCU | 17 | 437 |
| myoC-52 | + | AUAUCUUAUGACAGUUC | 17 | 438 |

Table 1D provides exemplary targeting domains for the P370L target site selected based on close proximity to mutation. In an embodiment, the targeting domain is the exact complement of the target domain. Any of the targeting domains in the table can be used with a *S. aureus* Cas9 molecule that gives double stranded cleavage. Any of the targeting domains in the table can be used with *S. aureus* single-stranded break nucleases (nickases). In an embodiment, dual targeting is used to create two nicks. In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 1D

| gRNA Name | DNA Strand | Targeting Domain | Target Site Length | SEQ ID NO |
|---|---|---|---|---|
| myoC-2904 | − | GUCCAGAACUGUCAUAAGAU | 20 | 1806 |
| myoC-2905 | − | GAACUGUCAUAAGAUAUGAG | 20 | 1807 |
| myoC-2906 | − | CAUAAGAUAUGAGCUGAAUA | 20 | 1808 |
| myoC-2907 | − | AUGAGCUGAAUACCGAGACA | 20 | 1809 |
| myoC-2908 | − | GAAUACCGAGACAGUGAAGG | 20 | 1810 |
| myoC-2909 | − | AUACCGAGACAGUGAAGGCU | 20 | 1811 |
| myoC-2910 | − | CCGAGACAGUGAAGGCUGAG | 20 | 1812 |
| myoC-2 | − | CGAGACAGUGAAGGCUGAGA | 20 | 405 |
| myoC-2912 | − | GAAGGCUGAGAAGGAAAUCC | 20 | 1813 |
| myoC-3 | − | AAGGCUGAGAAGGAAAUCCC | 20 | 406 |
| myoC-2914 | − | AAUCCCUGGAGCUGGCUACC | 20 | 1814 |
| myoC-2915 | − | CACGGACAGUUCCCGUAUUC | 20 | 1815 |
| myoC-6 | − | ACGGACAGUUCCCGUAUUCU | 20 | 408 |
| myoC-2917 | − | CGUAUUCUUGGGGUGGCUAC | 20 | 1816 |
| myoC-2918 | − | ACACGGACAUUGACUUGGCU | 20 | 1817 |
| myoC-2919 | − | GGACAUUGACUUGGCUGUGG | 20 | 1818 |
| myoC-2920 | − | GCUGUGGAUGAAGCAGGCCU | 20 | 1819 |
| myoC-2921 | − | CUGGGUCAUUUACAGCACCG | 20 | 1820 |
| myoC-2922 | + | GCUCAUAUCUUAUGACAGUU | 20 | 1821 |
| myoC-23 | + | UGUCCGUGGUAGCCAGCUCC | 20 | 420 |
| myoC-2924 | + | CUGUCCGUGGUAGCCAGCUC | 20 | 1822 |
| myoC-21 | + | UGUAGCCACCCCAAGAAUAC | 20 | 418 |
| myoC-20 | + | GUGUAGCCACCCCAAGAAUA | 20 | 390 |
| myoC-2927 | + | CGUGUAGCCACCCCAAGAAU | 20 | 1823 |
| myoC-2928 | + | AAUGUCCGUGUAGCCACCCC | 20 | 1824 |
| myoC-2929 | + | CAUCGGUGCUGUAAAUGACC | 20 | 1825 |
| myoC-2930 | − | CAGAACUGUCAUAAGAU | 17 | 1826 |
| myoC-2931 | − | CUGUCAUAAGAUAUGAG | 17 | 1827 |
| myoC-2932 | − | AAGAUAUGAGCUGAAUA | 17 | 1828 |
| myoC-2933 | − | AGCUGAAUACCGAGACA | 17 | 1829 |
| myoC-2934 | − | UACCGAGACAGUGAAGG | 17 | 1830 |
| myoC-2935 | − | CCGAGACAGUGAAGGCU | 17 | 1831 |
| myoC-2936 | − | AGACAGUGAAGGCUGAG | 17 | 1832 |
| myoC-28 | − | GACAGUGAAGGCUGAGA | 17 | 401 |
| myoC-2938 | − | GGCUGAGAAGGAAAUCC | 17 | 1833 |
| myoC-29 | − | GCUGAGAAGGAAAUCCC | 17 | 423 |
| myoC-2940 | − | CCCUGGAGCUGGCUACC | 17 | 1834 |
| myoC-2941 | − | GGACAGUUCCCGUAUUC | 17 | 1835 |

TABLE 1D-continued

| gRNA Name | DNA Strand | Targeting Domain | Target Site Length | SEQ ID NO |
|---|---|---|---|---|
| myoC-544 | - | GACAGUUCCCGUAUUCU | 17 | 881 |
| myoC-2943 | - | AUUCUUGGGGUGGCUAC | 17 | 1836 |
| myoC-2944 | - | CGGACAUUGACUUGGCU | 17 | 1837 |
| myoC-2945 | - | CAUUGACUUGGCUGUGG | 17 | 1838 |
| myoC-2946 | - | GUGGAUGAAGCAGGCCU | 17 | 1839 |
| myoC-2947 | - | GGUCAUUUACAGCACCG | 17 | 1840 |
| myoC-2948 | + | CAUAUCUUAUGACAGUU | 17 | 1841 |
| myoC-49 | + | CCGUGGUAGCCAGCUCC | 17 | 436 |
| myoC-2950 | + | UCCGUGGUAGCCAGCUC | 17 | 1842 |
| myoC-47 | + | AGCCACCCCAAGAAUAC | 17 | 435 |
| myoC-46 | + | UAGCCACCCCAAGAAUA | 17 | 395 |
| myoC-2953 | + | GUAGCCACCCCAAGAAU | 17 | 1843 |
| myoC-2954 | + | GUCCGUGUAGCCACCCC | 17 | 1844 |
| myoC-2955 | + | CGGUGCUGUAAAUGACC | 17 | 1845 |

Table 1E provides exemplary targeting domains for the P370L site selected based on close proximity to mutation. In an embodiment, the targeting domain is the exact complement of the target domain. Any of the targeting domains in the table can be used with a *N. meningitidis* Cas9 molecule that gives double stranded cleavage. Any of the targeting domains in the table can be used with *N. meningitidis* single-stranded break nucleases (nickases). In an embodiment, dual targeting is used to create two nicks.

TABLE 1E

| gRNA Name | DNA Strand | Targeting Domain | Target Site Length | SEQ ID NO |
|---|---|---|---|---|
| myoC-2924 | + | CUGUCCGUGGUAGCCAGCUC | 20 | 1822 |
| myoC-2950 | + | UCCGUGGUAGCCAGCUC | 17 | 1842 |

Table 2A provides exemplary targeting domains for the I477N target site selected according to first tier parameters, and are selected based on the presence of a 5' G (except for MYOC-68), close proximity and orientation to mutation and orthogonality in the human genome. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases).

In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, two 20-mer guide RNAs are used to target two *S. pyogenes* Cas9 nucleases or two *S. pyogenes* Cas9 nickases, e.g., MYOC-68 and MYOC-57 are used. In an embodiment, two 17-mer RNAs are used to target two Cas9 nucleases or two Cas9 nickases, e.g., MYOC-87 and MYOC-74, or MYOC-90 and MYOC-74 are used.

TABLE 2A

1st Tier selected based on the presence of a 5' G (except for #68), close proximity and orientation to mutation and orthogonality in the human genome

| gRNA Name | DNA Strand | Targeting Domain | Target Site Length | SEQ ID NO |
|---|---|---|---|---|
| myoC-53 | - | GUCAACUUUGCUUAUGACAC | 20 | 439 |
| myoC-57 | - | GGAGAAGAAGCUCUUUGCCU | 20 | 440 |
| myoC-60 | + | GACCAUGUUCAAGUUGUCCC | 20 | 441 |
| myoC-63 | + | GCAAAGAGCUUCUUCUCCAG | 20 | 442 |
| myoC-68 | + | AUAGCGGUUCUUGAAUGGGA | 20 | 443 |
| myoC-74 | - | GAAUGACUACAACCCCC | 17 | 444 |
| myoC-78 | + | GGAGGCUUUUCACAUCU | 17 | 445 |
| myoC-87 | + | GCGGUUCUUGAAUGGGA | 17 | 446 |
| myoC-90 | + | GUCAUAAGCAAAGUUGA | 17 | 447 |

Table 2B provides exemplary targeting domains for the I477N target site selected according to the second tier parameters and are selected based on the presence of a 5' G and reasonable proximity to mutation. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 2B

2nd Tier selected based on the presence of a 5' G and reasonable proximity to mutation

| gRNA Name | DNA Strand | Targeting Domain | Target Site Length | SEQ ID NO |
|---|---|---|---|---|
| myoC-62 | + | GGCAAAGAGCUUCUUCUCCA | 20 | 448 |
| myoC-69 | + | GGUUCUUGAAUGGGAUGGUC | 20 | 449 |

TABLE 2B-continued

| 2nd Tier | | | | |
|---|---|---|---|---|
| | selected based on the presence of a 5' G and reasonable proximity to mutation | | | |
| gRNA Name | DNA Strand | Targeting Domain | Target Site Length | SEQ ID NO |
| myoC-70 | + | GUUCUUGAAUGGGAUGGUCA | 20 | 450 |
| myoC-73 | - | GCUUAUGACACAGGCAC | 17 | 451 |
| myoC-76 | - | GAAGAAGCUCUUUGCCU | 17 | 452 |

Table 2C provides exemplary targeting domains for the I477N target site selected according to the third tier parameters and are selected based on reasonable proximity to mutation. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 2C

| 3rd Tier | | | | |
|---|---|---|---|---|
| | selected based on reasonable proximity to mutation | | | |
| gRNA Name | DNA Strand | Targeting Domain | Target Site Length | SEQ ID NO |
| myoC-54 | - | UUUGCUUAUGACACAGGCAC | 20 | 453 |
| myoC-55 | - | CAUGAUUGACUACAACCCCC | 20 | 454 |
| myoC-56 | - | UGGAGAAGAAGCUCUUUGCC | 20 | 455 |
| myoC-58 | - | UGCCUGGGACAACUUGAACA | 20 | 456 |
| myoC-59 | + | CUUGGAGGCUUUUCACAUCU | 20 | 457 |
| myoC-61 | + | AGGCAAAGAGCUUCUUCUCC | 20 | 458 |
| myoC-64 | + | CAAAGAGCUUCUUCUCCAGG | 20 | 459 |
| myoC-65 | + | UCAUGCUGCUGUACUUAUAG | 20 | 460 |
| myoC-66 | + | UACUUAUAGCGGUUCUUGAA | 20 | 461 |
| myoC-67 | + | ACUUAUAGCGGUUCUUGAAU | 20 | 462 |
| myoC-71 | + | UGUGUCAUAAGCAAAGUUGA | 20 | 463 |
| myoC-72 | - | AACUUUGCUUAUGACAC | 17 | 464 |
| myoC-75 | - | AGAAGAAGCUCUUUGCC | 17 | 465 |
| myoC-77 | - | CUGGGACAACUUGAACA | 17 | 466 |
| myoC-79 | + | CAUGUUCAAGUUGUCCC | 17 | 467 |

TABLE 2C-continued

| 3rd Tier | | | | |
|---|---|---|---|---|
| | selected based on reasonable proximity to mutation | | | |
| gRNA Name | DNA Strand | Targeting Domain | Target Site Length | SEQ ID NO |
| myoC-80 | + | CAAAGAGCUUCUUCUCC | 17 | 468 |
| myoC-81 | + | AAAGAGCUUCUUCUCCA | 17 | 469 |
| myoC-82 | + | AAGAGCUUCUUCUCCAG | 17 | 470 |
| myoC-83 | + | AGAGCUUCUUCUCCAGG | 17 | 471 |
| myoC-84 | + | UGCUGCUGUACUUAUAG | 17 | 472 |
| myoC-85 | + | UUAUAGCGGUUCUUGAA | 17 | 473 |
| myoC-86 | + | UAUAGCGGUUCUUGAAU | 17 | 474 |
| myoC-88 | + | UCUUGAAUGGGAUGGUC | 17 | 475 |
| myoC-89 | + | CUUGAAUGGGAUGGUCA | 17 | 476 |

Table 2D provides exemplary targeting domains for the I477N target site selected based on close proximity to mutation. In an embodiment, the targeting domain is the exact complement of the target domain. Any of the targeting domains in the table can be used with a *S. aureus* Cas9 molecule that gives double stranded cleavage. Any of the targeting domains in the table can be used with single-stranded break nucleases (nickases). In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 2D

| gRNA Name | DNA Strand | Targeting Domain | Target Site Length | SEQ ID NO |
|---|---|---|---|---|
| myoC-2956 | - | AGACCCUGACCAUCCCAUUC | 20 | 1846 |
| myoC-2957 | - | GCAUGAUUGACUACAACCCC | 20 | 1847 |
| myoC-55 | - | CAUGAUUGACUACAACCCCC | 20 | 454 |
| myoC-2959 | - | UGAUUGACUACAACCCCCUG | 20 | 1848 |
| myoC-2960 | - | UUGACUACAACCCCCUGGAG | 20 | 1849 |
| myoC-2961 | - | CUGGAGAAGAAGCUCUUUGC | 20 | 1850 |
| myoC-56 | - | UGGAGAAGAAGCUCUUUGCC | 20 | 455 |
| myoC-2963 | - | AGCUCUUUGCCUGGGACAAC | 20 | 1851 |
| myoC-2964 | - | GACAUCAAGCUCUCCAAGAU | 20 | 1852 |
| myoC-2965 | + | AAAGUUGACGGUAGCAUCUG | 20 | 1853 |
| myoC-2966 | + | CGGUUCUUGAAUGGGAUGGU | 20 | 1854 |
| myoC-66 | + | UACUUAUAGCGGUUCUUGAA | 20 | 461 |

TABLE 2D-continued

| gRNA Name | DNA Strand | Targeting Domain | Target Site Length | SEQ ID NO |
|---|---|---|---|---|
| myoC-2968 | + | GUACUUAUAGCGGUUCUUGA | 20 | 1855 |
| myoC-2969 | + | UGCUGUACUUAUAGCGGUUC | 20 | 1856 |
| myoC-62 | + | GGCAAAGAGCUUCUUCUCCA | 20 | 448 |
| myoC-61 | + | AGGCAAAGAGCUUCUUCUCC | 20 | 458 |
| myoC-2972 | + | CAGGCAAAGAGCUUCUUCUC | 20 | 1857 |
| myoC-2973 | + | UGUUCAAGUUGUCCCAGGCA | 20 | 1858 |
| myoC-2974 | + | UGGAGGCUUUUCACAUCUUG | 20 | 1859 |
| myoC-59 | + | CUUGGAGGCUUUUCACAUCU | 20 | 457 |
| myoC-2976 | + | GCUUGGAGGCUUUUCACAUC | 20 | 1860 |
| myoC-2977 | - | CCCUGACCAUCCCAUUC | 17 | 1861 |
| myoC-2978 | - | UGAUUGACUACAACCCC | 17 | 1862 |
| myoC-562 | - | GAUUGACUACAACCCCC | 17 | 886 |
| myoC-2980 | - | UUGACUACAACCCCCUG | 17 | 1863 |
| myoC-2981 | - | ACUACAACCCCCUGGAG | 17 | 1864 |
| myoC-2982 | - | GAGAAGAAGCUCUUUGC | 17 | 1865 |
| myoC-75 | - | AGAAGAAGCUCUUUGCC | 17 | 465 |
| myoC-2984 | - | UCUUUGCCUGGGACAAC | 17 | 1866 |
| myoC-2985 | - | AUCAAGCUCUCCAAGAU | 17 | 1867 |
| myoC-2986 | + | GUUGACGGUAGCAUCUG | 17 | 1868 |
| myoC-2987 | + | UUCUUGAAUGGGAUGGU | 17 | 1869 |
| myoC-85 | + | UUAUAGCGGUUCUUGAA | 17 | 473 |
| myoC-2989 | + | CUUAUAGCGGUUCUUGA | 17 | 1870 |
| myoC-2990 | + | UGUACUUAUAGCGGUUC | 17 | 1871 |
| myoC-81 | + | AAAGAGCUUCUUCUCCA | 17 | 469 |
| myoC-80 | + | CAAAGAGCUUCUUCUCC | 17 | 468 |
| myoC-2993 | + | GCAAAGAGCUUCUUCUC | 17 | 1872 |
| myoC-2994 | + | UCAAGUUGUCCCAGGCA | 17 | 1873 |
| myoC-2995 | + | AGGCUUUUCACAUCUUG | 17 | 1874 |
| myoC-78 | + | GGAGGCUUUUCACAUCU | 17 | 445 |
| myoC-2997 | + | UGGAGGCUUUUCACAUC | 17 | 1875 |

Table 2E provides exemplary targeting domains for the I477N target site selected based on close proximity to mutation. In an embodiment, the targeting domain is the exact complement of the target domain. Any of the targeting domains in the table can be used with a *N. meningitidis* Cas9 molecule that gives double stranded cleavage. Any of the targeting domains in the table can be used with single-stranded break nucleases (nickases). In an embodiment, dual targeting is used to create two nicks.

TABLE 2E

| gRNA Name | DNA Strand | Targeting Domain | Target Site Length | SEQ ID NO |
|---|---|---|---|---|
| myoC-3156 | - | GAACCGCUAUAAGUACAGCA | 20 | 2842 |
| myoC-3157 | - | CCGCUAUAAGUACAGCA | 17 | 2843 |

Table 3A provides exemplary targeting domains for the mutational hotspot 477-502 target site selected according to the first tier parameters, and are selected based on the presence of a 5' G (except for MYOC-54 and -1546), close proximity and orientation to mutation and orthogonality in the human genome. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases).

In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

In an embodiment, two 20-mer guide RNAs are used to target two *S. pyogenes* Cas9 nucleases or two *S. pyogenes* Cas9 nickases, e.g., MYOC-1501 and MYOC-54, MYOC-59 and MYOC-1531, MYOC-59 and MYOC-1537, or MYOC-1546 and MYOC-1537 are used. In an embodiment, two 17-mer RNAs are used to target two Cas9 nucleases or two Cas9 nickases, e.g., MYOC-73 and MYOC-1502, or MYOC-1549 and MYOC-78 are used.

For convenience, it is noted that targeting domains for gRNAs MYOC-53, -54, 65-73 and 84-90 are also listed for targeting the I447N mutation. These targeting domains are useful for targeting both a correction of the I447 point mutation and the mutational hotspot 477-502 target site.

TABLE 3A

| 1st Tier | | | | | |
|---|---|---|---|---|---|
| | selected based on the presence of a 5' G (except for #54 and 1546), close proximity and orientation to mutation and orthogonality in the human genome | | | | |
| gRNA Name | DNA Strand | Targeting Domain | Target Site Length | Location | SEQ ID NO |
| myoC-53 | - | GUCAACUUUGCUUAUGACAC | 20 | within 100 bp upstream of hotspot | 439 |
| myoC-54 | - | UUUGCUUAUGACACAGGCAC | 20 | within 100 bp upstream of hotspot | 453 |
| myoC-69 | + | GGUUCUUGAAUGGGAUGGUC | 20 | within 100 bp upstream of hotspot | 449 |
| myoC-437 | + | GUUGACGGUAGCAUCUGCUG | 20 | within 100 bp upstream of hotspot | 788 |
| myoC-73 | - | GCUUAUGACACAGGCAC | 17 | within 100 bp upstream of hotspot | 451 |
| myoC-87 | + | GCGGUUCUUGAAUGGGA | 17 | within 100 bp upstream of hotspot | 446 |
| myoC-599 | + | GACGGUAGCAUCUGCUG | 17 | within 100 bp upstream of hotspot | 907 |
| myoC-405 | - | GAAAAGCCUCCAAGCUGUAC | 20 | within 100 bp downstream of hotspot | 769 |
| myoC-407 | - | GCUGUACAGGCAAUGGCAGA | 20 | within 100 bp downstream of hotspot | 771 |
| myoC-413 | - | GAGAUGCUCAGGGCUCCUGG | 20 | within 100 bp downstream of hotspot | 777 |
| myoC-423 | + | CCAUUGCCUGUACAGCUUGG | 20 | within 100 bp downstream of hotspot | 787 |
| myoC-568 | - | GUACAGGCAAUGGCAGA | 17 | within 100 bp downstream of hotspot | 889 |
| myoC-78 | + | GGAGGCUUUUCACAUCU | 17 | within 100 bp downstream of hotspot | 445 |

Table 3B provides exemplary targeting domains for the mutational hotspot 477-502 target site selected according to the second tier parameters and are selected based on the presence of a 5' G and reasonable proximity to mutation. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 3B

| gRNA Name | DNA Strand | Targeting Domain | Target Site Length | Location | SEQ ID NO |
|---|---|---|---|---|---|
| 2nd Tier | | | | | |
| selected based on the presence of a 5' G and reasonable proximity to mutation | | | | | |
| myoC-70 | + | GUUCUUGAAUGGGAUGGUCA | 20 | within 100 bp upstream of hotspot | 450 |
| myoC-90 | + | GUCAUAAGCAAAGUUGA | 17 | within 100 bp upstream of hotspot | 447 |
| myoC-398 | − | GCCAAUGCCUUCAUCAUCUG | 20 | 100-200 bp upstream of hotspot | 768 |
| myoC-439 | + | GUAGCUGCUGACGGUGUACA | 20 | 100-200 bp upstream of hotspot | 790 |
| myoC-441 | + | GCCACAGAUGAUGAAGGCAU | 20 | 100-200 bp upstream of hotspot | 792 |
| myoC-445 | + | GUUCGAGUUCCAGAUUCUCU | 20 | 100-200 bp upstream of hotspot | 796 |
| myoC-558 | − | GGAACUCGAACAAACCU | 17 | 100-200 bp upstream of hotspot | 884 |
| myoC-601 | + | GCUGCUGACGGUGUACA | 17 | 100-200 bp upstream of hotspot | 909 |
| myoC-602 | + | GGUGCCACAGAUGAUGA | 17 | 100-200 bp upstream of hotspot | 910 |
| myoC-412 | − | GGAGAUGCUCAGGGCUCCUG | 20 | within 100 bp downstream of hotspot | 776 |
| myoC-418 | − | GAAGGGAGAGCCAGCCAGCC | 20 | within 100 bp downstream of hotspot | 782 |
| myoC-569 | − | GGCAGAAGGAGAUGCUC | 17 | within 100 bp downstream of hotspot | 890 |
| myoC-570 | − | GCAGAAGGAGAUGCUCA | 17 | within 100 bp downstream of hotspot | 891 |
| myoC-571 | − | GAGAUGCUCAGGGCUCC | 17 | within 100 bp downstream of hotspot | 892 |
| myoC-573 | − | GAUGCUCAGGGCUCCUG | 17 | within 100 bp downstream of hotspot | 894 |
| myoC-576 | − | GGGCUCCUGGGGGGAGC | 17 | within 100 bp downstream of hotspot | 897 |
| myoC-578 | − | GGGGGGAGCAGGCUGAA | 17 | within 100 bp downstream of hotspot | 899 |
| myoC-579 | − | GGGAGAGCCAGCCAGCC | 17 | within 100 bp downstream of hotspot | 900 |

TABLE 3B-continued

| 2nd Tier | | | | | |
|---|---|---|---|---|---|
| | selected based on the presence of a 5' G and reasonable proximity to mutation | | | | |
| gRNA Name | DNA Strand | Targeting Domain | Target Site Length | Location | SEQ ID NO |
| myoC-580 | − | GGAGAGCCAGCCAGCCA | 17 | within 100 bp downstream of hotspot | 901 |
| myoC-420 | − | GAGCCAGCCAGCCAGGGCCC | 20 | 100-200 bp downstream of hotspot | 784 |
| myoC-510 | + | GGUGACCAUGUUCAUCCUUC | 20 | 100-200 bp downstream of hotspot | 852 |
| myoC-512 | + | GGAAAGCAGUCAAAGCUGCC | 20 | 100-200 bp downstream of hotspot | 854 |
| myoC-513 | + | GAAAGCAGUCAAAGCUGCCU | 20 | 100-200 bp downstream of hotspot | 855 |
| myoC-645 | − | GUUUUCAUUAAUCCAGA | 17 | 100-200 bp downstream of hotspot | 945 |
| myoC-672 | + | GACCAUGUUCAUCCUUC | 17 | 100-200 bp downstream of hotspot | 972 |
| myoC-1591 | + | GCUGCCUGGGCCCUGGC | 17 | 100-200 bp downstream of hotspot | 1801 |

Table 3C provides exemplary targeting domains for the mutational hotspot 477-502 targeting site selected according to the third tier parameters and are selected based on reasonable proximity to mutation. In an embodiment, the targeting domain is the exact complement of the target domain. Any of the targeting domains in the table can be used with a *S. pyogenes* Cas9 molecule that gives double stranded cleavage. Any of the targeting domains in the table can be used with *S. pyogenes* single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 3C

| 3rd Tier | | | | | |
|---|---|---|---|---|---|
| | selected based on the presence of a 5' G and reasonable proximity to Mutation | | | | |
| gRNA Name | DNA Strand | Targeting Domain | Target Site Length | Location | SEQ ID NO |
| myoC-65 | + | UCAUGCUGCUGUACUUAUAG | 20 | within 100 bp upstream of hotspot | 460 |
| myoC-66 | + | UACUUAUAGCGGUUCUUGAA | 20 | within 100 bp upstream of hotspot | 461 |
| myoC-67 | + | ACUUAUAGCGGUUCUUGAAU | 20 | within 100 bp upstream of hotspot | 462 |

TABLE 3C-continued

| gRNA Name | DNA Strand | Targeting Domain | Target Site Length | Location | SEQ ID NO |
|---|---|---|---|---|---|
| 3rd Tier | | | | | |
| | selected based on the presence of a 5' G and reasonable proximity to Mutation | | | | |
| myoC-68 | + | AUAGCGGUUCUUGAAUGGGA | 20 | within 100 bp upstream of hotspot | 443 |
| myoC-71 | + | UGUGUCAUAAGCAAAGUUGA | 20 | within 100 bp upstream of hotspot | 463 |
| myoC-72 | − | AACUUUGCUUAUGACAC | 17 | within 100 bp upstream of hotspot | 464 |
| myoC-84 | + | UGCUGCUGUACUUAUAG | 17 | within 100 bp upstream of hotspot | 472 |
| myoC-85 | + | UUAUAGCGGUUCUUGAA | 17 | within 100 bp upstream of hotspot | 473 |
| myoC-86 | + | UAUAGCGGUUCUUGAAU | 17 | within 100 bp upstream of hotspot | 474 |
| myoC-88 | + | UCUUGAAUGGGAUGGUC | 17 | within 100 bp upstream of hotspot | 475 |
| myoC-89 | + | CUUGAAUGGGAUGGUCA | 17 | within 100 bp upstream of hotspot | 476 |
| myoC-395 | − | CAAACUGAACCCAGAGAAUC | 20 | 100-200 bp upstream of hotspot | 765 |
| myoC-396 | − | AUCUGGAACUCGAACAAACC | 20 | 100-200 bp upstream of hotspot | 766 |
| myoC-397 | − | UCUGGAACUCGAACAAACCU | 20 | 100-200 bp upstream of hotspot | 767 |
| myoC-438 | + | UGCUGAGGUGUAGCUGCUGA | 20 | 100-200 bp upstream of hotspot | 789 |
| myoC-440 | + | CAAGGUGCCACAGAUGAUGA | 20 | 100-200 bp upstream of hotspot | 791 |
| myoC-442 | + | CAUUGGCGACUGACUGCUUA | 20 | 100-200 bp upstream of hotspot | 793 |
| myoC-443 | + | CUUACGGAUGUUUGUCUCCC | 20 | 100-200 bp upstream of hotspot | 794 |
| myoC-444 | + | UGUUCGAGUUCCAGAUUCUC | 20 | 100-200 bp upstream of hotspot | 795 |
| myoC-446 | + | CAGAUUCUCUGGGUUCAGUU | 20 | 100-200 bp upstream of hotspot | 797 |
| myoC-556 | − | ACUGAACCCAGAGAAUC | 17 | 100-200 bp upstream of hotspot | 882 |

TABLE 3C-continued

| 3rd Tier | | | | | |
|---|---|---|---|---|---|
| | selected based on the presence of a 5' G and reasonable proximity to Mutation | | | | |
| gRNA Name | DNA Strand | Targeting Domain | Target Site Length | Location | SEQ ID NO |
| myoC-557 | − | UGGAACUCGAACAAACC | 17 | 100-200 bp upstream of hotspot | 883 |
| myoC-559 | − | AAUGCCUUCAUCAUCUG | 17 | 100-200 bp upstream of hotspot | 885 |
| myoC-600 | + | UGAGGUGUAGCUGCUGA | 17 | 100-200 bp upstream of hotspot | 908 |
| myoC-603 | + | ACAGAUGAUGAAGGCAU | 17 | 100-200 bp upstream of hotspot | 911 |
| myoC-604 | + | UGGCGACUGACUGCUUA | 17 | 100-200 bp upstream of hotspot | 912 |
| myoC-605 | + | ACGGAUGUUUGUCUCCC | 17 | 100-200 bp upstream of hotspot | 913 |
| myoC-606 | + | UCGAGUUCCAGAUUCUC | 17 | 100-200 bp upstream of hotspot | 914 |
| myoC-607 | + | CGAGUUCCAGAUUCUCU | 17 | 100-200 bp upstream of hotspot | 915 |
| myoC-608 | + | AUUCUCUGGGUUCAGUU | 17 | 100-200 bp upstream of hotspot | 916 |
| myoC-406 | − | CCUCCAAGCUGUACAGGCAA | 20 | within 100 bp downstream of hotspot | 770 |
| myoC-408 | − | AAUGGCAGAAGGAGAUGCUC | 20 | within 100 bp downstream of hotspot | 772 |
| myoC-409 | − | AUGGCAGAAGGAGAUGCUCA | 20 | within 100 bp downstream of hotspot | 773 |
| myoC-410 | − | AAGGAGAUGCUCAGGGCUCC | 20 | within 100 bp downstream of hotspot | 774 |
| myoC-411 | − | AGGAGAUGCUCAGGGCUCCU | 20 | within 100 bp downstream of hotspot | 775 |
| myoC-414 | − | AGAUGCUCAGGGCUCCUGGG | 20 | within 100 bp downstream of hotspot | 778 |
| myoC-415 | − | UCAGGGCUCCUGGGGGGAGC | 20 | within 100 bp downstream of hotspot | 779 |
| myoC-416 | − | UCCUGGGGGGAGCAGGCUGA | 20 | within 100 bp downstream of hotspot | 780 |

TABLE 3C-continued

| 3rd Tier | | | | | |
|---|---|---|---|---|---|
| | selected based on the presence of a 5' G and reasonable proximity to Mutation | | | | |
| gRNA Name | DNA Strand | Targeting Domain | Target Site Length | Location | SEQ ID NO |
| myoC-417 | - | CCUGGGGGGAGCAGGCUGAA | 20 | within 100 bp downstream of hotspot | 781 |
| myoC-419 | - | AAGGGAGAGCCAGCCAGCCA | 20 | within 100 bp downstream of hotspot | 783 |
| myoC-59 | + | CUUGGAGGCUUUUCACAUCU | 20 | within 100 bp downstream of hotspot | 457 |
| myoC-421 | + | CCCUUCAGCCUGCUCCCCCC | 20 | within 100 bp downstream of hotspot | 785 |
| myoC-422 | + | CUGCCAUUGCCUGUACAGCU | 20 | within 100 bp downstream of hotspot | 786 |
| myoC-566 | - | AAGCCUCCAAGCUGUAC | 17 | within 100 bp downstream of hotspot | 887 |
| myoC-567 | - | CCAAGCUGUACAGGCAA | 17 | within 100 bp downstream of hotspot | 888 |
| myoC-572 | - | AGAUGCUCAGGGCUCCU | 17 | within 100 bp downstream of hotspot | 893 |
| myoC-574 | - | AUGCUCAGGGCUCCUGG | 17 | within 100 bp downstream of hotspot | 895 |
| myoC-575 | - | UGCUCAGGGCUCCUGGG | 17 | within 100 bp downstream of hotspot | 896 |
| myoC-577 | - | UGGGGGGAGCAGGCUGA | 17 | within 100 bp downstream of hotspot | 898 |
| myoC-583 | + | UUCAGCCUGCUCCCCCC | 17 | within 100 bp downstream of hotspot | 904 |
| myoC-584 | + | CCAUUGCCUGUACAGCU | 17 | within 100 bp downstream of hotspot | 905 |
| myoC-585 | + | UUGCCUGUACAGCUUGG | 17 | within 100 bp downstream of hotspot | 906 |
| myoC-483 | - | CAAGUUUUCAUUAAUCCAGA | 20 | 100-200 bp downstream of hotspot | 825 |
| myoC-484 | - | UUAAUCCAGAAGGAUGAACA | 20 | 100-200 bp downstream of hotspot | 826 |
| myoC-485 | - | UGGUCACCAUCUAACUAUUC | 20 | 100-200 bp downstream of hotspot | 827 |
| myoC-486 | - | UAUUCAGGAAUUGUAGUCUG | 20 | 100-200 bp downstream of hotspot | 828 |

TABLE 3C-continued

| gRNA Name | DNA Strand | Targeting Domain | Target Site Length | Location | SEQ ID NO |
|---|---|---|---|---|---|
| 3rd Tier | | | | | |
| | selected based on the presence of a 5' G and reasonable proximity to Mutation | | | | |
| myoC-487 | − | AUUCAGGAAUUGUAGUCUGA | 20 | 100-200 bp downstream of hotspot | 829 |
| myoC-509 | + | ACAAUUCCUGAAUAGUUAGA | 20 | 100-200 bp downstream of hotspot | 851 |
| myoC-511 | + | CUUCUGGAUUAAUGAAAACU | 20 | 100-200 bp downstream of hotspot | 853 |
| myoC-1576 | + | AGUCAAAGCUGCCUGGGCCC | 20 | 100-200 bp downstream of hotspot | 1802 |
| myoC-1577 | + | AAAGCUGCCUGGGCCCUGGC | 20 | 100-200 bp downstream of hotspot | 1803 |
| myoC-1578 | + | CUGCCUGGGCCCUGGCUGGC | 20 | 100-200 bp downstream of hotspot | 1804 |
| myoC-581 | − | CCAGCCAGCCAGGGCCC | 17 | 100-200 bp downstream of hotspot | 902 |
| myoC-646 | − | AUCCAGAAGGAUGAACA | 17 | 100-200 bp downstream of hotspot | 946 |
| myoC-647 | − | UCACCAUCUAACUAUUC | 17 | 100-200 bp downstream of hotspot | 947 |
| myoC-648 | − | UCAGGAAUUGUAGUCUG | 17 | 100-200 bp downstream of hotspot | 948 |
| myoC-649 | − | CAGGAAUUGUAGUCUGA | 17 | 100-200 bp downstream of hotspot | 949 |
| myoC-671 | + | AUUCCUGAAUAGUUAGA | 17 | 100-200 bp downstream of hotspot | 971 |
| myoC-673 | + | CUGGAUUAAUGAAAACU | 17 | 100-200 bp downstream of hotspot | 973 |
| myoC-674 | + | AAGCAGUCAAAGCUGCC | 17 | 100-200 bp downstream of hotspot | 974 |
| myoC-675 | + | AGCAGUCAAAGCUGCCU | 17 | 100-200 bp downstream of hotspot | 975 |
| myoC-1590 | + | CAAAGCUGCCUGGGCCC | 17 | 100-200 bp downstream of hotspot | 1805 |
| myoC-582 | + | CCUGGGCCCUGGCUGGC | 17 | 100-200 bp downstream of hotspot | 903 |

Table 3D provides exemplary targeting domains for the mutational hotspot 477-502 target site selected based on close proximity to mutation. In an embodiment, the targeting domain is the exact complement of the target domain. Any of the targeting domains in the table can be used with a *S. aureus* Cas9 molecule that gives double stranded cleavage. Any of the targeting domains in the table can be used with *S. aureus* single-stranded break nucleases (nickases). In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 3D

| gRNA Name | DNA Strand | Targeting Domain | Target Site Length | SEQ ID NO |
|---|---|---|---|---|
| myoC-396 | − | AUCUGGAACUCGAACAAACC | 20 | 766 |
| myoC-397 | − | UCUGGAACUCGAACAAACCU | 20 | 767 |
| myoC-2956 | − | AGACCCUGACCAUCCCAUUC | 20 | 1846 |
| myoC-2999 | + | UGUUUGUCUCCCAGGUUUGU | 20 | 2792 |
| myoC-3000 | + | GCAUUGGCGACUGACUGCUU | 20 | 2793 |
| myoC-3001 | + | UGUACAAGGUGCCACAGAUG | 20 | 2794 |
| myoC-2965 | + | AAAGUUGACGGUAGCAUCUG | 20 | 1853 |
| myoC-2966 | + | CGGUUCUUGAAUGGGAUGGU | 20 | 1854 |
| myoC-66 | + | UACUUAUAGCGGUUCUUGAA | 20 | 461 |
| myoC-2968 | + | GUACUUAUAGCGGUUCUUGA | 20 | 1855 |
| myoC-2969 | + | UGCUGUACUUAUAGCGGUUC | 20 | 1856 |
| myoC-3003 | − | CCAAGCUGUACAGGCAAUGG | 20 | 2795 |
| myoC-3004 | − | AGCUGUACAGGCAAUGGCAG | 20 | 2796 |
| myoC-407 | − | GCUGUACAGGCAAUGGCAGA | 20 | 771 |
| myoC-3006 | − | CAAUGGCAGAAGGAGAUGCU | 20 | 2797 |
| myoC-3007 | − | GAAGGAGAUGCUCAGGGCUC | 20 | 2798 |
| myoC-410 | − | AAGGAGAUGCUCAGGGCUCC | 20 | 774 |
| myoC-411 | − | AGGAGAUGCUCAGGGCUCCU | 20 | 775 |
| myoC-412 | − | GGAGAUGCUCAGGGCUCCUG | 20 | 776 |
| myoC-413 | − | GAGAUGCUCAGGGCUCCUGG | 20 | 777 |
| myoC-414 | − | AGAUGCUCAGGGCUCCUGGG | 20 | 778 |
| myoC-3013 | − | GGGCUCCUGGGGGGAGCAGG | 20 | 2799 |
| myoC-3014 | − | CUCCUGGGGGGAGCAGGCUG | 20 | 2800 |
| myoC-416 | − | UCCUGGGGGGAGCAGGCUGA | 20 | 780 |
| myoC-417 | − | CCUGGGGGGAGCAGGCUGAA | 20 | 781 |
| myoC-3017 | − | UGGGGGGAGCAGGCUGAAGG | 20 | 2801 |
| myoC-3018 | − | UGAAGGGAGAGCCAGCCAGC | 20 | 2802 |
| myoC-3019 | − | UUUCCAAGUUUUCAUUAAUC | 20 | 2803 |

TABLE 3D-continued

| gRNA Name | DNA Strand | Targeting Domain | Target Site Length | SEQ ID NO |
|---|---|---|---|---|
| myoC-3020 | − | CCAAGUUUUCAUUAAUCCAG | 20 | 2804 |
| myoC-3021 | − | GUUUUCAUUAAUCCAGAAGG | 20 | 2805 |
| myoC-3022 | − | AUGGUCACCAUCUAACUAUU | 20 | 2806 |
| myoC-485 | − | UGGUCACCAUCUAACUAUUC | 20 | 827 |
| myoC-3024 | − | AACUAUUCAGGAAUUGUAGU | 20 | 2807 |
| myoC-3025 | − | CUAUUCAGGAAUUGUAGUCU | 20 | 2808 |
| myoC-2974 | + | UGGAGGCUUUUCACAUCUUG | 20 | 1859 |
| myoC-59 | + | CUUGGAGGCUUUUCACAUCU | 20 | 457 |
| myoC-2976 | + | GCUUGGAGGCUUUUCACAUC | 20 | 1860 |
| myoC-422 | + | CUGCCAUUGCCUGUACAGCU | 20 | 786 |
| myoC-3030 | + | UCUGCCAUUGCCUGUACAGC | 20 | 2809 |
| myoC-3031 | + | GCCUGCUCCCCCCAGGAGCC | 20 | 2810 |
| myoC-421 | + | CCCUUCAGCCUGCUCCCCCC | 20 | 785 |
| myoC-3033 | + | UCCCUUCAGCCUGCUCCCCC | 20 | 2811 |
| myoC-3034 | + | UGGAAAGCAGUCAAAGCUGC | 20 | 2812 |
| myoC-511 | + | CUUCUGGAUUAAUGAAAACU | 20 | 853 |
| myoC-3036 | + | CCUUCUGGAUUAAUGAAAAC | 20 | 2813 |
| myoC-3037 | + | AUGUUCAUCCUUCUGGAUUA | 20 | 2814 |
| myoC-3038 | + | UGGUGACCAUGUUCAUCCUU | 20 | 2815 |
| myoC-3039 | + | ACGCCCUCAGACUACAAUUC | 20 | 2816 |
| myoC-557 | − | UGGAACUCGAACAAACC | 17 | 883 |
| myoC-558 | − | GGAACUCGAACAAACCU | 17 | 884 |
| myoC-2977 | − | CCCUGACCAUCCCAUUC | 17 | 1861 |
| myoC-3041 | + | UUGUCUCCCAGGUUUGU | 17 | 2817 |
| myoC-3042 | + | UUGGCGACUGACUGCUU | 17 | 2818 |
| myoC-3043 | + | ACAAGGUGCCACAGAUG | 17 | 2819 |
| myoC-2986 | + | GUUGACGGUAGCAUCUG | 17 | 1868 |
| myoC-2987 | + | UUCUUGAAUGGGAUGGU | 17 | 1869 |
| myoC-85 | + | UUAUAGCGGUUCUUGAA | 17 | 473 |
| myoC-2989 | + | CUUAUAGCGGUUCUUGA | 17 | 1870 |
| myoC-2990 | + | UGUACUUAUAGCGGUUC | 17 | 1871 |
| myoC-3045 | − | AGCUGUACAGGCAAUGG | 17 | 2820 |
| myoC-3046 | − | UGUACAGGCAAUGGCAG | 17 | 2821 |
| myoC-568 | − | GUACAGGCAAUGGCAGA | 17 | 889 |
| myoC-3048 | − | UGGCAGAAGGAGAUGCU | 17 | 2822 |
| myoC-3049 | − | GGAGAUGCUCAGGGCUC | 17 | 2823 |
| myoC-571 | − | GAGAUGCUCAGGGCUCC | 17 | 892 |
| myoC-572 | − | AGAUGCUCAGGGCUCCU | 17 | 893 |

TABLE 3D-continued

| gRNA Name | DNA Strand | Targeting Domain | Target Site Length | SEQ ID NO |
|---|---|---|---|---|
| myoC-573 | - | GAUGCUCAGGGCUCCUG | 17 | 894 |
| myoC-574 | - | AUGCUCAGGGCUCCUGG | 17 | 895 |
| myoC-575 | - | UGCUCAGGGCUCCUGGG | 17 | 896 |
| myoC-3055 | - | CUCCUGGGGGGAGCAGG | 17 | 2824 |
| myoC-3056 | - | CUGGGGGGAGCAGGCUG | 17 | 2825 |
| myoC-577 | - | UGGGGGGAGCAGGCUGA | 17 | 898 |
| myoC-578 | - | GGGGGGAGCAGGCUGAA | 17 | 899 |
| myoC-3059 | - | GGGGAGCAGGCUGAAGG | 17 | 2826 |
| myoC-3060 | - | AGGGAGAGCCAGCCAGC | 17 | 2827 |
| myoC-3061 | - | CCAAGUUUUCAUUAAUC | 17 | 2828 |
| myoC-3062 | - | AGUUUUCAUUAAUCCAG | 17 | 2829 |
| myoC-3063 | - | UUCAUUAAUCCAGAAGG | 17 | 2830 |
| myoC-3064 | - | GUCACCAUCUAACUAUU | 17 | 2831 |
| myoC-647 | - | UCACCAUCUAACUAUUC | 17 | 947 |
| myoC-3066 | - | UAUUCAGGAAUUGUAGU | 17 | 2832 |
| myoC-3067 | - | UUCAGGAAUUGUAGUCU | 17 | 2833 |
| myoC-2995 | + | AGGCUUUUCACAUCUUG | 17 | 1874 |
| myoC-78 | + | GGAGGCUUUUCACAUCU | 17 | 445 |
| myoC-2997 | + | UGGAGGCUUUUCACAUC | 17 | 1875 |
| myoC-584 | + | CCAUUGCCUGUACAGCU | 17 | 905 |
| myoC-3072 | + | GCCAUUGCCUGUACAGC | 17 | 2834 |
| myoC-3073 | + | UGCUCCCCCCAGGAGCC | 17 | 2835 |
| myoC-583 | + | UUCAGCCUGCUCCCCCC | 17 | 904 |
| myoC-3075 | + | CUUCAGCCUGCUCCCCC | 17 | 2836 |
| myoC-3076 | + | AAAGCAGUCAAAGCUGC | 17 | 2837 |
| myoC-673 | + | CUGGAUUAAUGAAAACU | 17 | 973 |
| myoC-3078 | + | UCUGGAUUAAUGAAAAC | 17 | 2838 |
| myoC-3079 | + | UUCAUCCUUCUGGAUUA | 17 | 2839 |
| myoC-3080 | + | UGACCAUGUUCAUCCUU | 17 | 2840 |
| myoC-3081 | + | CCCUCAGACUACAAUUC | 17 | 2841 |

Table 3E provides exemplary targeting domains for the mutational hotspot 477-502 target site selected based on close proximity to mutation. In an embodiment, the targeting domain is the exact complement of the target domain. Any of the targeting domains in the table can be used with a *N. meningitidis* Cas9 molecule that gives double stranded cleavage. Any of the targeting domains in the table can be used with *N. meningitidis* single-stranded break nucleases (nickases). In an embodiment, dual targeting is used to create two nicks.

TABLE 3E

| gRNA Name | DNA Strand | Targeting Domain | Target Site Length | SEQ ID NO |
|---|---|---|---|---|
| myoC-3091 | + | AUGGUGACCAUGUUCAUCCU | 20 | 2849 |
| myoC-3097 | + | GUGACCAUGUUCAUCCU | 17 | 2855 |

Table 4A provides exemplary targeting domains for knocking out the MYOC gene selected according to first tier parameters, and are selected based on the presence of a 5' G, close proximity to the start codon (located in exon 1) and orthogonality in the human genome. In an embodiment, the targeting domain is the exact complement of the target domain. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 4A

1st Tier selected based on the presence of a 5' G, close proximity to the start codon (gRNAs located in exon1) and orthogonality in the human genome

| gRNA Name | DNA Strand | Targeting Domain | Target Site Length | SEQ ID NO |
|---|---|---|---|---|
| myoC-91 | - | GUGCACGUUGCUGCAGCUUU | 20 | 477 |
| myoC-93 | - | GCUUCUGGCCUGCCUGGUGU | 20 | 478 |
| myoC-106 | - | GGAAACCCAAACCAGAGAGU | 20 | 479 |
| myoC-108 | - | GUUGGAAAGCAGCAGCCAGG | 20 | 480 |
| myoC-112 | + | GCACAGCCCGAGCAGUGUCU | 20 | 481 |
| myoC-114 | + | GAACUGACUUGUCUCGGAGG | 20 | 482 |
| myoC-116 | + | GUAGGCAGUCUCCAACUCUC | 20 | 483 |
| myoC-117 | + | GCUGGUCCCGCUCCCGCCUC | 20 | 484 |
| myoC-123 | + | GUCGAGCUUUGGUGGCCUCC | 20 | 485 |
| myoC-124 | + | GGCCUCCAGGUCUAAGCGUU | 20 | 486 |
| myoC-127 | + | GCAUCGGCCACUCUGGUCAU | 20 | 487 |
| myoC-129 | - | GCACGUUGCUGCAGCUU | 17 | 488 |
| myoC-147 | - | GACCCGAGACACUGCUC | 17 | 489 |
| myoC-148 | - | GCUCGGGCUGUGCCACC | 17 | 490 |
| myoC-149 | + | GAGCAGUGUCUCGGGUC | 17 | 491 |
| myoC-152 | + | GAACUGACUUGUCUCGG | 17 | 492 |
| myoC-157 | + | GGUCCAAGGUCAAUUGG | 17 | 493 |

TABLE 4A-continued

| 1st Tier | | | | |
|---|---|---|---|---|
| | selected based on the presence of a 5' G, close proximity to the start codon (gRNAs located in exon1) and orthogonality in the human genome | | | |
| gRNA Name | DNA Strand | Targeting Domain | Target Site Length | SEQ ID NO |
| myoC-160 | + | GGAGCUGAGUCGAGCUU | 17 | 494 |
| myoC-161 | + | GCUGAGUCGAGCUUUGG | 17 | 495 |
| myoC-163 | + | GUUAUGGAUGACUGACA | 17 | 496 |
| myoC-167 | + | GCUGGAUUCAUUGGGAC | 17 | 497 |

Table 4B provides exemplary targeting domains for knocking out the MYOC gene selected according to the second tier parameters and are selected based on the presence of a 5' G close proximity to the start codon (located in exon 1). In an embodiment, the targeting domain is the exact complement of the target domain. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 4B

| 2nd Tier | | | | |
|---|---|---|---|---|
| | selected based on the presence of a 5' G and close proximity to the start codon (gRNAs located in exon1) | | | |
| gRNA Name | DNA Strand | Targeting Domain | Target Site Length | SEQ ID NO |
| myoC-92 | − | GCUGCUGCUUCUGGCCUGCC | 20 | 498 |
| myoC-94 | − | GGCCUGCCUGGUGUGGGAUG | 20 | 499 |
| myoC-95 | − | GCCUGCCUGGUGUGGGAUGU | 20 | 500 |
| myoC-96 | − | GGGCCAGGACAGCUCAGCUC | 20 | 501 |
| myoC-97 | − | GGACCAGGCUGCCAGGCCCC | 20 | 502 |
| myoC-98 | − | GGCCCCAGGAGACCCAGGAG | 20 | 503 |
| myoC-99 | − | GACCCAGGAGGGGCUGCAGA | 20 | 504 |
| myoC-100 | − | GGAGGGGCUGCAGAGGGAGC | 20 | 505 |
| myoC-101 | − | GAGGGGCUGCAGAGGGAGCU | 20 | 506 |
| myoC-102 | − | GGGAGCUGGGCACCCUGAGG | 20 | 507 |
| myoC-103 | − | GGAGCUGGGCACCCUGAGGC | 20 | 508 |
| myoC-104 | − | GGGCACCCUGAGGCGGGAGC | 20 | 509 |

TABLE 4B-continued

| 2nd Tier | | | | |
|---|---|---|---|---|
| | selected based on the presence of a 5' G and close proximity to the start codon (gRNAs located in exon1) | | | |
| gRNA Name | DNA Strand | Targeting Domain | Target Site Length | SEQ ID NO |
| myoC-105 | − | GAGGCGGGAGCGGGACCAGC | 20 | 510 |
| myoC-107 | − | GAGGUUGGAAAGCAGCAGCC | 20 | 511 |
| myoC-109 | − | GCAGCAGCCAGGAGGUAGCA | 20 | 512 |
| myoC-110 | − | GGAGGUAGCAAGGCUGAGAA | 20 | 513 |
| myoC-111 | − | GAGGUAGCAAGGCUGAGAAG | 20 | 514 |
| myoC-113 | + | GCUGCUGCUUUCCAACCUCC | 20 | 515 |
| myoC-115 | + | GUCUCGGAGGAGGUUGCUGU | 20 | 516 |
| myoC-118 | + | GCUCCCUCUGCAGCCCCUCC | 20 | 517 |
| myoC-119 | + | GCAGCCCCUCCUGGGUCUCC | 20 | 518 |
| myoC-120 | + | GGGCCUGGCAGCCUGGUCCA | 20 | 519 |
| myoC-121 | + | GGUCCAAGGUCAAUUGGUGG | 20 | 520 |
| myoC-122 | + | GGAGCUGAGUCGAGCUUUGG | 20 | 521 |
| myoC-125 | | GACAUGGCCUGGCUCUGCUC | 20 | 522 |
| myoC-126 | + | GCAGCUGGAUUCAUUGGGAC | 20 | 523 |
| myoC-128 | + | GGCAGGCCAGAAGCAGCAGC | 20 | 524 |
| myoC-130 | − | GCUGCUUCUGGCCUGCC | 17 | 525 |
| myoC-131 | − | GCCUGGUGUGGGAUGUG | 17 | 526 |
| myoC-132 | − | GACAGCUCAGCUCAGGA | 17 | 527 |
| myoC-133 | − | GCCCCAGGAGACCCAGG | 17 | 528 |
| myoC-134 | − | GGGGCUGCAGAGGGAGC | 17 | 529 |
| myoC-135 | − | GGGCUGCAGAGGGAGCU | 17 | 530 |
| myoC-136 | − | GGGAGCUGGGCACCCUG | 17 | 531 |
| myoC-137 | − | GCUGGGCACCCUGAGGC | 17 | 532 |
| myoC-138 | − | GCACCCUGAGGCGGGAG | 17 | 533 |
| myoC-139 | − | GCGGGAGCGGGACCAGC | 17 | 534 |
| myoC-140 | − | GCAAGAAAAUGAGAAUC | 17 | 535 |
| myoC-141 | − | GAAUCUGGCCAGGAGGU | 17 | 536 |
| myoC-142 | − | GUUGGAAAGCAGCAGCC | 17 | 537 |
| myoC-143 | − | GGAAAGCAGCAGCCAGG | 17 | 538 |
| myoC-144 | − | GCAGCCAGGAGGUAGCA | 17 | 539 |
| myoC-145 | − | GGUAGCAAGGCUGAGAA | 17 | 540 |
| myoC-146 | − | GUAGCAAGGCUGAGAAG | 17 | 541 |
| myoC-150 | + | GCAGUGUCUCGGGUCUG | 17 | 542 |
| myoC-151 | + | GCUGCUUUCCAACCUCC | 17 | 543 |
| myoC-153 | + | GGCAGUCUCCAACUCUC | 17 | 544 |

TABLE 4B-continued

| 2nd Tier | | | | |
|---|---|---|---|---|
| | selected based on the presence of a 5' G and close proximity to the start codon (gRNAs located in exon1) | | | |
| gRNA Name | DNA Strand | Targeting Domain | Target Site Length | SEQ ID NO |
| myoC-154 | + | GGUCCCGCUCCCGCCUC | 17 | 545 |
| myoC-155 | + | GUCCCGCUCCCGCCUCA | 17 | 546 |
| myoC-156 | + | GCCCCUCCUGGGUCUCC | 17 | 547 |
| myoC-158 | + | GGUGGAGGAGGCUCUCC | 17 | 548 |
| myoC-159 | + | GUGGAGGAGGCUCUCCA | 17 | 549 |
| myoC-162 | + | GAGCUUUGGUGGCCUCC | 17 | 550 |
| myoC-164 | + | GGAUGACUGACAUGGCC | 17 | 551 |
| myoC-165 | + | GCUCUGCUCUGGGCAGC | 17 | 552 |
| myoC-166 | + | GGGCAGCUGGAUUCAUU | 17 | 553 |
| myoC-168 | + | GGGACUGGCCACACUGA | 17 | 554 |

Table 4C provides exemplary targeting domains for knocking out the MYOC gene selected according to the third tier parameters and are selected to fall within the coding sequence (exon 1, 2 or 3 of the MYOC gene). In an embodiment, the targeting domain is the exact complement of the target domain. Any of the targeting domains in the table can be used with a *S. pyogenes* Cas9 molecule that gives double stranded cleavage. Any of the targeting domains in the table can be used with a *S. pyogenes* Cas9 single-stranded break nucleases (nickases). In an embodiment, dual targeting is used to create two nicks on opposite DNA strands by using *S. pyogenes* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 4C

| 3rd Tier | | | | | |
|---|---|---|---|---|---|
| | Anywhere within coding sequence, does not require 5' G | | | | |
| gRNA Name | DNA Strand | Targeting Domain | Target Site Length | Exon | SEQ ID NO |
| myoC-169 | − | UGUGCACGUUGCUGCAGCUU | 20 | 1 | 555 |
| myoC-170 | − | AGCUGUCCAGCUGCUGCUUC | 20 | 1 | 556 |
| myoC-171 | − | UGCUUCUGGCCUGCCUGGUG | 20 | 1 | 557 |
| myoC-172 | − | CCUGCCUGGUGUGGGAUGUG | 20 | 1 | 558 |
| myoC-173 | − | CUGCCUGGUGUGGGAUGUGG | 20 | 1 | 559 |
| myoC-174 | − | UGGUGUGGGAUGUGGGGGCC | 20 | 1 | 560 |
| myoC-175 | − | CAGGACAGCUCAGCUCAGGA | 20 | 1 | 561 |

TABLE 4C-continued

| 3rd Tier | | | | | |
|---|---|---|---|---|---|
| | Anywhere within coding sequence, does not require 5' G | | | | |
| gRNA Name | DNA Strand | Targeting Domain | Target Site Length | Exon | SEQ ID NO |
| myoC-176 | − | AGGAAGGCCAAUGACCAGAG | 20 | 1 | 562 |
| myoC-177 | − | AUGCCAGUAUACCUUCAGUG | 20 | 1 | 563 |
| myoC-178 | − | CAGCUGCCCAGAGCAGAGCC | 20 | 1 | 564 |
| myoC-179 | − | CAGCACCCAACGCUUAGACC | 20 | 1 | 565 |
| myoC-180 | − | CACCCAACGCUUAGACCUGG | 20 | 1 | 566 |
| myoC-181 | − | CAAAGCUCGACUCAGCUCCC | 20 | 1 | 567 |
| myoC-182 | − | CCUCCUCCACCAAUUGACCU | 20 | 1 | 568 |
| myoC-183 | − | CCACCAAUUGACCUUGGACC | 20 | 1 | 569 |
| myoC-184 | − | UGACCUUGGACCAGGCUGCC | 20 | 1 | 570 |
| myoC-185 | − | UGCCAGGCCCCAGGAGACCC | 20 | 1 | 571 |
| myoC-186 | − | CAGGCCCCAGGAGACCCAGG | 20 | 1 | 572 |
| myoC-187 | − | AGGCCCCAGGAGACCCAGGA | 20 | 1 | 573 |
| myoC-188 | − | AGACCCAGGAGGGGCUGCAG | 20 | 1 | 574 |
| myoC-189 | − | AGAGGGAGCUGGGCACCCUG | 20 | 1 | 575 |
| myoC-190 | − | UGGGCACCCUGAGGCGGGAG | 20 | 1 | 576 |
| myoC-191 | − | CCUCCGAGACAAGUCAGUUC | 20 | 1 | 577 |
| myoC-192 | − | CCGAGACAAGUCAGUUCUGG | 20 | 1 | 578 |
| myoC-193 | − | AGGAAGAGAAGAAGCGACUA | 20 | 1 | 579 |
| myoC-194 | − | AAGGCAAGAAAAUGAGAAUC | 20 | 1 | 580 |
| myoC-195 | − | AAGAAAAUGAGAAUCUGGCC | 20 | 1 | 581 |
| myoC-196 | − | AAAAUGAGAAUCUGGCCAGG | 20 | 1 | 582 |
| myoC-197 | − | UGAGAAUCUGGCCAGGAGGU | 20 | 1 | 583 |
| myoC-198 | − | AGGAGGUAGCAAGGCUGAGA | 20 | 1 | 584 |
| myoC-199 | − | CCCAGACCCGAGACACUGCU | 20 | 1 | 585 |
| myoC-200 | − | CCAGACCCGAGACACUGCUC | 20 | 1 | 586 |
| myoC-201 | − | ACUGCUCGGGCUGUGCCACC | 20 | 1 | 587 |
| myoC-202 | + | CACAGCCCGAGCAGUGUCUC | 20 | 1 | 588 |
| myoC-203 | + | CCCGAGCAGUGUCUCGGGUC | 20 | 1 | 589 |
| myoC-204 | + | CCGAGCAGUGUCUCGGGUCU | 20 | 1 | 590 |
| myoC-205 | + | CGAGCAGUGUCUCGGGUCUG | 20 | 1 | 591 |
| myoC-206 | + | UGUCUCGGGUCUGGGGACAC | 20 | 1 | 592 |
| myoC-207 | + | UUCUCAGCCUUGCUACCUCC | 20 | 1 | 593 |
| myoC-208 | + | CCUCCAGAACUGACUUGUCU | 20 | 1 | 594 |
| myoC-209 | + | CCAGAACUGACUUGUCUCGG | 20 | 1 | 595 |
| myoC-210 | + | CAGUCUCCAACUCUCUGGUU | 20 | 1 | 596 |

TABLE 4C-continued

3rd Tier

Anywhere within coding sequence, does not require 5' G

| gRNA Name | DNA Strand | Targeting Domain | Target Site Length | Exon | SEQ ID NO |
|---|---|---|---|---|---|
| myoC-211 | + | AGUCUCCAACUCUCUGGUUU | 20 | 1 | 597 |
| myoC-212 | + | CUCUGGUUUGGGUUUCCAGC | 20 | 1 | 598 |
| myoC-213 | + | CUGGUCCCGCUCCCGCCUCA | 20 | 1 | 599 |
| myoC-214 | + | CUCCCUCUGCAGCCCCUCCU | 20 | 1 | 600 |
| myoC-215 | + | CAGCCCCUCCUGGGUCUCCU | 20 | 1 | 601 |
| myoC-216 | + | AGCCCCUCCUGGGUCUCCUG | 20 | 1 | 602 |
| myoC-217 | + | CUCCUGGGUCUCCUGGGGCC | 20 | 1 | 603 |
| myoC-218 | + | UCUCCUGGGGCCUGGCAGCC | 20 | 1 | 604 |
| myoC-219 | + | CAGCCUGGUCCAAGGUCAAU | 20 | 1 | 605 |
| myoC-220 | + | CCUGGUCCAAGGUCAAUUGG | 20 | 1 | 606 |
| myoC-221 | + | CCAAGGUCAAUUGGUGGAGG | 20 | 1 | 607 |
| myoC-222 | + | AUUGGUGGAGGAGGCUCUCC | 20 | 1 | 608 |
| myoC-223 | + | UUGGUGGAGGAGGCUCUCCA | 20 | 1 | 609 |
| myoC-224 | + | CAGGGAGCUGAGUCGAGCUU | 20 | 1 | 610 |
| myoC-225 | + | UGGCCUCCAGGUCUAAGCGU | 20 | 1 | 611 |
| myoC-226 | + | UGCUGUCUCUCUGUAAGUUA | 20 | 1 | 612 |
| myoC-227 | + | UAAGUUAUGGAUGACUGACA | 20 | 1 | 613 |
| myoC-228 | + | UAUGGAUGACUGACAUGGCC | 20 | 1 | 614 |
| myoC-229 | + | ACAUGGCCUGGCUCUGCUCU | 20 | 1 | 615 |
| myoC-230 | + | CUGGCUCUGCUCUGGGCAGC | 20 | 1 | 616 |
| myoC-231 | + | CUCUGGGCAGCUGGAUUCAU | 20 | 1 | 617 |
| myoC-232 | + | UCUGGGCAGCUGGAUUCAUU | 20 | 1 | 618 |
| myoC-233 | + | AUUGGGACUGGCCACACUGA | 20 | 1 | 619 |
| myoC-234 | + | UGGCCACACUGAAGGUAUAC | 20 | 1 | 620 |
| myoC-235 | + | CACUGAAGGUAUACUGGCAU | 20 | 1 | 621 |
| myoC-236 | + | UAUACUGGCAUCGGCCACUC | 20 | 1 | 622 |
| myoC-237 | + | CUUCCUGAGCUGAGCUGUCC | 20 | 1 | 623 |
| myoC-238 | + | UGGCCCCCACAUCCCACACC | 20 | 1 | 624 |
| myoC-239 | + | CCCCACAUCCCACACCAGGC | 20 | 1 | 625 |
| myoC-240 | + | AGAAGCAGCAGCUGGACAGC | 20 | 1 | 626 |
| myoC-241 | + | AGCUGGACAGCUGGCAUCUC | 20 | 1 | 627 |
| myoC-242 | − | CACGUUGCUGCAGCUUU | 17 | 1 | 628 |
| myoC-243 | − | UGUCCAGCUGCUGCUUC | 17 | 1 | 629 |
| myoC-244 | − | UUCUGGCCUGCCUGGUG | 17 | 1 | 630 |
| myoC-245 | − | UCUGGCCUGCCUGGUGU | 17 | 1 | 631 |
| myoC-246 | − | CUGCCUGGUGUGGGAUG | 17 | 1 | 632 |
| myoC-247 | − | UGCCUGGUGUGGGAUGU | 17 | 1 | 633 |
| myoC-248 | − | CCUGGUGUGGGAUGUGG | 17 | 1 | 634 |
| myoC-249 | − | UGUGGGAUGUGGGGGCC | 17 | 1 | 635 |
| myoC-250 | − | CCAGGACAGCUCAGCUC | 17 | 1 | 636 |
| myoC-251 | − | AAGGCCAAUGACCAGAG | 17 | 1 | 637 |
| myoC-252 | − | CCAGUAUACCUUCAGUG | 17 | 1 | 638 |
| myoC-253 | − | CUGCCCAGAGCAGAGCC | 17 | 1 | 639 |
| myoC-254 | − | CACCCAACGCUUAGACC | 17 | 1 | 640 |
| myoC-255 | − | CCAACGCUUAGACCUGG | 17 | 1 | 641 |
| myoC-256 | − | AGCUCGACUCAGCUCCC | 17 | 1 | 642 |
| myoC-257 | − | CCUCCACCAAUUGACCU | 17 | 1 | 643 |
| myoC-258 | − | CCAAUUGACCUUGGACC | 17 | 1 | 644 |
| myoC-259 | − | CCUUGGACCAGGCUGCC | 17 | 1 | 645 |
| myoC-260 | − | CCAGGCUGCCAGGCCCC | 17 | 1 | 646 |
| myoC-261 | − | CAGGCCCCAGGAGACCC | 17 | 1 | 647 |
| myoC-262 | − | CCCCAGGAGACCCAGGA | 17 | 1 | 648 |
| myoC-263 | − | CCCAGGAGACCCAGGAG | 17 | 1 | 649 |
| myoC-264 | − | CCCAGGAGGGGCUGCAG | 17 | 1 | 650 |
| myoC-265 | − | CCAGGAGGGGCUGCAGA | 17 | 1 | 651 |
| myoC-266 | − | AGCUGGGCACCCUGAGG | 17 | 1 | 652 |
| myoC-267 | − | CACCCUGAGGCGGGAGC | 17 | 1 | 653 |
| myoC-268 | − | AACCCAAACCAGAGAGU | 17 | 1 | 654 |
| myoC-269 | − | CCGAGACAAGUCAGUUC | 17 | 1 | 655 |
| myoC-270 | − | AGACAAGUCAGUUCUGG | 17 | 1 | 656 |
| myoC-271 | − | AAGAGAAGAAGCGACUA | 17 | 1 | 657 |
| myoC-272 | − | AAAAUGAGAAUCUGGCC | 17 | 1 | 658 |
| myoC-273 | − | AUGAGAAUCUGGCCAGG | 17 | 1 | 659 |
| myoC-274 | − | AGGUAGCAAGGCUGAGA | 17 | 1 | 660 |
| myoC-275 | − | AGACCCGAGACACUGCU | 17 | 1 | 661 |
| myoC-276 | + | CAGCCCGAGCAGUGUCU | 17 | 1 | 662 |
| myoC-277 | + | AGCCCGAGCAGUGUCUC | 17 | 1 | 663 |
| myoC-278 | + | AGCAGUGUCUCGGGUCU | 17 | 1 | 664 |
| myoC-279 | + | CUCGGGUCUGGGGACAC | 17 | 1 | 665 |
| myoC-280 | + | UCAGCCUUGCUACCUCC | 17 | 1 | 666 |
| myoC-281 | + | CCAGAACUGACUUGUCU | 17 | 1 | 667 |

TABLE 4C-continued

3rd Tier

Anywhere within coding sequence, does not require 5' G

| gRNA Name | DNA Strand | Targeting Domain | Target Site Length | Exon | SEQ ID NO |
|---|---|---|---|---|---|
| myoC-282 | + | CUGACUUGUCUCGGAGG | 17 | 1 | 668 |
| myoC-283 | + | UCGGAGGAGGUUGCUGU | 17 | 1 | 669 |
| myoC-284 | + | UCUCCAACUCUCUGGUU | 17 | 1 | 670 |
| myoC-285 | + | CUCCAACUCUCUGGUUU | 17 | 1 | 671 |
| myoC-286 | + | UGGUUUGGGUUUCCAGC | 17 | 1 | 672 |
| myoC-287 | + | CCCUCUGCAGCCCCUCC | 17 | 1 | 673 |
| myoC-288 | + | CCUCUGCAGCCCCUCCU | 17 | 1 | 674 |
| myoC-289 | + | CCCCUCCUGGGUCUCCU | 17 | 1 | 675 |
| myoC-290 | + | CCCUCCUGGGUCUCCUG | 17 | 1 | 676 |
| myoC-291 | + | CUGGGUCUCCUGGGGCC | 17 | 1 | 677 |
| myoC-292 | + | CCUGGGGCCUGGCAGCC | 17 | 1 | 678 |
| myoC-293 | + | CCUGGCAGCCUGGUCCA | 17 | 1 | 679 |
| myoC-294 | + | CCUGGUCCAAGGUCAAU | 17 | 1 | 680 |
| myoC-295 | + | CCAAGGUCAAUUGGUGG | 17 | 1 | 681 |
| myoC-296 | + | AGGUCAAUUGGUGGAGG | 17 | 1 | 682 |
| myoC-297 | + | CCUCCAGGUCUAAGCGU | 17 | 1 | 683 |
| myoC-298 | + | CUCCAGGUCUAAGCGUU | 17 | 1 | 684 |
| myoC-299 | + | UGUCUCUCUGUAAGUUA | 17 | 1 | 685 |
| myoC-300 | + | AUGGCCUGGCUCUGCUC | 17 | 1 | 686 |
| myoC-301 | + | UGGCCUGGCUCUGCUCU | 17 | 1 | 687 |
| myoC-302 | + | UGGGCAGCUGGAUUCAU | 17 | 1 | 688 |
| myoC-303 | + | CCACACUGAAGGUAUAC | 17 | 1 | 689 |
| myoC-304 | + | UGAAGGUAUACUGGCAU | 17 | 1 | 690 |
| myoC-305 | + | ACUGGCAUCGGCCACUC | 17 | 1 | 691 |
| myoC-306 | + | UCGGCCACUCUGGUCAU | 17 | 1 | 692 |
| myoC-307 | + | CCUGAGCUGAGCUGUCC | 17 | 1 | 693 |
| myoC-308 | + | CCCCCACAUCCCACACC | 17 | 1 | 694 |
| myoC-309 | + | CACAUCCCACACCAGGC | 17 | 1 | 695 |
| myoC-310 | + | AGGCCAGAAGCAGCAGC | 17 | 1 | 696 |
| myoC-311 | + | AGCAGCAGCUGGACAGC | 17 | 1 | 697 |
| myoC-312 | + | UGGACAGCUGGCAUCUC | 17 | 1 | 698 |
| myoC-313 | − | CUUUUAAUGCAGUUUCUACG | 20 | 2 | 699 |
| myoC-314 | − | UGCAGUUUCUACGUGGAAUU | 20 | 2 | 700 |
| myoC-315 | − | UACGUGGAAUUUGGACACUU | 20 | 2 | 701 |
| myoC-316 | − | UUUGGACACUUUGGCCUUCC | 20 | 2 | 702 |
| myoC-317 | − | UCCUGCUUCCCGAAUUUUGA | 20 | 2 | 703 |

TABLE 4C-continued

3rd Tier

Anywhere within coding sequence, does not require 5' G

| gRNA Name | DNA Strand | Targeting Domain | Target Site Length | Exon | SEQ ID NO |
|---|---|---|---|---|---|
| myoC-318 | − | AUUUUGAAGGAGAGCCCAUC | 20 | 2 | 704 |
| myoC-319 | − | AGAGCCCAUCUGGCUAUCUC | 20 | 2 | 705 |
| myoC-320 | − | CCAUCUGGCUAUCUCAGGAG | 20 | 2 | 706 |
| myoC-321 | − | UGGCUAUCUCAGGAGUGGAG | 20 | 2 | 707 |
| myoC-322 | − | GGCUAUCUCAGGAGUGGAGA | 20 | 2 | 708 |
| myoC-323 | − | AGGAGUGGAGAGGGAGACAC | 20 | 2 | 709 |
| myoC-324 | + | GAAGAAACUUAACUUCAUAC | 20 | 2 | 710 |
| myoC-325 | + | CCACUCCUGAGAUAGCCAGA | 20 | 2 | 711 |
| myoC-326 | + | CACUCCUGAGAUAGCCAGAU | 20 | 2 | 712 |
| myoC-327 | + | AUGGGCUCUCCUUCAAAAUU | 20 | 2 | 713 |
| myoC-328 | + | UGGGCUCUCCUUCAAAAUUC | 20 | 2 | 714 |
| myoC-329 | + | UCCUUCAAAAUUCGGGAAGC | 20 | 2 | 715 |
| myoC-330 | + | AGCAGGAACUUCAGUUAGCU | 20 | 2 | 716 |
| myoC-331 | + | UUAGCUCGGACUUCAGUUCC | 20 | 2 | 717 |
| myoC-332 | + | CUCGGACUUCAGUUCCUGGA | 20 | 2 | 718 |
| myoC-333 | − | UUAAUGCAGUUUCUACG | 17 | 2 | 719 |
| myoC-334 | − | AGUUUCUACGUGGAAUU | 17 | 2 | 720 |
| myoC-335 | − | GUGGAAUUUGGACACUU | 17 | 2 | 721 |
| myoC-336 | − | GGACACUUUGGCCUUCC | 17 | 2 | 722 |
| myoC-337 | − | UGCUUCCCGAAUUUUGA | 17 | 2 | 723 |
| myoC-338 | − | UUGAAGGAGAGCCCAUC | 17 | 2 | 724 |
| myoC-339 | − | GCCCAUCUGGCUAUCUC | 17 | 2 | 725 |
| myoC-340 | − | UCUGGCUAUCUCAGGAG | 17 | 2 | 726 |
| myoC-341 | − | CUAUCUCAGGAGUGGAG | 17 | 2 | 727 |
| myoC-342 | − | UAUCUCAGGAGUGGAGA | 17 | 2 | 728 |
| myoC-343 | − | AGUGGAGAGGGAGACAC | 17 | 2 | 729 |
| myoC-344 | + | GAAACUUAACUUCAUAC | 17 | 2 | 730 |
| myoC-345 | + | CUCCUGAGAUAGCCAGA | 17 | 2 | 731 |
| myoC-346 | + | UCCUGAGAUAGCCAGAU | 17 | 2 | 732 |
| myoC-347 | + | GGCUCUCCUUCAAAAUU | 17 | 2 | 733 |
| myoC-348 | + | GCUCUCCUUCAAAAUUC | 17 | 2 | 734 |
| myoC-349 | + | UUCAAAAUUCGGGAAGC | 17 | 2 | 735 |
| myoC-350 | + | AGGAACUUCAGUUAGCU | 17 | 2 | 736 |
| myoC-351 | + | GCUCGGACUUCAGUUCC | 17 | 2 | 737 |
| myoC-352 | + | GGACUUCAGUUCCUGGA | 17 | 2 | 738 |

TABLE 4C-continued

| 3rd Tier | | | | | |
|---|---|---|---|---|---|
| | | Anywhere within coding sequence, does not require 5' G | | | |
| gRNA Name | DNA Strand | Targeting Domain | Target Site Length | Exon | SEQ ID NO |
| myoC-353 | – | UUUCUGAAUUUACCAGGAUG | 20 | 3 | 739 |
| myoC-354 | – | CAGGAUGUGGAGAACUAGUU | 20 | 3 | 740 |
| myoC-355 | – | AGGAUGUGGAGAACUAGUUU | 20 | 3 | 741 |
| myoC-356 | – | UGUGGAGAACUAGUUUGGGU | 20 | 3 | 742 |
| myoC-357 | – | AGAACAGCAGAAACAAUUAC | 20 | 3 | 743 |
| myoC-358 | – | GAAACAAUUACUGGCAAGUA | 20 | 3 | 744 |
| myoC-359 | – | UUACUGGCAAGUAUGGUGUG | 20 | 3 | 745 |
| myoC-360 | – | GCCCACCUACCCCUACACCC | 20 | 3 | 746 |
| myoC-361 | – | CCUACACCCAGGAGACCACG | 20 | 3 | 747 |
| myoC-362 | – | ACGUGGAGAAUCGACACAGU | 20 | 3 | 748 |
| myoC-363 | – | GAGAAUCGACACAGUUGGCA | 20 | 3 | 749 |
| myoC-364 | – | AGUUGGCACGGAUGUCCGCC | 20 | 3 | 750 |
| myoC-365 | – | CCUCAUCAGCCAGUUUAUGC | 20 | 3 | 751 |
| myoC-366 | – | CUCAUCAGCCAGUUUAUGCA | 20 | 3 | 752 |
| myoC-367 | – | UAUGCAGGGCUACCCUUCUA | 20 | 3 | 753 |
| myoC-368 | – | CUAAGGUUCACAUACUGCCU | 20 | 3 | 754 |
| myoC-369 | – | UCACAUACUGCCUAGGCCAC | 20 | 3 | 755 |
| myoC-370 | – | GCCUAGGCCACUGGAAAGCA | 20 | 3 | 756 |
| myoC-371 | – | CCUAGGCCACUGGAAAGCAC | 20 | 3 | 757 |
| myoC-372 | – | ACUGGAAAGCACGGGUGCUG | 20 | 3 | 758 |
| myoC-373 | – | CACGGGUGCUGUGGUGUACU | 20 | 3 | 759 |
| myoC-374 | – | ACGGGUGCUGUGGUGUACUC | 20 | 3 | 760 |
| myoC-375 | – | CGGGUGCUGUGGUGUACUCG | 20 | 3 | 761 |
| myoC-376 | – | CUCGGGGAGCCUCUAUUUCC | 20 | 3 | 762 |
| myoC-377 | – | UCGGGGAGCCUCUAUUUCCA | 20 | 3 | 763 |
| myoC-1 | – | GCUGAAUACCGAGACAGUGA | 20 | 3 | 398 |
| myoC-2 | – | CGAGACAGUGAAGGCUGAGA | 20 | 3 | 405 |
| myoC-3 | – | AAGGCUGAGAAGGAAAUCCC | 20 | 3 | 406 |
| myoC-4 | – | GAGAAGGAAAUCCCUGGAGC | 20 | 3 | 399 |
| myoC-5 | – | AUCCCUGGAGCUGGCUACCA | 20 | 3 | 407 |
| myoC-6 | – | ACGGACAGUUCCCGUAUUCU | 20 | 3 | 408 |
| myoC-7 | – | CGGACAGUUCCCGUAUUCUU | 20 | 3 | 409 |
| myoC-385 | – | GGACAGUUCCCGUAUUCUUG | 20 | 3 | 764 |
| myoC-9 | – | CAGUUCCCGUAUUCUUGGGG | 20 | 3 | 410 |
| myoC-10 | – | GUAUUCUUGGGGUGGCUACA | 20 | 3 | 388 |
| myoC-11 | – | UGGCUACACGGACAUUGACU | 20 | 3 | 411 |
| myoC-12 | – | CACGGACAUUGACUUGGCUG | 20 | 3 | 412 |
| myoC-13 | – | GACUUGGCUGUGGAUGAAGC | 20 | 3 | 400 |
| myoC-14 | – | CUGUGGAUGAAGCAGGCCUC | 20 | 3 | 413 |
| myoC-15 | – | UGUGGAUGAAGCAGGCCUCU | 20 | 3 | 414 |
| myoC-16 | – | GGUCAUUUACAGCACCGAUG | 20 | 3 | 389 |
| myoC-17 | – | UACAGCACCGAUGAGGCCAA | 20 | 3 | 415 |
| myoC-395 | – | CAAACUGAACCCAGAGAAUC | 20 | 3 | 765 |
| myoC-396 | – | AUCUGGAACUCGAACAAACC | 20 | 3 | 766 |
| myoC-397 | – | UCUGGAACUCGAACAAACCU | 20 | 3 | 767 |
| myoC-398 | – | GCCAAUGCCUUCAUCAUCUG | 20 | 3 | 768 |
| myoC-53 | – | GUCAACUUUGCUUAUGACAC | 20 | 3 | 439 |
| myoC-54 | – | UUUGCUUAUGACACAGGCAC | 20 | 3 | 453 |
| myoC-55 | – | CAUGAUUGACUACAACCCCC | 20 | 3 | 454 |
| myoC-56 | – | UGGAGAAGAAGCUCUUUGCC | 20 | 3 | 455 |
| myoC-57 | – | GGAGAAGAAGCUCUUUGCCU | 20 | 3 | 440 |
| myoC-58 | – | UGCCUGGGACAACUUGAACA | 20 | 3 | 456 |
| myoC-405 | – | GAAAAGCCUCCAAGCUGUAC | 20 | 3 | 769 |
| myoC-406 | – | CCUCCAAGCUGUACAGGCAA | 20 | 3 | 770 |
| myoC-407 | – | GCUGUACAGGCAAUGGCAGA | 20 | 3 | 771 |
| myoC-408 | – | AAUGGCAGAAGGAGAUGCUC | 20 | 3 | 772 |
| myoC-409 | – | AUGGCAGAAGGAGAUGCUCA | 20 | 3 | 773 |
| myoC-410 | – | AAGGAGAUGCUCAGGGCUCC | 20 | 3 | 774 |
| myoC-411 | – | AGGAGAUGCUCAGGGCUCCU | 20 | 3 | 775 |
| myoC-412 | – | GGAGAUGCUCAGGGCUCCUG | 20 | 3 | 776 |
| myoC-413 | – | GAGAUGCUCAGGGCUCCUGG | 20 | 3 | 777 |
| myoC-414 | – | AGAUGCUCAGGGCUCCUGGG | 20 | 3 | 778 |
| myoC-415 | – | UCAGGGCUCCUGGGGGGAGC | 20 | 3 | 779 |
| myoC-416 | – | UCCUGGGGGGAGCAGGCUGA | 20 | 3 | 780 |
| myoC-417 | – | CCUGGGGGGAGCAGGCUGAA | 20 | 3 | 781 |
| myoC-418 | – | GAAGGGAGAGCCAGCCAGCC | 20 | 3 | 782 |
| myoC-419 | – | AAGGGAGAGCCAGCCAGCCA | 20 | 3 | 783 |
| myoC-420 | – | GAGCCAGCCAGCCAGGGCCC | 20 | 3 | 784 |
| myoC-421 | + | CCCUUCAGCCUGCUCCCCCC | 20 | 3 | 785 |
| myoC-422 | + | CUGCCAUUGCCUGUACAGCU | 20 | 3 | 786 |
| myoC-423 | + | CCAUUGCCUGUACAGCUUGG | 20 | 3 | 787 |

TABLE 4C-continued

3rd Tier

Anywhere within coding sequence, does not require 5' G

| gRNA Name | DNA Strand | Targeting Domain | Target Site Length | Exon | SEQ ID NO |
|---|---|---|---|---|---|
| myoC-59 | + | CUUGGAGGCUUUUCACAUCU | 20 | 3 | 457 |
| myoC-60 | + | GACCAUGUUCAAGUUGUCCC | 20 | 3 | 441 |
| myoC-61 | + | AGGCAAAGAGCUUCUUCUCC | 20 | 3 | 458 |
| myoC-62 | + | GGCAAAGAGCUUCUUCUCCA | 20 | 3 | 448 |
| myoC-63 | + | GCAAAGAGCUUCUUCUCCAG | 20 | 3 | 442 |
| myoC-64 | + | CAAAGAGCUUCUUCUCCAGG | 20 | 3 | 459 |
| myoC-65 | + | UCAUGCUGCUGUACUUAUAG | 20 | 3 | 460 |
| myoC-66 | + | UACUUAUAGCGGUUCUUGAA | 20 | 3 | 461 |
| myoC-67 | + | ACUUAUAGCGGUUCUUGAAU | 20 | 3 | 462 |
| myoC-68 | + | AUAGCGGUUCUUGAAUGGGA | 20 | 3 | 443 |
| myoC-69 | + | GGUUCUUGAAUGGGAUGGUC | 20 | 3 | 449 |
| myoC-70 | + | GUUCUUGAAUGGGAUGGUCA | 20 | 3 | 450 |
| myoC-71 | + | UGUGUCAUAAGCAAAGUUGA | 20 | 3 | 463 |
| myoC-437 | + | GUUGACGGUAGCAUCUGCUG | 20 | 3 | 788 |
| myoC-438 | + | UGCUGAGGUGUAGCUGCUGA | 20 | 3 | 789 |
| myoC-439 | + | GUAGCUGCUGACGGUGUACA | 20 | 3 | 790 |
| myoC-440 | + | CAAGGUGCCACAGAUGAUGA | 20 | 3 | 791 |
| myoC-441 | + | GCCACAGAUGAUGAAGGCAU | 20 | 3 | 792 |
| myoC-442 | + | CAUUGGCGACUGACUGCUUA | 20 | 3 | 793 |
| myoC-443 | + | CUUACGGAUGUUUGUCUCCC | 20 | 3 | 794 |
| myoC-444 | + | UGUUCGAGUUCCAGAUUCUC | 20 | 3 | 795 |
| myoC-445 | + | GUUCGAGUUCCAGAUUCUCU | 20 | 3 | 796 |
| myoC-446 | + | CAGAUUCUCUGGGUUCAGUU | 20 | 3 | 797 |
| myoC-447 | + | UCUCUGGGUUCAGUUUGGAG | 20 | 3 | 798 |
| myoC-448 | + | GUUCAGUUUGGAGAGGACAA | 20 | 3 | 799 |
| myoC-449 | + | GGAGAGGACAAUGGCACCUU | 20 | 3 | 800 |
| myoC-18 | + | AAUGGCACCUUUGGCCUCAU | 20 | 3 | 416 |
| myoC-19 | + | CGGUGCUGUAAAUGACCCAG | 20 | 3 | 417 |
| myoC-20 | + | GUGUAGCCACCCCAAGAAUA | 20 | 3 | 390 |
| myoC-21 | + | UGUAGCCACCCCAAGAAUAC | 20 | 3 | 418 |
| myoC-22 | + | AAGAAUACGGGAACUGUCCG | 20 | 3 | 419 |
| myoC-23 | + | UGUCCGUGGUAGCCAGCUCC | 20 | 3 | 420 |
| myoC-24 | + | GUCCGUGGUAGCCAGCUCCA | 20 | 3 | 391 |
| myoC-25 | + | CUUCUCAGCCUUCACUGUCU | 20 | 3 | 421 |
| myoC-26 | + | CUCAUAUCUUAUGACAGUUC | 20 | 3 | 422 |
| myoC-459 | + | CAGUUCUGGACUCAGCGCCC | 20 | 3 | 801 |

TABLE 4C-continued

3rd Tier

Anywhere within coding sequence, does not require 5' G

| gRNA Name | DNA Strand | Targeting Domain | Target Site Length | Exon | SEQ ID NO |
|---|---|---|---|---|---|
| myoC-460 | + | ACUCAGCGCCCUGGAAAUAG | 20 | 3 | 802 |
| myoC-461 | + | ACAGCACCCGUGCUUUCCAG | 20 | 3 | 803 |
| myoC-462 | + | CCCGUGCUUUCCAGUGGCCU | 20 | 3 | 804 |
| myoC-463 | + | GGCAGUAUGUGAACCUUAGA | 20 | 3 | 805 |
| myoC-464 | + | GCAGUAUGUGAACCUUAGAA | 20 | 3 | 806 |
| myoC-465 | + | AAGGGUAGCCCUGCAUAAAC | 20 | 3 | 807 |
| myoC-466 | + | CCUGCAUAAACUGGCUGAUG | 20 | 3 | 808 |
| myoC-467 | + | UGAGGUCAUACUCAAAAACC | 20 | 3 | 809 |
| myoC-468 | + | GGUCAUACUCAAAAACCUGG | 20 | 3 | 810 |
| myoC-469 | + | AACUGUGUCGAUUCUCCACG | 20 | 3 | 811 |
| myoC-470 | + | CGAUUCUCCACGUGGUCUCC | 20 | 3 | 812 |
| myoC-471 | + | GAUUCUCCACGUGGUCUCCU | 20 | 3 | 813 |
| myoC-472 | + | CCACGUGGUCUCCUGGGUGU | 20 | 3 | 814 |
| myoC-473 | + | CACGUGGUCUCCUGGGUGUA | 20 | 3 | 815 |
| myoC-474 | + | ACGUGGUCUCCUGGGUGUAG | 20 | 3 | 816 |
| myoC-475 | + | GGUCUCCUGGGUGUAGGGGU | 20 | 3 | 817 |
| myoC-476 | + | CUCCUGGGUGUAGGGGUAGG | 20 | 3 | 818 |
| myoC-477 | + | UCCUGGGUGUAGGGGUAGGU | 20 | 3 | 819 |
| myoC-478 | + | GGUGUAGGGGUAGGUGGGCU | 20 | 3 | 820 |
| myoC-479 | + | GUGUAGGGGUAGGUGGGCUU | 20 | 3 | 821 |
| myoC-480 | + | UGUAGGGGUAGGUGGGCUUG | 20 | 3 | 822 |
| myoC-481 | + | UCUGCUGUUCUCAGCGUGAG | 20 | 3 | 823 |
| myoC-482 | + | CAAACUAGUUCUCCACAUCC | 20 | 3 | 824 |
| myoC-483 | − | CAAGUUUUCAUUAAUCCAGA | 20 | 3 | 825 |
| myoC-484 | − | UUAAUCCAGAAGGAUGAACA | 20 | 3 | 826 |
| myoC-485 | − | UGGUCACCAUCUAACUAUUC | 20 | 3 | 827 |
| myoC-486 | − | UAUUCAGGAAUUGUAGUCUG | 20 | 3 | 828 |
| myoC-487 | − | AUUCAGGAAUUGUAGUCUGA | 20 | 3 | 829 |
| myoC-488 | − | UUAUCUUCUGUCAGCAUUUA | 20 | 3 | 830 |
| myoC-489 | − | UAUCUUCUGUCAGCAUUUAU | 20 | 3 | 831 |
| myoC-490 | − | GUUCAAGUUUUCUUGUGAUU | 20 | 3 | 832 |
| myoC-491 | − | UUCAAGUUUUCUUGUGAUUU | 20 | 3 | 833 |
| myoC-492 | − | UCAAGUUUUCUUGUGAUUUG | 20 | 3 | 834 |
| myoC-493 | − | GAUUUGGGGCAAAAGCUGUA | 20 | 3 | 835 |
| myoC-494 | − | CAUUGCUCUUGCAUGUUACA | 20 | 3 | 836 |

TABLE 4C-continued

3rd Tier

Anywhere within coding sequence, does not require 5' G

| gRNA Name | DNA Strand | Targeting Domain | Target Site Length | Exon | SEQ ID NO |
|---|---|---|---|---|---|
| myoC-495 | − | AUAAAAAGCAUAACUUCUAA | 20 | 3 | 837 |
| myoC-496 | − | AGGAAGCAGAAUAGCUCCUC | 20 | 3 | 838 |
| myoC-497 | − | UAAGAUGCAUUUACUACAGU | 20 | 3 | 839 |
| myoC-498 | − | UGCUUCAGAUAGAAUACAGU | 20 | 3 | 840 |
| myoC-499 | − | GCUUCAGAUAGAAUACAGUU | 20 | 3 | 841 |
| myoC-500 | + | AAUUUUAUUUCACAAUGUAA | 20 | 3 | 842 |
| myoC-501 | + | AUUUUAUUUCACAAUGUAAA | 20 | 3 | 843 |
| myoC-502 | + | AUCUUACUUAUAUUCGAUGC | 20 | 3 | 844 |
| myoC-503 | + | UUAUAUUCGAUGCUGGCCAG | 20 | 3 | 845 |
| myoC-504 | + | AGAAGUUAUGCUUUUUAUUG | 20 | 3 | 846 |
| myoC-505 | + | AUGCUUUUUAUUGUGGCUUG | 20 | 3 | 847 |
| myoC-506 | + | CAUGUAACAUGCAAGAGCAA | 20 | 3 | 848 |
| myoC-507 | + | AUGCAAGAGCAAUGGUUUUC | 20 | 3 | 849 |
| myoC-508 | + | UAAAUGCUGACAGAAGAUAA | 20 | 3 | 850 |
| myoC-509 | + | ACAAUUCCUGAAUAGUUAGA | 20 | 3 | 851 |
| myoC-510 | + | GGUGACCAUGUUCAUCCUUC | 20 | 3 | 852 |
| myoC-511 | + | CUUCUGGAUUAAUGAAAACU | 20 | 3 | 853 |
| myoC-512 | + | GGAAAGCAGUCAAAGCUGCC | 20 | 3 | 854 |
| myoC-513 | + | GAAAGCAGUCAAAGCUGCCU | 20 | 3 | 855 |
| myoC-514 | − | CUGAAUUUACCAGGAUG | 17 | 3 | 856 |
| myoC-515 | − | GAUGUGGAGAACUAGUU | 17 | 3 | 857 |
| myoC-516 | − | AUGUGGAGAACUAGUUU | 17 | 3 | 858 |
| myoC-517 | − | GGAGAACUAGUUUGGGU | 17 | 3 | 859 |
| myoC-518 | − | ACAGCAGAAACAAUUAC | 17 | 3 | 860 |
| myoC-519 | − | ACAAUUACUGGCAAGUA | 17 | 3 | 861 |
| myoC-520 | − | CUGGCAAGUAUGGUGUG | 17 | 3 | 862 |
| myoC-521 | − | CACCUACCCCUACACCC | 17 | 3 | 863 |
| myoC-522 | − | ACACCCAGGAGACCACG | 17 | 3 | 864 |
| myoC-523 | − | UGGAGAAUCGACACAGU | 17 | 3 | 865 |
| myoC-524 | − | AAUCGACACAGUUGGCA | 17 | 3 | 866 |
| myoC-525 | − | UGGCACGGAUGUCCGCC | 17 | 3 | 867 |
| myoC-526 | − | CAUCAGCCAGUUUAUGC | 17 | 3 | 868 |
| myoC-527 | − | AUCAGCCAGUUUAUGCA | 17 | 3 | 869 |
| myoC-528 | − | GCAGGGCUACCCUUCUA | 17 | 3 | 870 |
| myoC-529 | − | AGGUUCACAUACUGCCU | 17 | 3 | 871 |
| myoC-530 | − | CAUACUGCCUAGGCCAC | 17 | 3 | 872 |
| myoC-531 | − | UAGGCCACUGGAAAGCA | 17 | 3 | 873 |
| myoC-532 | − | AGGCCACUGGAAAGCAC | 17 | 3 | 874 |
| myoC-533 | − | GGAAAGCACGGGUGCUG | 17 | 3 | 875 |
| myoC-534 | − | GGGUGCUGUGGUGUACU | 17 | 3 | 876 |
| myoC-535 | − | GGUGCUGUGGUGUACUC | 17 | 3 | 877 |
| myoC-536 | − | GUGCUGUGGUGUACUCG | 17 | 3 | 878 |
| myoC-537 | − | GGGGAGCCUCUAUUUCC | 17 | 3 | 879 |
| myoC-538 | − | GGGAGCCUCUAUUUCCA | 17 | 3 | 880 |
| myoC-27 | − | GAAUACCGAGACAGUGA | 17 | 3 | 392 |
| myoC-28 | − | GACAGUGAAGGCUGAGA | 17 | 3 | 401 |
| myoC-29 | − | GCUGAGAAGGAAAUCCC | 17 | 3 | 423 |
| myoC-30 | − | AAGGAAAUCCCUGGAGC | 17 | 3 | 424 |
| myoC-31 | − | CCUGGAGCUGGCUACCA | 17 | 3 | 425 |
| myoC-544 | − | GACAGUUCCCGUAUUCU | 17 | 3 | 881 |
| myoC-33 | − | ACAGUUCCCGUAUUCUU | 17 | 3 | 426 |
| myoC-34 | − | CAGUUCCCGUAUUCUUG | 17 | 3 | 427 |
| myoC-35 | − | UUCCCGUAUUCUUGGGG | 17 | 3 | 428 |
| myoC-36 | − | UUCUUGGGGUGGCUACA | 17 | 3 | 429 |
| myoC-37 | − | CUACACGGACAUUGACU | 17 | 3 | 394 |
| myoC-38 | − | GGACAUUGACUUGGCUG | 17 | 3 | 402 |
| myoC-39 | − | UUGGCUGUGGAUGAAGC | 17 | 3 | 430 |
| myoC-40 | − | UGGAUGAAGCAGGCCUC | 17 | 3 | 431 |
| myoC-41 | − | GGAUGAAGCAGGCCUCU | 17 | 3 | 403 |
| myoC-42 | − | CAUUUACAGCACCGAUG | 17 | 3 | 432 |
| myoC-43 | − | AGCACCGAUGAGGCCAA | 17 | 3 | 433 |
| myoC-556 | − | ACUGAACCCAGAGAAUC | 17 | 3 | 882 |
| myoC-557 | − | UGGAACUCGAACAAACC | 17 | 3 | 883 |
| myoC-558 | − | GGAACUCGAACAAACCU | 17 | 3 | 884 |
| myoC-559 | − | AAUGCCUUCAUCAUCUG | 17 | 3 | 885 |
| myoC-72 | − | AACUUUGCUUAUGACAC | 17 | 3 | 464 |
| myoC-73 | − | GCUUAUGACACAGGCAC | 17 | 3 | 451 |
| myoC-562 | − | GAUUGACUACAACCCCC | 17 | 3 | 886 |
| myoC-75 | − | AGAAGAAGCUCUUUGCC | 17 | 3 | 465 |
| myoC-76 | − | GAAGAAGCUCUUUGCCU | 17 | 3 | 452 |
| myoC-77 | − | CUGGGACAACUUGAACA | 17 | 3 | 466 |

TABLE 4C-continued

3rd Tier

Anywhere within coding sequence, does not require 5' G

| gRNA Name | DNA Strand | Targeting Domain | Target Site Length | Exon | SEQ ID NO |
|---|---|---|---|---|---|
| myoC-566 | − | AAGCCUCCAAGCUGUAC | 17 | 3 | 887 |
| myoC-567 | − | CCAAGCUGUACAGGCAA | 17 | 3 | 888 |
| myoC-568 | − | GUACAGGCAAUGGCAGA | 17 | 3 | 889 |
| myoC-569 | − | GGCAGAAGGAGAUGCUC | 17 | 3 | 890 |
| myoC-570 | − | GCAGAAGGAGAUGCUCA | 17 | 3 | 891 |
| myoC-571 | − | GAGAUGCUCAGGGCUCC | 17 | 3 | 892 |
| myoC-572 | − | AGAUGCUCAGGGCUCCU | 17 | 3 | 893 |
| myoC-573 | − | GAUGCUCAGGGCUCCUG | 17 | 3 | 894 |
| myoC-574 | − | AUGCUCAGGGCUCCUGG | 17 | 3 | 895 |
| myoC-575 | − | UGCUCAGGGCUCCUGGG | 17 | 3 | 896 |
| myoC-576 | − | GGGCUCCUGGGGGGAGC | 17 | 3 | 897 |
| myoC-577 | − | UGGGGGGAGCAGGCUGA | 17 | 3 | 898 |
| myoC-578 | − | GGGGGGAGCAGGCUGAA | 17 | 3 | 899 |
| myoC-579 | − | GGGAGAGCCAGCCAGCC | 17 | 3 | 900 |
| myoC-580 | − | GGAGAGCCAGCCAGCCA | 17 | 3 | 901 |
| myoC-581 | − | CCAGCCAGCCAGGGCCC | 17 | 3 | 902 |
| myoC-582 | + | CCUGGGCCCUGGCUGGC | 17 | 3 | 903 |
| myoC-583 | + | UUCAGCCUGCUCCCCCC | 17 | 3 | 904 |
| myoC-584 | + | CCAUUGCCUGUACAGCU | 17 | 3 | 905 |
| myoC-585 | + | UUGCCUGUACAGCUUGG | 17 | 3 | 906 |
| myoC-78 | + | GGAGGCUUUUCACAUCU | 17 | 3 | 445 |
| myoC-79 | + | CAUGUUCAAGUUGUCCC | 17 | 3 | 467 |
| myoC-80 | + | CAAAGAGCUUCUUCUCC | 17 | 3 | 468 |
| myoC-81 | + | AAAGAGCUUCUUCUCCA | 17 | 3 | 469 |
| myoC-82 | + | AAGAGCUUCUUCUCCAG | 17 | 3 | 470 |
| myoC-83 | + | AGAGCUUCUUCUCCAGG | 17 | 3 | 471 |
| myoC-84 | + | UGCUGCUGUACUUAUAG | 17 | 3 | 472 |
| myoC-85 | + | UUAUAGCGGUUCUUGAA | 17 | 3 | 473 |
| myoC-86 | + | UAUAGCGGUUCUUGAAU | 17 | 3 | 474 |
| myoC-87 | + | GCGGUUCUUGAAUGGGA | 17 | 3 | 446 |
| myoC-88 | + | UCUUGAAUGGGAUGGUC | 17 | 3 | 475 |
| myoC-89 | + | CUUGAAUGGGAUGGUCA | 17 | 3 | 476 |
| myoC-90 | + | GUCAUAAGCAAAGUUGA | 17 | 3 | 447 |
| myoC-599 | + | GACGGUAGCAUCUGCUG | 17 | 3 | 907 |
| myoC-600 | + | UGAGGUGUAGCUGCUGA | 17 | 3 | 908 |
| myoC-601 | + | GCUGCUGACGGUGUACA | 17 | 3 | 909 |

TABLE 4C-continued

3rd Tier

Anywhere within coding sequence, does not require 5' G

| gRNA Name | DNA Strand | Targeting Domain | Target Site Length | Exon | SEQ ID NO |
|---|---|---|---|---|---|
| myoC-602 | + | GGUGCCACAGAUGAUGA | 17 | 3 | 910 |
| myoC-603 | + | ACAGAUGAUGAAGGCAU | 17 | 3 | 911 |
| myoC-604 | + | UGGCGACUGACUGCUUA | 17 | 3 | 912 |
| myoC-605 | + | ACGGAUGUUUGUCUCCC | 17 | 3 | 913 |
| myoC-606 | + | UCGAGUUCCAGAUUCUC | 17 | 3 | 914 |
| myoC-607 | + | CGAGUUCCAGAUUCUCU | 17 | 3 | 915 |
| myoC-608 | + | AUUCUCUGGGUUCAGUU | 17 | 3 | 916 |
| myoC-609 | + | CUGGGUUCAGUUUGGAG | 17 | 3 | 917 |
| myoC-610 | + | CAGUUUGGAGAGGACAA | 17 | 3 | 918 |
| myoC-611 | + | GAGGACAAUGGCACCUU | 17 | 3 | 919 |
| myoC-44 | + | GGCACCUUUGGCCUCAU | 17 | 3 | 404 |
| myoC-45 | + | UGCUGUAAAUGACCCAG | 17 | 3 | 434 |
| myoC-46 | + | UAGCCACCCCAAGAAUA | 17 | 3 | 395 |
| myoC-47 | + | AGCCACCCCAAGAAUAC | 17 | 3 | 435 |
| myoC-616 | + | AAUACGGGAACUGUCCG | 17 | 3 | 920 |
| myoC-49 | + | CCGUGGUAGCCAGCUCC | 17 | 3 | 436 |
| myoC-50 | + | CGUGGUAGCCAGCUCCA | 17 | 3 | 397 |
| myoC-51 | + | CUCAGCCUUCACUGUCU | 17 | 3 | 437 |
| myoC-52 | + | AUAUCUUAUGACAGUUC | 17 | 3 | 438 |
| myoC-621 | + | UUCUGGACUCAGCGCCC | 17 | 3 | 921 |
| myoC-622 | + | CAGCGCCCUGGAAAUAG | 17 | 3 | 922 |
| myoC-623 | + | GCACCCGUGCUUUCCAG | 17 | 3 | 923 |
| myoC-624 | + | GUGCUUUCCAGUGGCCU | 17 | 3 | 924 |
| myoC-625 | + | AGUAUGUGAACCUUAGA | 17 | 3 | 925 |
| myoC-626 | + | GUAUGUGAACCUUAGAA | 17 | 3 | 926 |
| myoC-627 | + | GGUAGCCCUGCAUAAAC | 17 | 3 | 927 |
| myoC-628 | + | GCAUAAACUGGCUGAUG | 17 | 3 | 928 |
| myoC-629 | + | GGUCAUACUCAAAAACC | 17 | 3 | 929 |
| myoC-630 | + | CAUACUCAAAAACCUGG | 17 | 3 | 930 |
| myoC-631 | + | UGUGUCGAUUCUCCACG | 17 | 3 | 931 |
| myoC-632 | + | UUCUCCACGUGGUCUCC | 17 | 3 | 932 |
| myoC-633 | + | UCUCCACGUGGUCUCCU | 17 | 3 | 933 |
| myoC-634 | + | CGUGGUCUCCUGGGUGU | 17 | 3 | 934 |
| myoC-635 | + | GUGGUCUCCUGGGUGUA | 17 | 3 | 935 |
| myoC-636 | + | UGGUCUCCUGGGUGUAG | 17 | 3 | 936 |

TABLE 4C-continued

3rd Tier

Anywhere within coding sequence, does not require 5' G

| gRNA Name | DNA Strand | Targeting Domain | Target Site Length | Exon | SEQ ID NO |
|---|---|---|---|---|---|
| myoC-637 | + | CUCCUGGGUGUAGGGGU | 17 | 3 | 937 |
| myoC-638 | + | CUGGGUGUAGGGGUAGG | 17 | 3 | 938 |
| myoC-639 | + | UGGGUGUAGGGGUAGGU | 17 | 3 | 939 |
| myoC-640 | + | GUAGGGGUAGGUGGGCU | 17 | 3 | 940 |
| myoC-641 | + | UAGGGGUAGGUGGGCUU | 17 | 3 | 941 |
| myoC-642 | + | AGGGGUAGGUGGGCUUG | 17 | 3 | 942 |
| myoC-643 | + | GCUGUUCUCAGCGUGAG | 17 | 3 | 943 |
| myoC-644 | + | ACUAGUUCUCCACAUCC | 17 | 3 | 944 |
| myoC-645 | − | GUUUUCAUUAAUCCAGA | 17 | 3 | 945 |
| myoC-646 | − | AUCCAGAAGGAUGAACA | 17 | 3 | 946 |
| myoC-647 | − | UCACCAUCUAACUAUUC | 17 | 3 | 947 |
| myoC-648 | − | UCAGGAAUUGUAGUCUG | 17 | 3 | 948 |
| myoC-649 | − | CAGGAAUUGUAGUCUGA | 17 | 3 | 949 |
| myoC-650 | − | UCUUCUGUCAGCAUUUA | 17 | 3 | 950 |
| myoC-651 | − | CUUCUGUCAGCAUUUAU | 17 | 3 | 951 |
| myoC-652 | − | CAAGUUUUCUUGUGAUU | 17 | 3 | 952 |
| myoC-653 | − | AAGUUUUCUUGUGAUUU | 17 | 3 | 953 |
| myoC-654 | − | AGUUUUCUUGUGAUUUG | 17 | 3 | 954 |
| myoC-655 | − | UUGGGGCAAAAGCUGUA | 17 | 3 | 955 |
| myoC-656 | − | UGCUCUUGCAUGUUACA | 17 | 3 | 956 |
| myoC-657 | − | AAAAGCAUAACUUCUAA | 17 | 3 | 957 |
| myoC-658 | − | AAGCAGAAUAGCUCCUC | 17 | 3 | 958 |
| myoC-659 | − | GAUGCAUUUACUACAGU | 17 | 3 | 959 |
| myoC-660 | − | UUCAGAUAGAAUACAGU | 17 | 3 | 960 |
| myoC-661 | − | UCAGAUAGAAUACAGUU | 17 | 3 | 961 |
| myoC-662 | + | UUUAUUUCACAAUGUAA | 17 | 3 | 962 |
| myoC-663 | + | UUAUUUCACAAUGUAAA | 17 | 3 | 963 |
| myoC-664 | + | UUACUUAUAUUCGAUGC | 17 | 3 | 964 |
| myoC-665 | + | UAUUCGAUGCUGGCCAG | 17 | 3 | 965 |
| myoC-666 | + | AGUUAUGCUUUUUAUUG | 17 | 3 | 966 |
| myoC-667 | + | CUUUUUAUUGUGGCUUG | 17 | 3 | 967 |
| myoC-668 | + | GUAACAUGCAAGAGCAA | 17 | 3 | 968 |
| myoC-669 | + | CAAGAGCAAUGGUUUUC | 17 | 3 | 969 |
| myoC-670 | + | AUGCUGACAGAAGAUAA | 17 | 3 | 970 |
| myoC-671 | + | AUUCCUGAAUAGUUAGA | 17 | 3 | 971 |
| myoC-672 | + | GACCAUGUUCAUCCUUC | 17 | 3 | 972 |
| myoC-673 | + | CUGGAUUAAUGAAAACU | 17 | 3 | 973 |
| myoC-674 | + | AAGCAGUCAAAGCUGCC | 17 | 3 | 974 |
| myoC-675 | + | AGCAGUCAAAGCUGCCU | 17 | 3 | 975 |

Table 4D provides exemplary targeting domains for knocking out the MYOC gene. In an embodiment, the targeting domain is the exact complement of the target domain. Any of the targeting domains in the table can be used with a *S. aureus* Cas9 molecule that gives double stranded cleavage. Any of the targeting domains in the table can be used with a *S. aureus* Cas9 single-stranded break nucleases (nickases). In an embodiment, dual targeting is used to create two nicks on opposite DNA strands by using *S. aureus* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 4D

| gRNA Name | DNA Strand | Targeting Domain | Target Site Length | SEQ ID NO |
|---|---|---|---|---|
| myoC-1592 | − | AGCCUCACCAAGCCUCUGCA | 20 | 1876 |
| myoC-1593 | − | CUGUGCACGUUGCUGCAGCU | 20 | 1877 |
| myoC-1594 | − | ACGUUGCUGCAGCUUUGGGC | 20 | 1878 |
| myoC-1595 | − | CUGCUUCUGGCCUGCCUGGU | 20 | 1879 |
| myoC-171 | − | UGCUUCUGGCCUGCCUGGUG | 20 | 557 |
| myoC-1597 | − | UGGCCUGCCUGGUGUGGGAU | 20 | 1880 |
| myoC-94 | − | GGCCUGCCUGGUGUGGGAUG | 20 | 499 |
| myoC-95 | − | GCCUGCCUGGUGUGGGAUGU | 20 | 500 |
| myoC-1600 | − | CUGGUGUGGGAUGUGGGGGC | 20 | 1881 |
| myoC-1601 | − | GGGGCCAGGACAGCUCAGCU | 20 | 1882 |
| myoC-96 | − | GGGCCAGGACAGCUCAGCUC | 20 | 501 |
| myoC-1603 | − | AGCUCAGGAAGGCCAAUGAC | 20 | 1883 |
| myoC-1604 | − | CUUCAGUGUGGCCAGUCCCA | 20 | 1884 |
| myoC-1605 | − | UCCCAAUGAAUCCAGCUGCC | 20 | 1885 |
| myoC-1606 | − | AUGAAUCCAGCUGCCCAGAG | 20 | 1886 |
| myoC-1607 | − | UGUCAGUCAUCCAUAACUUA | 20 | 1887 |
| myoC-1608 | − | UCAGUCAUCCAUAACUUACA | 20 | 1888 |
| myoC-1609 | − | GCAGCACCCAACGCUUAGAC | 20 | 1889 |

TABLE 4D-continued

| gRNA Name | DNA Strand | Targeting Domain | Target Site Length | SEQ ID NO |
|---|---|---|---|---|
| myoC-179 | - | CAGCACCCAACGCUUAGACC | 20 | 565 |
| myoC-1611 | - | CCAAAGCUCGACUCAGCUCC | 20 | 1890 |
| myoC-181 | - | CAAAGCUCGACUCAGCUCCC | 20 | 567 |
| myoC-1613 | - | AAGCUCGACUCAGCUCCCUG | 20 | 1891 |
| myoC-1614 | - | GCCUCCUCCACCAAUUGACC | 20 | 1892 |
| myoC-1615 | - | UGGACCAGGCUGCCAGGCCC | 20 | 1893 |
| myoC-97 | - | GGACCAGGCUGCCAGGCCCC | 20 | 502 |
| myoC-1617 | - | CUGCCAGGCCCCAGGAGACC | 20 | 1894 |
| myoC-185 | - | UGCCAGGCCCCAGGAGACCC | 20 | 571 |
| myoC-1619 | - | CCAGGCCCCAGGAGACCCAG | 20 | 1895 |
| myoC-186 | - | CAGGCCCCAGGAGACCCAGG | 20 | 572 |
| myoC-1621 | - | AGGAGACCCAGGAGGGGCUG | 20 | 1896 |
| myoC-1622 | - | GAGACCCAGGAGGGGCUGCA | 20 | 1897 |
| myoC-188 | - | AGACCCAGGAGGGGCUGCAG | 20 | 574 |
| myoC-99 | - | GACCCAGGAGGGGCUGCAGA | 20 | 504 |
| myoC-1625 | - | AGGAGGGGCUGCAGAGGGAG | 20 | 1898 |
| myoC-1626 | - | UGCAGAGGGAGCUGGGCACC | 20 | 1899 |
| myoC-1627 | - | AGGGAGCUGGGCACCCUGAG | 20 | 1900 |
| myoC-102 | - | GGGAGCUGGGCACCCUGAGG | 20 | 507 |
| myoC-103 | - | GGAGCUGGGCACCCUGAGGC | 20 | 508 |
| myoC-1630 | - | CUGGGCACCCUGAGGCGGGA | 20 | 1901 |
| myoC-190 | - | UGGGCACCCUGAGGCGGGAG | 20 | 576 |
| myoC-1632 | - | UGAGGCGGGAGCGGGACCAG | 20 | 1902 |
| myoC-105 | - | GAGGCGGGAGCGGGACCAGC | 20 | 510 |
| myoC-1634 | - | GACCAGCUGGAAACCCAAAC | 20 | 1903 |
| myoC-1635 | - | CCAGCUGGAAACCCAAACCA | 20 | 1904 |
| myoC-1636 | - | UGGAAACCCAAACCAGAGAG | 20 | 1905 |
| myoC-106 | - | GGAAACCCAAACCAGAGAGU | 20 | 479 |
| myoC-1638 | - | ACUGCCUACAGCAACCUCCU | 20 | 1906 |
| myoC-1639 | - | UCCUCCGAGACAAGUCAGUU | 20 | 1907 |
| myoC-191 | - | CCUCCGAGACAAGUCAGUUC | 20 | 577 |
| myoC-1641 | - | UCCGAGACAAGUCAGUUCUG | 20 | 1908 |
| myoC-192 | - | CCGAGACAAGUCAGUUCUGG | 20 | 578 |
| myoC-1643 | - | AGACAAGUCAGUUCUGGAGG | 20 | 1909 |
| myoC-1644 | - | ACAAGUCAGUUCUGGAGGAA | 20 | 1910 |
| myoC-1645 | - | AGUCAGUUCUGGAGGAAGAG | 20 | 1911 |
| myoC-1646 | - | AGAGAAGAAGCGACUAAGGC | 20 | 1912 |
| myoC-1647 | - | GAAGCGACUAAGGCAAGAAA | 20 | 1913 |
| myoC-1648 | - | AGCGACUAAGGCAAGAAAAU | 20 | 1914 |
| myoC-1649 | - | CAAGAAAAUGAGAAUCUGGC | 20 | 1915 |
| myoC-195 | - | AAGAAAAUGAGAAUCUGGCC | 20 | 581 |
| myoC-1651 | - | AUGAGAAUCUGGCCAGGAGG | 20 | 1916 |
| myoC-197 | - | UGAGAAUCUGGCCAGGAGGU | 20 | 583 |
| myoC-1653 | - | GGAGGUUGGAAAGCAGCAGC | 20 | 1917 |
| myoC-107 | - | GAGGUUGGAAAGCAGCAGCC | 20 | 511 |
| myoC-1655 | - | GCAGCCAGGAGGUAGCAAGG | 20 | 1918 |
| myoC-1656 | - | AGCCAGGAGGUAGCAAGGCU | 20 | 1919 |
| myoC-1657 | - | CAGGAGGUAGCAAGGCUGAG | 20 | 1920 |
| myoC-198 | - | AGGAGGUAGCAAGGCUGAGA | 20 | 584 |
| myoC-1659 | - | AGGGGCCAGUGUCCCCAGAC | 20 | 1921 |
| myoC-1660 | - | CCCCAGACCCGAGACACUGC | 20 | 1922 |
| myoC-1661 | - | CGGGCUGUGCCACCAGGCUC | 20 | 1923 |
| myoC-1662 | - | GGCUGUGCCACCAGGCUCCA | 20 | 1924 |
| myoC-1663 | + | AACCUCAUUGCAGAGGCUUG | 20 | 1925 |
| myoC-1664 | + | UGCACAGAAGAACCUCAUUG | 20 | 1926 |
| myoC-1665 | + | AGCUGCAGCAACGUGCACAG | 20 | 1927 |
| myoC-1666 | + | CAAAGCUGCAGCAACGUGCA | 20 | 1928 |
| myoC-1667 | + | AGGCAGGCCAGAAGCAGCAG | 20 | 1929 |
| myoC-1668 | + | ACAUCCCACACCAGGCAGGC | 20 | 1930 |
| myoC-1669 | + | UGGUCAUUGGCCUUCCUGAG | 20 | 1931 |
| myoC-1670 | + | CACUCUGGUCAUUGGCCUUC | 20 | 1932 |
| myoC-1671 | + | AUUCAUUGGGACUGGCCACA | 20 | 1933 |
| myoC-231 | + | CUCUGGGCAGCUGGAUUCAU | 20 | 617 |
| myoC-1673 | + | GCUCUGGGCAGCUGGAUUCA | 20 | 1934 |
| myoC-1674 | + | CCUGGCUCUGCUCUGGGCAG | 20 | 1935 |
| myoC-1675 | + | UGACAUGGCCUGGCUCUGCU | 20 | 1936 |
| myoC-1676 | + | CUGCUGUCUCUCUGUAAGUU | 20 | 1937 |
| myoC-1677 | + | GUGGCCUCCAGGUCUAAGCG | 20 | 1938 |
| myoC-1678 | + | AGGCUCUCCAGGGAGCUGAG | 20 | 1939 |
| myoC-1679 | + | GGAGGAGGCUCUCCAGGGAG | 20 | 1940 |
| myoC-223 | + | UUGGUGGAGGAGGCUCUCCA | 20 | 609 |
| myoC-222 | + | AUUGGUGGAGGAGGCUCUCC | 20 | 608 |
| myoC-1682 | + | AAUUGGUGGAGGAGGCUCUC | 20 | 1941 |
| myoC-121 | + | GGUCCAAGGUCAAUUGGUGG | 20 | 520 |
| myoC-1684 | + | UGGUCCAAGGUCAAUUGGUG | 20 | 1942 |
| myoC-220 | + | CCUGGUCCAAGGUCAAUUGG | 20 | 606 |

TABLE 4D-continued

| gRNA Name | DNA Strand | Targeting Domain | Target Site Length | SEQ ID NO |
|---|---|---|---|---|
| myoC-1686 | + | GCCUGGUCCAAGGUCAAUUG | 20 | 1943 |
| myoC-119 | + | GCAGCCCCUCCUGGGUCUCC | 20 | 518 |
| myoC-1688 | + | UGCAGCCCCUCCUGGGUCUC | 20 | 1944 |
| myoC-1689 | + | AGCUCCCUCUGCAGCCCCUC | 20 | 1945 |
| myoC-1690 | + | AGCUGGUCCCGCUCCCGCCU | 20 | 1946 |
| myoC-1691 | + | GCAGUCUCCAACUCUCUGGU | 20 | 1947 |
| myoC-209 | + | CCAGAACUGACUUGUCUCGG | 20 | 595 |
| myoC-1693 | + | UCCAGAACUGACUUGUCUCG | 20 | 1948 |
| myoC-208 | + | CCUCCAGAACUGACUUGUCU | 20 | 594 |
| myoC-1695 | + | UCCUCCAGAACUGACUUGUC | 20 | 1949 |
| myoC-1696 | + | AGUCGCUUCUUCUCUUCCUC | 20 | 1950 |
| myoC-204 | + | CCGAGCAGUGUCUCGGGUCU | 20 | 590 |
| myoC-203 | + | CCCGAGCAGUGUCUCGGGUC | 20 | 589 |
| myoC-1699 | + | GCCCGAGCAGUGUCUCGGGU | 20 | 1951 |
| myoC-1700 | + | GGCACAGCCCGAGCAGUGUC | 20 | 1952 |
| myoC-1701 | + | CUGGAGCCUGGUGGCACAGC | 20 | 1953 |
| myoC-1702 | − | CUCACCAAGCCUCUGCA | 17 | 1954 |
| myoC-1703 | − | UGCACGUUGCUGCAGCU | 17 | 1955 |
| myoC-1704 | − | UUGCUGCAGCUUUGGGC | 17 | 1956 |
| myoC-1705 | − | CUUCUGGCCUGCCUGGU | 17 | 1957 |
| myoC-244 | − | UUCUGGCCUGCCUGGUG | 17 | 630 |
| myoC-1707 | − | CCUGCCUGGUGUGGGAU | 17 | 1958 |
| myoC-246 | − | CUGCCUGGUGUGGGAUG | 17 | 632 |
| myoC-247 | − | UGCCUGGUGUGGGAUGU | 17 | 633 |
| myoC-1710 | − | GUGUGGGAUGUGGGGGC | 17 | 1959 |
| myoC-1711 | − | GCCAGGACAGCUCAGCU | 17 | 1960 |
| myoC-250 | − | CCAGGACAGCUCAGCUC | 17 | 636 |
| myoC-1713 | − | UCAGGAAGGCCAAUGAC | 17 | 1961 |
| myoC-1714 | − | CAGUGUGGCCAGUCCCA | 17 | 1962 |
| myoC-1715 | − | CAAUGAAUCCAGCUGCC | 17 | 1963 |
| myoC-1716 | − | AAUCCAGCUGCCCAGAG | 17 | 1964 |
| myoC-1717 | − | CAGUCAUCCAUAACUUA | 17 | 1965 |
| myoC-1718 | − | GUCAUCCAUAACUUACA | 17 | 1966 |
| myoC-1719 | − | GCACCCAACGCUUAGAC | 17 | 1967 |
| myoC-254 | − | CACCCAACGCUUAGACC | 17 | 640 |
| myoC-1721 | − | AAGCUCGACUCAGCUCC | 17 | 1968 |
| myoC-256 | − | AGCUCGACUCAGCUCCC | 17 | 642 |
| myoC-1723 | − | CUCGACUCAGCUCCCUG | 17 | 1969 |

TABLE 4D-continued

| gRNA Name | DNA Strand | Targeting Domain | Target Site Length | SEQ ID NO |
|---|---|---|---|---|
| myoC-1724 | − | UCCUCCACCAAUUGACC | 17 | 1970 |
| myoC-1725 | − | ACCAGGCUGCCAGGCCC | 17 | 1971 |
| myoC-260 | − | CCAGGCUGCCAGGCCCC | 17 | 646 |
| myoC-1727 | − | CCAGGCCCCAGGAGACC | 17 | 1972 |
| myoC-261 | − | CAGGCCCCAGGAGACCC | 17 | 647 |
| myoC-1729 | − | GGCCCCAGGAGACCCAG | 17 | 1973 |
| myoC-133 | − | GCCCCAGGAGACCCAGG | 17 | 528 |
| myoC-1731 | − | AGACCCAGGAGGGGCUG | 17 | 1974 |
| myoC-1732 | − | ACCCAGGAGGGGCUGCA | 17 | 1975 |
| myoC-264 | − | CCCAGGAGGGGCUGCAG | 17 | 650 |
| myoC-265 | − | CCAGGAGGGGCUGCAGA | 17 | 651 |
| myoC-1735 | − | AGGGGCUGCAGAGGGAG | 17 | 1976 |
| myoC-1736 | − | AGAGGGAGCUGGGCACC | 17 | 1977 |
| myoC-1737 | − | GAGCUGGGCACCCUGAG | 17 | 1978 |
| myoC-266 | − | AGCUGGGCACCCUGAGG | 17 | 652 |
| myoC-137 | − | GCUGGGCACCCUGAGGC | 17 | 532 |
| myoC-1740 | − | GGCACCCUGAGGCGGGA | 17 | 1979 |
| myoC-138 | − | GCACCCUGAGGCGGGAG | 17 | 533 |
| myoC-1742 | − | GGCGGGAGCGGGACCAG | 17 | 1980 |
| myoC-139 | − | GCGGGAGCGGGACCAGC | 17 | 534 |
| myoC-1744 | − | CAGCUGGAAACCCAAAC | 17 | 1981 |
| myoC-1745 | − | GCUGGAAACCCAAACCA | 17 | 1982 |
| myoC-1746 | − | AAACCCAAACCAGAGAG | 17 | 1983 |
| myoC-268 | − | AACCCAAACCAGAGAGU | 17 | 654 |
| myoC-1748 | − | GCCUACAGCAACCUCCU | 17 | 1984 |
| myoC-1749 | − | UCCGAGACAAGUCAGUU | 17 | 1985 |
| myoC-269 | − | CCGAGACAAGUCAGUUC | 17 | 655 |
| myoC-1751 | − | GAGACAAGUCAGUUCUG | 17 | 1986 |
| myoC-270 | − | AGACAAGUCAGUUCUGG | 17 | 656 |
| myoC-1753 | − | CAAGUCAGUUCUGGAGG | 17 | 1987 |
| myoC-1754 | − | AGUCAGUUCUGGAGGAA | 17 | 1988 |
| myoC-1755 | − | CAGUUCUGGAGGAAGAG | 17 | 1989 |
| myoC-1756 | − | GAAGAAGCGACUAAGGC | 17 | 1990 |
| myoC-1757 | − | GCGACUAAGGCAAGAAA | 17 | 1991 |
| myoC-1758 | − | GACUAAGGCAAGAAAAU | 17 | 1992 |
| myoC-1759 | − | GAAAAUGAGAAUCUGGC | 17 | 1993 |
| myoC-272 | − | AAAAUGAGAAUCUGGCC | 17 | 658 |
| myoC-1761 | − | AGAAUCUGGCCAGGAGG | 17 | 1994 |

TABLE 4D-continued

| gRNA Name | DNA Strand | Targeting Domain | Target Site Length | SEQ ID NO |
|---|---|---|---|---|
| myoC-141 | − | GAAUCUGGCCAGGAGGU | 17 | 536 |
| myoC-1763 | − | GGUUGGAAAGCAGCAGC | 17 | 1995 |
| myoC-142 | − | GUUGGAAAGCAGCAGCC | 17 | 537 |
| myoC-1765 | − | GCCAGGAGGUAGCAAGG | 17 | 1996 |
| myoC-1766 | − | CAGGAGGUAGCAAGGCU | 17 | 1997 |
| myoC-1767 | − | GAGGUAGCAAGGCUGAG | 17 | 1998 |
| myoC-274 | − | AGGUAGCAAGGCUGAGA | 17 | 660 |
| myoC-1769 | − | GGCCAGUGUCCCCAGAC | 17 | 1999 |
| myoC-1770 | − | CAGACCCGAGACACUGC | 17 | 2000 |
| myoC-1771 | − | GCUGUGCCACCAGGCUC | 17 | 2001 |
| myoC-1772 | − | UGUGCCACCAGGCUCCA | 17 | 2002 |
| myoC-1773 | + | CUCAUUGCAGAGGCUUG | 17 | 2003 |
| myoC-1774 | + | ACAGAAGAACCUCAUUG | 17 | 2004 |
| myoC-1775 | + | UGCAGCAACGUGCACAG | 17 | 2005 |
| myoC-1776 | + | AGCUGCAGCAACGUGCA | 17 | 2006 |
| myoC-1777 | + | CAGGCCAGAAGCAGCAG | 17 | 2007 |
| myoC-1778 | + | UCCCACACCAGGCAGGC | 17 | 2008 |
| myoC-1779 | + | UCAUUGGCCUUCCUGAG | 17 | 2009 |
| myoC-1780 | + | UCUGGUCAUUGGCCUUC | 17 | 2010 |
| myoC-1781 | + | CAUUGGGACUGGCCACA | 17 | 2011 |
| myoC-302 | + | UGGGCAGCUGGAUUCAU | 17 | 688 |
| myoC-1783 | + | CUGGGCAGCUGGAUUCA | 17 | 2012 |
| myoC-1784 | + | GGCUCUGCUCUGGGCAG | 17 | 2013 |
| myoC-1785 | + | CAUGGCCUGGCUCUGCU | 17 | 2014 |
| myoC-1786 | + | CUGUCUCUCUGUAAGUU | 17 | 2015 |
| myoC-1787 | + | GCCUCCAGGUCUAAGCG | 17 | 2016 |
| myoC-1788 | + | CUCUCCAGGGAGCUGAG | 17 | 2017 |
| myoC-1789 | + | GGAGGCUCUCCAGGGAG | 17 | 2018 |
| myoC-159 | + | GUGGAGGAGGCUCUCCA | 17 | 549 |
| myoC-158 | + | GGUGGAGGAGGCUCUCC | 17 | 548 |
| myoC-1792 | + | UGGUGGAGGAGGCUCUC | 17 | 2019 |
| myoC-295 | + | CCAAGGUCAAUUGGUGG | 17 | 681 |
| myoC-1794 | + | UCCAAGGUCAAUUGGUG | 17 | 2020 |
| myoC-157 | + | GGUCCAAGGUCAAUUGG | 17 | 493 |
| myoC-1796 | + | UGGUCCAAGGUCAAUUG | 17 | 2021 |
| myoC-156 | + | GCCCCUCCUGGGUCUCC | 17 | 547 |
| myoC-1798 | + | AGCCCCUCCUGGGUCUC | 17 | 2022 |
| myoC-1799 | + | UCCCUCUGCAGCCCCUC | 17 | 2023 |
| myoC-1800 | + | UGGUCCCGCUCCCGCCU | 17 | 2024 |
| myoC-1801 | + | GUCUCCAACUCUCUGGU | 17 | 2025 |
| myoC-152 | + | GAACUGACUUGUCUCGG | 17 | 492 |
| myoC-1803 | + | AGAACUGACUUGUCUCG | 17 | 2026 |
| myoC-281 | + | CCAGAACUGACUUGUCU | 17 | 667 |
| myoC-1805 | + | UCCAGAACUGACUUGUC | 17 | 2027 |
| myoC-1806 | + | CGCUUCUUCUCUUCCUC | 17 | 2028 |
| myoC-278 | + | AGCAGUGUCUCGGGUCU | 17 | 664 |
| myoC-149 | + | GAGCAGUGUCUCGGGUC | 17 | 491 |
| myoC-1809 | + | CGAGCAGUGUCUCGGGU | 17 | 2029 |
| myoC-1810 | + | ACAGCCCGAGCAGUGUC | 17 | 2030 |
| myoC-1811 | + | GAGCCUGGUGGCACAGC | 17 | 2031 |

Table 4E provides exemplary targeting domains for knocking out the MYOC gene. In an embodiment, the targeting domain is the exact complement of the target domain. Any of the targeting domains in the table can be used with an *N. meningitidis* Cas9 molecule that gives double stranded cleavage. Any of the targeting domains in the table can be used with an *N. meningitidis* Cas9 single-stranded break nucleases (nickases). In an embodiment, dual targeting is used to create two nicks on opposite DNA strands by using *N. meningitidis* Cas9 nickases with two targeting domains that are complementary to opposite DNA strands, e.g., a gRNA comprising any minus strand targeting domain may be paired any gRNA comprising a plus strand targeting domain provided that the two gRNAs are oriented on the DNA such that PAMs face outward and the distance between the 5' ends of the gRNAs is 0-50 bp.

TABLE 4E

| gRNA Name | DNA Strand | Targeting Domain | Target Site Length | SEQ ID NO |
|---|---|---|---|---|
| myoC-3082 | + | GCCUGGCUCUGCUCUGGGCA | 20 | 2844 |
| myoC-3083 | + | UGCUGCUUUCCAACCUCCUG | 20 | 2845 |
| myoC-3156 | − | GAACCGCUAUAAGUACAGCA | 20 | 2842 |
| myoC-3087 | − | AUGACAUAGUUCAAGUUUUC | 20 | 2846 |
| myoC-3088 | + | GCGGACAUCCGUGCCAACUG | 20 | 2847 |
| myoC-2924 | + | CUGUCCGUGGUAGCCAGCUC | 20 | 1822 |
| myoC-3090 | + | UCUCCCAGGUUUGUUCGAGU | 20 | 2848 |
| myoC-3091 | + | AUGGUGACCAUGUUCAUCCU | 20 | 2849 |
| myoC-3084 | + | UGGCUCUGCUCUGGGCA | 17 | 2850 |
| myoC-3085 | + | UGCUUUCCAACCUCCUG | 17 | 2851 |
| myoC-3157 | − | CCGCUAUAAGUACAGCA | 17 | 2843 |

TABLE 4E-continued

| gRNA Name | DNA Strand | Targeting Domain | Target Site Length | SEQ ID NO |
|---|---|---|---|---|
| myoC-3093 | - | ACAUAGUUCAAGUUUUC | 17 | 2852 |
| myoC-3094 | + | GACAUCCGUGCCAACUG | 17 | 2853 |
| myoC-2950 | + | UCCGUGGUAGCCAGCUC | 17 | 1842 |
| myoC-3096 | + | CCCAGGUUUGUUCGAGU | 17 | 2854 |
| myoC-3097 | + | GUGACCAUGUUCAUCCU | 17 | 2855 |

Table 5A provides exemplary targeting domains for repressing (i.e., knocking down or decreasing) expression of the MYOC gene selected according to first tier parameters, and are selected based on the presence of a 5' G, location in the promoter region and orthogonality in the human genome. In an embodiment, the targeting domain is the exact complement of the target domain. Any of the targeting domains in the table can be used with a *S. pyogenes* eiCas9 molecule to cause a steric block at the promoter region to block transcription resulting in the repression of the MYOC gene. Alternatively, any of the targeting domains in the table can be used with a *S. pyogenes* eiCas9 fused to a transcriptional repressor to decrease transcription and therefore downregulate gene expression.

TABLE 5A

| 1st Tier | | | | | |
|---|---|---|---|---|---|
| | selected based on the presence of a 5' G, location in promoter region, and orthogonality in the human genome | | | | |
| gRNA Name | DNA Strand | Targeting Domain | Target Site Length | Location | SEQ ID NO |
| myoC-696 | - | GCUGCCUCCAUCGUGCCCGG | 20 | 1st 500bp of DNAsel HS region, overlapping transcription factor binding sites | 976 |
| myoC-707 | + | GCUUGGAAGACUCGGGCUUG | 20 | 1st 500bp of DNAsel HS region, overlapping transcription factor binding sites | 977 |
| myoC-706 | + | GGCUUGGAAGACUCGGGCUU | 20 | 1st 500bp of DNAsel HS region, overlapping transcription factor binding sites | 978 |
| myoC-682 | - | GGGAGCCCUGCAAGCACCCG | 20 | 1st 500bp of DNAsel HS region, overlapping transcription factor binding sites | 979 |
| myoC-712 | + | GGGGCCUCCGGGCACGAUGG | 20 | 1st 500bp of DNAsel HS region, overlapping transcription factor binding sites | 980 |
| myoC-694 | - | GUGCGCAGCAUCCCUUAACA | 20 | 1st 500bp of DNAsel HS region, overlapping transcription factor binding sites | 981 |
| myoC-822 | + | GACCCCGGGUGCUUGCA | 17 | 1st 500bp of DNAsel HS region, overlapping transcription factor binding sites | 982 |
| myoC-828 | + | GAGGAAACCUCUGCCGG | 17 | 1st 500bp of DNAsel HS region, overlapping transcription factor binding sites | 983 |
| myoC-812 | + | GAUAACAAAACAACCAG | 17 | 1st 500bp of DNAsel HS region, overlapping transcription factor binding sites | 984 |
| myoC-772 | - | GCCUCCAUCGUGCCCGG | 17 | 1st 500bp of DNAsel HS region, overlapping transcription factor binding sites | 985 |
| myoC-789 | + | GCCUCCGGGCACGAUGG | 17 | 1st 500bp of DNAsel HS region, overlapping | 986 |

TABLE 5A-continued

1st Tier selected based on the presence of a 5' G, location in promoter region, and orthogonality in the human genome

| gRNA Name | DNA Strand | Targeting Domain | Target Site Length | Location | SEQ ID NO |
|---|---|---|---|---|---|
| | | | | transcription factor binding sites | |
| myoC-806 | + | GUCACCUCCACGAAGGU | 17 | 1st 500bp of DNAsel HS region, overlapping transcription factor binding sites | 987 |
| myoC-848 | − | GAAUCUUGCUGGCAGCGUGA | 20 | within 500bp upstream of transcription start site | 988 |
| myoC-839 | − | GAGAUAUAGGAACUAUUAUU | 20 | within 500bp upstream of transcription start site | 989 |
| myoC-857 | − | GCCAGCAAGGCCACCCAUCC | 20 | within 500bp upstream of transcription start site | 990 |
| myoC-838 | − | GGAGAUAUAGGAACUAUUAU | 20 | within 500bp upstream of transcription start site | 991 |
| myoC-871 | + | GGGGAGCCAGCCCUUCAUGG | 20 | within 500bp upstream of transcription start site | 992 |
| myoC-844 | − | GGGGUAUGGGUGCAUAAAUU | 20 | within 500bp upstream of transcription start site | 993 |
| myoC-837 | − | GUAAAACCAGGUGGAGAUAU | 20 | within 500bp upstream of transcription start site | 994 |
| myoC-861 | + | GUGCUGAGAGGUGCCUGGAU | 20 | within 500bp upstream of transcription start site | 995 |
| myoC-907 | − | GAACUAUUAUUGGGGUA | 17 | within 500bp upstream of transcription start site | 996 |
| myoC-931 | + | GAGAGGUUUAUAUAUAC | 17 | within 500bp upstream of transcription start site | 997 |
| myoC-919 | − | GUAUAUAUAAACCUCUC | 17 | within 500bp upstream of transcription start site | 998 |
| myoC-910 | − | GUAUGGGUGCAUAAAUU | 17 | within 500bp upstream of transcription start site | 999 |
| myoC-959 | + | GUCCUUUAAGACGUAGC | 17 | within 500bp upstream of transcription start site | 1000 |
| myoC-896 | − | GUCUUAAAGGACUUGUU | 17 | within 500bp upstream of transcription start site | 1001 |
| myoC-955 | + | GUGUGCUGAUUUCAACA | 17 | within 500bp upstream of transcription start site | 1002 |

Table 5B provides exemplary targeting domains for repressing (i.e., knocking down or decreasing) expression of MYOC gene selected according to the second tier parameters, and are selected based on the presence of a 5' G, location in the promoter region. In an embodiment, the targeting domain is the exact complement of the target domain. Any of the targeting domains in the table can be used with a *S. pyogenes* eiCas9 molecule to cause a steric block at the promoter region to block transcription resulting in the repression of the MYOC gene. Alternatively, any of the targeting domains in the table can be used with a *S. pyogenes* eiCas9 fused to a transcriptional repressor to decrease transcription and therefore downregulate gene expression.

TABLE 5B

| 2nd Tier | | | | | |
|---|---|---|---|---|---|
| | selected based on the presence of a 5' G and location in promoter region | | | | |
| gRNA Name | DNA Strand | Targeting Domain | Target Site Length | Location | SEQ ID NO |
| myoC-709 | + | GACUCGGGCUUGGGGGCCUC | 20 | 1st 500bp of DNAsel HS region, overlapping transcription factor binding sites | 1003 |
| myoC-702 | + | GACUGAUGGAGGAGGAGGCU | 20 | 1st 500bp of DNAsel HS region, overlapping transcription factor binding sites | 1004 |
| myoC-679 | - | GAGGUUUCCUCUCCAGCUGG | 20 | 1st 500bp of DNAsel HS region, overlapping transcription factor binding sites | 1005 |
| myoC-676 | - | GCAGAGGUUUCCUCUCCAGC | 20 | 1st 500bp of DNAsel HS region, overlapping transcription factor binding sites | 1006 |
| myoC-741 | + | GCAGGUUGCUCAGGACACCC | 20 | 1st 500bp of DNAsel HS region, overlapping transcription factor binding sites | 1007 |
| myoC-689 | - | GCCAGACACCAGAGACAAAA | 20 | 1st 500bp of DNAsel HS region, overlapping transcription factor binding sites | 1008 |
| myoC-742 | + | GCUCAGGACACCCAGGACCC | 20 | 1st 500bp of DNAsel HS region, overlapping transcription factor binding sites | 1009 |
| myoC-748 | + | GCUGGAGAGGAAACCUCUGC | 20 | 1st 500bp of DNAsel HS region, overlapping transcription factor binding sites | 1010 |
| myoC-701 | + | GCUGUGACUGAUGGAGGAGG | 20 | 1st 500bp of DNAsel HS region, overlapping transcription factor binding sites | 1011 |
| myoC-746 | + | GCUUGCAGGGCUCCCCCAGC | 20 | 1st 500bp of DNAsel HS region, overlapping transcription factor binding sites | 1012 |

TABLE 5B-continued

| 2nd Tier | | | | | |
|---|---|---|---|---|---|
| | selected based on the presence of a 5' G and location in promoter region | | | | |
| gRNA Name | DNA Strand | Targeting Domain | Target Site Length | Location | SEQ ID NO |
| myoC-751 | + | GGAGAGGAAACCUCUGCCGG | 20 | 1st 500bp of DNAsel HS region, overlapping transcription factor binding sites | 1013 |
| myoC-704 | + | GGAGGAGGCUUGGAAGACUC | 20 | 1st 500bp of DNAsel HS region, overlapping transcription factor binding sites | 1014 |
| myoC-718 | + | GGAGGCAGCAGGGGGCGCUA | 20 | 1st 500bp of DNAsel HS region, overlapping transcription factor binding sites | 1015 |
| myoC-716 | + | GGCACGAUGGAGGCAGCAGG | 20 | 1st 500bp of DNAsel HS region, overlapping transcription factor binding sites | 1016 |
| myoC-719 | + | GGCAGCAGGGGGCGCUAGGG | 20 | 1st 500bp of DNAsel HS region, overlapping transcription factor binding sites | 1017 |
| myoC-715 | + | GGGCACGAUGGAGGCAGCAG | 20 | 1st 500bp of DNAsel HS region, overlapping transcription factor binding sites | 1018 |
| myoC-681 | - | GGGGAGCCCUGCAAGCACCC | 20 | 1st 500bp of DNAsel HS region, overlapping transcription factor binding sites | 1019 |
| myoC-680 | - | GGGGGAGCCCUGCAAGCACC | 20 | 1st 500bp of DNAsel HS region, overlapping transcription factor binding sites | 1020 |
| myoC-692 | - | GUGGAGGUGACAGUUUCUCA | 20 | 1st 500bp of DNAsel HS region, overlapping transcription factor binding sites | 1021 |
| myoC-764 | - | GACUCGUUCAUUCAUCC | 17 | 1st 500bp of DNAsel HS region, overlapping transcription factor binding sites | 1022 |
| myoC-826 | + | GAGAGGAAACCUCUGCC | 17 | 1st 500bp of DNAsel HS region, overlapping transcription factor binding sites | 1023 |
| myoC-757 | - | GAGCCCUGCAAGCACCC | 17 | 1st 500bp of DNAsel HS region, overlapping transcription factor binding sites | 1024 |

TABLE 5B-continued

| 2nd Tier | | | | | |
|---|---|---|---|---|---|
| | selected based on the presence of a 5' G and location in promoter region | | | | |
| gRNA Name | DNA Strand | Targeting Domain | Target Site Length | Location | SEQ ID NO |
| myoC-768 | - | GAGGUGACAGUUUCUCA | 17 | 1st 500bp of DNAsel HS region, overlapping transcription factor binding sites | 1025 |
| myoC-752 | - | GAGGUUUCCUCUCCAGC | 17 | 1st 500bp of DNAsel HS region, overlapping transcription factor binding sites | 1026 |
| myoC-759 | - | GCAAGCACCCGGGGUCC | 17 | 1st 500bp of DNAsel HS region, overlapping transcription factor binding sites | 1027 |
| myoC-791 | + | GCACGAUGGAGGCAGCA | 17 | 1st 500bp of DNAsel HS region, overlapping transcription factor binding sites | 1028 |
| myoC-808 | + | GCUCACCAUUUUGUCUC | 17 | 1st 500bp of DNAsel HS region, overlapping transcription factor binding sites | 1029 |
| myoC-771 | - | GCUGCCUCCAUCGUGCC | 17 | 1st 500bp of DNAsel HS region, overlapping transcription factor binding sites | 1030 |
| myoC-777 | + | GCUGUGACUGAUGGAGG | 17 | 1st 500bp of DNAsel HS region, overlapping transcription factor binding sites | 1031 |
| myoC-785 | + | GGAAGACUCGGGCUUGG | 17 | 1st 500bp of DNAsel HS region, overlapping transcription factor binding sites | 1032 |
| myoC-821 | + | GGACCCCGGGUGCUUGC | 17 | 1st 500bp of DNAsel HS region, overlapping transcription factor binding sites | 1033 |
| myoC-825 | + | GGAGAGGAAACCUCUGC | 17 | 1st 500bp of DNAsel HS region, overlapping transcription factor binding sites | 1034 |
| myoC-756 | - | GGAGCCCUGCAAGCACC | 17 | 1st 500bp of DNAsel HS region, overlapping transcription factor binding sites | 1035 |

TABLE 5B-continued

| 2nd Tier | | | | | |
|---|---|---|---|---|---|
| | selected based on the presence of a 5' G and location in promoter region | | | | |
| gRNA Name | DNA Strand | Targeting Domain | Target Site Length | Location | SEQ ID NO |
| myoC-781 | + | GGAGGCUUGGAAGACUC | 17 | 1st 500bp of DNAsel HS region, overlapping transcription factor binding sites | 1036 |
| myoC-799 | + | GGAGGUGGCCUUGUUAA | 17 | 1st 500bp of DNAsel HS region, overlapping transcription factor binding sites | 1037 |
| myoC-790 | + | GGCACGAUGGAGGCAGC | 17 | 1st 500bp of DNAsel HS region, overlapping transcription factor binding sites | 1038 |
| myoC-795 | + | GGCAGCAGGGGGCGCUA | 17 | 1st 500bp of DNAsel HS region, overlapping transcription factor binding sites | 1039 |
| myoC-824 | + | GGCUCCCCCAGCUGGAG | 17 | 1st 500bp of DNAsel HS region, overlapping transcription factor binding sites | 1040 |
| myoC-798 | + | GGGAGGUGGCCUUGUUA | 17 | 1st 500bp of DNAsel HS region, overlapping transcription factor binding sites | 1041 |
| myoC-817 | + | GGGCUGGCAGGUUGCUC | 17 | 1st 500bp of DNAsel HS region, overlapping transcription factor binding sites | 1042 |
| myoC-788 | + | GGGGCCUCCGGGCACGA | 17 | 1st 500bp of DNAsel HS region, overlapping transcription factor binding sites | 1043 |
| myoC-818 | + | GGUUGCUCAGGACACCC | 17 | 1st 500bp of DNAsel HS region, overlapping transcription factor binding sites | 1044 |
| myoC-754 | - | GGUUUCCUCUCCAGCUG | 17 | 1st 500bp of DNAsel HS region, overlapping transcription factor binding sites | 1045 |
| myoC-778 | + | GUGACUGAUGGAGGAGG | 17 | 1st 500bp of DNAsel HS region, overlapping transcription factor binding sites | 1046 |
| myoC-755 | - | GUUUCCUCUCCAGCUGG | 17 | 1st 500bp of DNAsel HS region, overlapping transcription factor binding sites | 1047 |

TABLE 5B-continued

| gRNA Name | DNA Strand | Targeting Domain | Target Site Length | Location | SEQ ID NO |
|---|---|---|---|---|---|
| 2nd Tier — selected based on the presence of a 5' G and location in promoter region | | | | | |
| myoC-858 | + | GAAAGCUCUGCUGUGCUGAG | 20 | within 500bp upstream of transcription start site | 1048 |
| myoC-863 | + | GCCUGGAUGGGUGGCCUUGC | 20 | within 500bp upstream of transcription start site | 1049 |
| myoC-881 | + | GCUGGGUGGGGCUGUGCACA | 20 | within 500bp upstream of transcription start site | 1050 |
| myoC-880 | + | GGCUGGGUGGGGCUGUGCAC | 20 | within 500bp upstream of transcription start site | 1051 |
| myoC-884 | + | GGGUGGGGCUGUGCACAGGG | 20 | within 500bp upstream of transcription start site | 1052 |
| myoC-877 | + | GGUGGCCACGUGAGGCUGGG | 20 | within 500bp upstream of transcription start site | 1053 |
| myoC-878 | + | GUGGCCACGUGAGGCUGGGU | 20 | within 500bp upstream of transcription start site | 1054 |
| myoC-835 | - | GUGUGUGUGUGUGUAAAACC | 20 | within 500bp upstream of transcription start site | 1055 |
| myoC-937 | + | GAGCCAGCCCUUCAUGG | 17 | within 500bp upstream of transcription start site | 1056 |
| myoC-933 | + | GAGGUUUAUAUAUACUG | 17 | within 500bp upstream of transcription start site | 1057 |
| myoC-904 | - | GAUAUAGGAACUAUUAU | 17 | within 500bp upstream of transcription start site | 1058 |
| myoC-944 | + | GCCACGUGAGGCUGGGU | 17 | within 500bp upstream of transcription start site | 1059 |
| myoC-926 | + | GCUGAGAGGUGCCUGGA | 17 | within 500bp upstream of transcription start site | 1060 |
| myoC-936 | + | GGAGCCAGCCCUUCAUG | 17 | within 500bp upstream of transcription start site | 1061 |

TABLE 5B-continued

| 2nd Tier | | | | | |
|---|---|---|---|---|---|
| | selected based on the presence of a 5' G and location in promoter region | | | | |
| gRNA Name | DNA Strand | Targeting Domain | Target Site Length | Location | SEQ ID NO |
| myoC-958 | + | GGCACUAUGCUAGGAAC | 17 | within 500bp upstream of transcription start site | 1062 |
| myoC-943 | + | GGCCACGUGAGGCUGGG | 17 | within 500bp upstream of transcription start site | 1063 |
| myoC-935 | + | GGGAGCCAGCCCUUCAU | 17 | within 500bp upstream of transcription start site | 1064 |
| myoC-934 | + | GGGGAGCCAGCCCUUCA | 17 | within 500bp upstream of transcription start site | 1065 |
| myoC-947 | + | GGGUGGGGCUGUGCACA | 17 | within 500bp upstream of transcription start site | 1066 |
| myoC-909 | − | GGUAUGGGUGCAUAAAU | 17 | within 500bp upstream of transcription start site | 1067 |
| myoC-942 | + | GGUGGCCACGUGAGGCU | 17 | within 500bp upstream of transcription start site | 1068 |
| myoC-948 | + | GGUGGGGCUGUGCACAG | 17 | within 500bp upstream of transcription start site | 1069 |
| myoC-953 | + | GUACACACACUUACACC | 17 | within 500bp upstream of transcription start site | 1070 |
| myoC-957 | + | GUGCCAGGCACUAUGCU | 17 | within 500bp upstream of transcription start site | 1071 |
| myoC-949 | + | GUGGGGCUGUGCACAGG | 17 | within 500bp upstream of transcription start site | 1072 |
| myoC-902 | − | GUGUGUGUAAAACCAGG | 17 | within 500bp upstream of transcription start site | 1073 |
| myoC-897 | − | GUUCCUAGCAUAGUGCC | 17 | within 500bp upstream of transcription start site | 1074 |
| myoC-952 | + | GUUCCUAUAUCUCCACC | 17 | within 500bp upstream of transcription start site | 1075 |

Table 5C provides exemplary targeting domains for repressing (i.e., knocking down or decreasing) expression of MYOC gene selected according to the third tier parameters, and are selected based on the location in the promoter region. In an embodiment, the targeting domain is the exact complement of the target domain. Any of the targeting domains in the table can be used with a *S. pyogenes* eiCas9 molecule to cause a steric block at the promoter region to block transcription resulting in the repression of the MYOC gene. Alternatively, any of the targeting domains in the table can be used with a *S. pyogenes* eiCas9 fused to a transcriptional repressor to decrease transcription and therefore downregulate gene expression.

TABLE 5C

| 3rd Tier | | | | | |
|---|---|---|---|---|---|
| | selected based on location in promoter region | | | | |
| gRNA Name | DNA Strand | Targeting Domain | Target Site Length | Location | SEQ ID NO |
| myoC-738 | + | AAACAACCAGUGGCACGGGC | 20 | 1st 500bp of DNAsel HS region, overlapping transcription factor binding sites | 1076 |
| myoC-737 | + | AACAAAACAACCAGUGGCAC | 20 | 1st 500bp of DNAsel HS region, overlapping transcription factor binding sites | 1077 |
| myoC-739 | + | AACCAGUGGCACGGGCUGGC | 20 | 1st 500bp of DNAsel HS region, overlapping transcription factor binding sites | 1078 |
| myoC-685 | - | AACCUGCCAGCCCGUGCCAC | 20 | 1st 500bp of DNAsel HS region, overlapping transcription factor binding sites | 1079 |
| myoC-734 | + | ACACAGAAAUAGAAAGCAAC | 20 | 1st 500bp of DNAsel HS region, overlapping transcription factor binding sites | 1080 |
| myoC-732 | + | ACCAUUUUGUCUCUGGUGUC | 20 | 1st 500bp of DNAsel HS region, overlapping transcription factor binding sites | 1081 |
| myoC-710 | + | ACUCGGGCUUGGGGGCCUCC | 20 | 1st 500bp of DNAsel HS region, overlapping transcription factor binding sites | 1082 |
| myoC-729 | + | ACUGUCACCUCCACGAAGGU | 20 | 1st 500bp of DNAsel HS region, overlapping transcription factor binding sites | 1083 |
| myoC-728 | + | AGAAACUGUCACCUCCACGA | 20 | 1st 500bp of DNAsel HS region, overlapping transcription factor binding sites | 1084 |
| myoC-678 | - | AGAGGUUUCCUCUCCAGCUG | 20 | 1st 500bp of DNAsel HS region, overlapping transcription factor binding sites | 1085 |
| myoC-727 | + | AGCACUGGGUUUAAGUUGGC | 20 | 1st 500bp of DNAsel HS region, overlapping transcription factor binding sites | 1086 |
| myoC-720 | + | AGCAGGGGGCGCUAGGGAGG | 20 | 1st 500bp of DNAsel HS region, overlapping transcription factor binding sites | 1087 |

TABLE 5C-continued

| 3rd Tier | | | | | |
|---|---|---|---|---|---|
| | selected based on location in promoter region | | | | |
| gRNA Name | DNA Strand | Targeting Domain | Target Site Length | Location | SEQ ID NO |
| myoC-700 | + | AGCGCUGUGACUGAUGGAGG | 20 | 1st 500bp of DNAsel HS region, overlapping transcription factor binding sites | 1088 |
| myoC-698 | + | AGCUGCAGCGCUGUGACUGA | 20 | 1st 500bp of DNAsel HS region, overlapping transcription factor binding sites | 1089 |
| myoC-703 | + | AGGAGGAGGCUUGGAAGACU | 20 | 1st 500bp of DNAsel HS region, overlapping transcription factor binding sites | 1090 |
| myoC-705 | + | AGGCUUGGAAGACUCGGGCU | 20 | 1st 500bp of DNAsel HS region, overlapping transcription factor binding sites | 1091 |
| myoC-735 | + | AGUGAUAACAAAACAACCAG | 20 | 1st 500bp of DNAsel HS region, overlapping transcription factor binding sites | 1092 |
| myoC-733 | + | AUAAAUUGUCAAUGAAUGCC | 20 | 1st 500bp of DNAsel HS region, overlapping transcription factor binding sites | 1093 |
| myoC-697 | - | AUCAGUCACAGCGCUGCAGC | 20 | 1st 500bp of DNAsel HS region, overlapping transcription factor binding sites | 1094 |
| myoC-725 | + | AUUUCCUUUCUUUCAGCACU | 20 | 1st 500bp of DNAsel HS region, overlapping transcription factor binding sites | 1095 |
| myoC-740 | + | CACGGGCUGGCAGGUUGCUC | 20 | 1st 500bp of DNAsel HS region, overlapping transcription factor binding sites | 1096 |
| myoC-677 | - | CAGAGGUUUCCUCUCCAGCU | 20 | 1st 500bp of DNAsel HS region, overlapping transcription factor binding sites | 1097 |
| myoC-745 | + | CAGGACCCCGGGUGCUUGCA | 20 | 1st 500bp of DNAsel HS region, overlapping transcription factor binding sites | 1098 |
| myoC-747 | + | CAGGGCUCCCCCAGCUGGAG | 20 | 1st 500bp of DNAsel HS region, overlapping transcription factor binding sites | 1099 |
| myoC-690 | - | CAGUCACUGCCCUACCUUCG | 20 | 1st 500bp of DNAsel HS region, overlapping transcription factor binding sites | 1100 |
| myoC-744 | + | CCAGGACCCCGGGUGCUUGC | 20 | 1st 500bp of DNAsel HS region, overlapping transcription factor binding sites | 1101 |

TABLE 5C-continued

| gRNA Name | DNA Strand | Targeting Domain | Target Site Length | Location | SEQ ID NO |
|---|---|---|---|---|---|
| 3rd Tier | | | | | |
| | selected based on location in promoter region | | | | |
| myoC-713 | + | CCGGGCACGAUGGAGGCAGC | 20 | 1st 500bp of DNAsel HS region, overlapping transcription factor binding sites | 1102 |
| myoC-683 | - | CCUGCAAGCACCCGGGGUCC | 20 | 1st 500bp of DNAsel HS region, overlapping transcription factor binding sites | 1103 |
| myoC-695 | - | CCUGCUGCCUCCAUCGUGCC | 20 | 1st 500bp of DNAsel HS region, overlapping transcription factor binding sites | 1104 |
| myoC-714 | + | CGGGCACGAUGGAGGCAGCA | 20 | 1st 500bp of DNAsel HS region, overlapping transcription factor binding sites | 1105 |
| myoC-721 | + | CUAGGGAGGUGGCCUUGUUA | 20 | 1st 500bp of DNAsel HS region, overlapping transcription factor binding sites | 1106 |
| myoC-743 | + | CUCAGGACACCCAGGACCCC | 20 | 1st 500bp of DNAsel HS region, overlapping transcription factor binding sites | 1107 |
| myoC-684 | - | CUGCAAGCACCCGGGGUCCU | 20 | 1st 500bp of DNAsel HS region, overlapping transcription factor binding sites | 1108 |
| myoC-723 | + | CUGCGCACAAUUCUUCAAGA | 20 | 1st 500bp of DNAsel HS region, overlapping transcription factor binding sites | 1109 |
| myoC-749 | + | CUGGAGAGGAAACCUCUGCC | 20 | 1st 500bp of DNAsel HS region, overlapping transcription factor binding sites | 1110 |
| myoC-730 | + | CUGUCACCUCCACGAAGGUA | 20 | 1st 500bp of DNAsel HS region, overlapping transcription factor binding sites | 1111 |
| myoC-708 | + | CUUGGAAGACUCGGGCUUGG | 20 | 1st 500bp of DNAsel HS region, overlapping transcription factor binding sites | 1112 |
| myoC-693 | - | UAAACCCAGUGCUGAAAGAA | 20 | 1st 500bp of DNAsel HS region, overlapping transcription factor binding sites | 1113 |
| myoC-736 | + | UAACAAAACAACCAGUGGCA | 20 | 1st 500bp of DNAsel HS region, overlapping transcription factor binding sites | 1114 |
| myoC-722 | + | UAGGGAGGUGGCCUUGUUAA | 20 | 1st 500bp of DNAsel HS region, overlapping transcription factor binding sites | 1115 |

TABLE 5C-continued

| 3rd Tier | | | | | |
|---|---|---|---|---|---|
| | selected based on location in promoter region | | | | |
| gRNA Name | DNA Strand | Targeting Domain | Target Site Length | Location | SEQ ID NO |
| myoC-724 | + | UAUUUCCUUUCUUUCAGCAC | 20 | 1st 500bp of DNAsel HS region, overlapping transcription factor binding sites | 1116 |
| myoC-691 | - | UCACUGCCCUACCUUCGUGG | 20 | 1st 500bp of DNAsel HS region, overlapping transcription factor binding sites | 1117 |
| myoC-699 | + | UGCAGCGCUGUGACUGAUGG | 20 | 1st 500bp of DNAsel HS region, overlapping transcription factor binding sites | 1118 |
| myoC-750 | + | UGGAGAGGAAACCUCUGCCG | 20 | 1st 500bp of DNAsel HS region, overlapping transcription factor binding sites | 1119 |
| myoC-717 | + | UGGAGGCAGCAGGGGGCGCU | 20 | 1st 500bp of DNAsel HS region, overlapping transcription factor binding sites | 1120 |
| myoC-688 | - | UGUGACUCGUUCAUUCAUCC | 20 | 1st 500bp of DNAsel HS region, overlapping transcription factor binding sites | 1121 |
| myoC-687 | - | UGUUUUGUUAUCACUCUCUA | 20 | 1st 500bp of DNAsel HS region, overlapping transcription factor binding sites | 1122 |
| myoC-711 | + | UUGGGGGCCUCCGGGCACGA | 20 | 1st 500bp of DNAsel HS region, overlapping transcription factor binding sites | 1123 |
| myoC-686 | - | UUGUUUUGUUAUCACUCUCU | 20 | 1st 500bp of DNAsel HS region, overlapping transcription factor binding sites | 1124 |
| myoC-726 | + | UUUCAGCACUGGGUUUAAGU | 20 | 1st 500bp of DNAsel HS region, overlapping transcription factor binding sites | 1125 |
| myoC-731 | + | UUUGCUCACCAUUUUGUCUC | 20 | 1st 500bp of DNAsel HS region, overlapping transcription factor binding sites | 1126 |
| myoC-814 | + | AAAACAACCAGUGGCAC | 17 | 1st 500bp of DNAsel HS region, overlapping transcription factor binding sites | 1127 |
| myoC-805 | + | AACUGUCACCUCCACGA | 17 | 1st 500bp of DNAsel HS region, overlapping transcription factor binding sites | 1128 |
| myoC-810 | + | AAUUGUCAAUGAAUGCC | 17 | 1st 500bp of DNAsel HS region, overlapping transcription factor binding sites | 1129 |

TABLE 5C-continued

| gRNA Name | DNA Strand | Targeting Domain | Target Site Length | Location | SEQ ID NO |
|---|---|---|---|---|---|
| 3rd Tier | | | | | |
| | selected based on location in promoter region | | | | |
| myoC-769 | − | ACCCAGUGCUGAAAGAA | 17 | 1st 500bp of DNAseI HS region, overlapping transcription factor binding sites | 1130 |
| myoC-793 | + | ACGAUGGAGGCAGCAGG | 17 | 1st 500bp of DNAseI HS region, overlapping transcription factor binding sites | 1131 |
| myoC-804 | + | ACUGGGUUUAAGUUGGC | 17 | 1st 500bp of DNAseI HS region, overlapping transcription factor binding sites | 1132 |
| myoC-765 | − | AGACACCAGAGACAAAA | 17 | 1st 500bp of DNAseI HS region, overlapping transcription factor binding sites | 1133 |
| myoC-827 | + | AGAGGAAACCUCUGCCG | 17 | 1st 500bp of DNAseI HS region, overlapping transcription factor binding sites | 1134 |
| myoC-796 | + | AGCAGGGGGCGCUAGGG | 17 | 1st 500bp of DNAseI HS region, overlapping transcription factor binding sites | 1135 |
| myoC-758 | − | AGCCCUGCAAGCACCCG | 17 | 1st 500bp of DNAseI HS region, overlapping transcription factor binding sites | 1136 |
| myoC-776 | + | AGCGCUGUGACUGAUGG | 17 | 1st 500bp of DNAseI HS region, overlapping transcription factor binding sites | 1137 |
| myoC-820 | + | AGGACACCCAGGACCCC | 17 | 1st 500bp of DNAseI HS region, overlapping transcription factor binding sites | 1138 |
| myoC-780 | + | AGGAGGCUUGGAAGACU | 17 | 1st 500bp of DNAseI HS region, overlapping transcription factor binding sites | 1139 |
| myoC-794 | + | AGGCAGCAGGGGGCGCU | 17 | 1st 500bp of DNAseI HS region, overlapping transcription factor binding sites | 1140 |
| myoC-797 | + | AGGGGGCGCUAGGGAGG | 17 | 1st 500bp of DNAseI HS region, overlapping transcription factor binding sites | 1141 |
| myoC-753 | − | AGGUUUCCUCUCCAGCU | 17 | 1st 500bp of DNAseI HS region, overlapping transcription factor binding sites | 1142 |
| myoC-773 | − | AGUCACAGCGCUGCAGC | 17 | 1st 500bp of DNAseI HS region, overlapping transcription factor binding sites | 1143 |

TABLE 5C-continued

| 3rd Tier | | | | | |
|---|---|---|---|---|---|
| selected based on location in promoter region | | | | | |
| gRNA Name | DNA Strand | Targeting Domain | Target Site Length | Location | SEQ ID NO |
| myoC-809 | + | AUUUUGUCUCUGGUGUC | 17 | 1st 500bp of DNAsel HS region, overlapping transcription factor binding sites | 1144 |
| myoC-813 | + | CAAAACAACCAGUGGCA | 17 | 1st 500bp of DNAsel HS region, overlapping transcription factor binding sites | 1145 |
| myoC-815 | + | CAACCAGUGGCACGGGC | 17 | 1st 500bp of DNAsel HS region, overlapping transcription factor binding sites | 1146 |
| myoC-760 | − | CAAGCACCCGGGGUCCU | 17 | 1st 500bp of DNAsel HS region, overlapping transcription factor binding sites | 1147 |
| myoC-792 | + | CACGAUGGAGGCAGCAG | 17 | 1st 500bp of DNAsel HS region, overlapping transcription factor binding sites | 1148 |
| myoC-811 | + | CAGAAAUAGAAAGCAAC | 17 | 1st 500bp of DNAsel HS region, overlapping transcription factor binding sites | 1149 |
| myoC-803 | + | CAGCACUGGGUUUAAGU | 17 | 1st 500bp of DNAsel HS region, overlapping transcription factor binding sites | 1150 |
| myoC-819 | + | CAGGACACCCAGGACCC | 17 | 1st 500bp of DNAsel HS region, overlapping transcription factor binding sites | 1151 |
| myoC-816 | + | CAGUGGCACGGGCUGGC | 17 | 1st 500bp of DNAsel HS region, overlapping transcription factor binding sites | 1152 |
| myoC-800 | + | CGCACAAUUCUUCAAGA | 17 | 1st 500bp of DNAsel HS region, overlapping transcription factor binding sites | 1153 |
| myoC-770 | − | CGCAGCAUCCCUUAACA | 17 | 1st 500bp of DNAsel HS region, overlapping transcription factor binding sites | 1154 |
| myoC-787 | + | CGGGCUUGGGGGCCUCC | 17 | 1st 500bp of DNAsel HS region, overlapping transcription factor binding sites | 1155 |
| myoC-761 | − | CUGCCAGCCCGUGCCAC | 17 | 1st 500bp of DNAsel HS region, overlapping transcription factor binding sites | 1156 |
| myoC-767 | − | CUGCCCUACCUUCGUGG | 17 | 1st 500bp of DNAsel HS region, overlapping transcription factor binding sites | 1157 |

TABLE 5C-continued

| 3rd Tier | | | | | |
|---|---|---|---|---|---|
| | selected based on location in promoter region | | | | |
| gRNA Name | DNA Strand | Targeting Domain | Target Site Length | Location | SEQ ID NO |
| myoC-782 | + | CUUGGAAGACUCGGGCU | 17 | 1st 500bp of DNAsel HS region, overlapping transcription factor binding sites | 1158 |
| myoC-807 | + | UCACCUCCACGAAGGUA | 17 | 1st 500bp of DNAsel HS region, overlapping transcription factor binding sites | 1159 |
| myoC-766 | - | UCACUGCCCUACCUUCG | 17 | 1st 500bp of DNAsel HS region, overlapping transcription factor binding sites | 1160 |
| myoC-802 | + | UCCUUUCUUUCAGCACU | 17 | 1st 500bp of DNAsel HS region, overlapping transcription factor binding sites | 1161 |
| myoC-786 | + | UCGGGCUUGGGGGCCUC | 17 | 1st 500bp of DNAsel HS region, overlapping transcription factor binding sites | 1162 |
| myoC-779 | + | UGAUGGAGGAGGAGGCU | 17 | 1st 500bp of DNAsel HS region, overlapping transcription factor binding sites | 1163 |
| myoC-775 | + | UGCAGCGCUGUGACUGA | 17 | 1st 500bp of DNAsel HS region, overlapping transcription factor binding sites | 1164 |
| myoC-823 | + | UGCAGGGCUCCCCCAGC | 17 | 1st 500bp of DNAsel HS region, overlapping transcription factor binding sites | 1165 |
| myoC-784 | + | UGGAAGACUCGGGCUUG | 17 | 1st 500bp of DNAsel HS region, overlapping transcription factor binding sites | 1166 |
| myoC-774 | + | UUCACGGGAAGCGAGGC | 17 | 1st 500bp of DNAsel HS region, overlapping transcription factor binding sites | 1167 |
| myoC-801 | + | UUCCUUUCUUUCAGCAC | 17 | 1st 500bp of DNAsel HS region, overlapping transcription factor binding sites | 1168 |
| myoC-783 | + | UUGGAAGACUCGGGCUU | 17 | 1st 500bp of DNAsel HS region, overlapping transcription factor binding sites | 1169 |
| myoC-763 | - | UUUGUUAUCACUCUCUA | 17 | 1st 500bp of DNAsel HS region, overlapping transcription factor binding sites | 1170 |
| myoC-762 | - | UUUUGUUAUCACUCUCU | 17 | 1st 500bp of DNAsel HS region, overlapping transcription factor binding sites | 1171 |

TABLE 5C-continued

| gRNA Name | DNA Strand | Targeting Domain | Target Site Length | Location | SEQ ID NO |
|---|---|---|---|---|---|
| | | 3rd Tier | | | |
| | | selected based on location in promoter region | | | |
| myoC-874 | + | AAGACAGAGGUGGCCACGUG | 20 | within 500bp upstream of transcription start site | 1172 |
| myoC-894 | + | AAGUCCUUUAAGACGUAGCA | 20 | within 500bp upstream of transcription start site | 1173 |
| myoC-834 | − | AAUCAGCACACCAGUAGUCC | 20 | within 500bp upstream of transcription start site | 1174 |
| myoC-850 | − | ACCUCUGUCUUCCCCCAUGA | 20 | within 500bp upstream of transcription start site | 1175 |
| myoC-846 | − | ACUCCAAACAGACUUCUGGA | 20 | within 500bp upstream of transcription start site | 1176 |
| myoC-868 | + | ACUGGGGAGCCAGCCCUUCA | 20 | within 500bp upstream of transcription start site | 1177 |
| myoC-891 | + | ACUGUGCCAGGCACUAUGCU | 20 | within 500bp upstream of transcription start site | 1178 |
| myoC-845 | − | AGAAACUCCAAACAGACUUC | 20 | within 500bp upstream of transcription start site | 1179 |
| myoC-867 | + | AGAGAGGUUUAUAUAUACUG | 20 | within 500bp upstream of transcription start site | 1180 |
| myoC-876 | + | AGAGGUGGCCACGUGAGGCU | 20 | within 500bp upstream of transcription start site | 1181 |
| myoC-840 | − | AGAUAUAGGAACUAUUAUUG | 20 | within 500bp upstream of transcription start site | 1182 |
| myoC-856 | − | AGCUCGGGCAUGAGCCAGCA | 20 | within 500bp upstream of transcription start site | 1183 |
| myoC-842 | − | AGGAACUAUUAUUGGGGUAU | 20 | within 500bp upstream of transcription start site | 1184 |
| myoC-886 | + | AUAGUUCCUAUAUCUCCACC | 20 | within 500bp upstream of transcription start site | 1185 |
| myoC-854 | − | AUAUAAACCUCUCUGGAGCU | 20 | within 500bp upstream of transcription start site | 1186 |
| myoC-893 | + | CAAGUCCUUUAAGACGUAGC | 20 | within 500bp upstream of transcription start site | 1187 |
| myoC-833 | − | CAAUGAGUUUGCAGAGUGAA | 20 | within 500bp upstream of transcription start site | 1188 |
| myoC-888 | + | CACACUUACACCAGGACUAC | 20 | within 500bp upstream of transcription start site | 1189 |

TABLE 5C-continued

| 3rd Tier | | | | | |
|---|---|---|---|---|---|
| selected based on location in promoter region | | | | | |
| gRNA Name | DNA Strand | Targeting Domain | Target Site Length | Location | SEQ ID NO |
| myoC-887 | + | CACGUACACACACUUACACC | 20 | within 500bp upstream of transcription start site | 1190 |
| myoC-866 | + | CAGAGAGGUUUAUAUAUACU | 20 | within 500bp upstream of transcription start site | 1191 |
| myoC-875 | + | CAGAGGUGGCCACGUGAGGC | 20 | within 500bp upstream of transcription start site | 1192 |
| myoC-849 | − | CAGCCCCACCCAGCCUCACG | 20 | within 500bp upstream of transcription start site | 1193 |
| myoC-832 | − | CAUAGUGCCUGGCACAGUGC | 20 | within 500bp upstream of transcription start site | 1194 |
| myoC-865 | + | CCAGAGAGGUUUAUAUAUAC | 20 | within 500bp upstream of transcription start site | 1195 |
| myoC-892 | + | CCAGGCACUAUGCUAGGAAC | 20 | within 500bp upstream of transcription start site | 1196 |
| myoC-853 | − | CCAGUAUAUAUAAACCUCUC | 20 | within 500bp upstream of transcription start site | 1197 |
| myoC-831 | − | CCAGUUCCUAGCAUAGUGCC | 20 | within 500bp upstream of transcription start site | 1198 |
| myoC-872 | + | CCCUUCAUGGGGGAAGACAG | 20 | within 500bp upstream of transcription start site | 1199 |
| myoC-851 | − | CCUCUGUCUUCCCCCAUGAA | 20 | within 500bp upstream of transcription start site | 1200 |
| myoC-864 | + | CUCAUGCCCGAGCUCCAGAG | 20 | within 500bp upstream of transcription start site | 1201 |
| myoC-862 | + | CUGAGAGGUGCCUGGAUGGG | 20 | within 500bp upstream of transcription start site | 1202 |
| myoC-859 | + | CUGCUGUGCUGAGAGGUGCC | 20 | within 500bp upstream of transcription start site | 1203 |
| myoC-869 | + | CUGGGGAGCCAGCCCUUCAU | 20 | within 500bp upstream of transcription start site | 1204 |
| myoC-882 | + | CUGGGUGGGGCUGUGCACAG | 20 | within 500bp upstream of transcription start site | 1205 |
| myoC-889 | + | CUGGUGUGCUGAUUUCAACA | 20 | within 500bp upstream of transcription start site | 1206 |
| myoC-829 | − | CUGUCCCUGCUACGUCUUAA | 20 | within 500bp upstream of transcription start site | 1207 |

TABLE 5C-continued

| 3rd Tier | | | | | |
|---|---|---|---|---|---|
| | selected based on location in promoter region | | | | |
| gRNA Name | DNA Strand | Targeting Domain | Target Site Length | Location | SEQ ID NO |
| myoC-885 | + | UAACCUUCCAGAAGUCUGUU | 20 | within 500bp upstream of transcription start site | 1208 |
| myoC-830 | - | UACGUCUUAAAGGACUUGUU | 20 | within 500bp upstream of transcription start site | 1209 |
| myoC-841 | - | UAGGAACUAUUAUUGGGGUA | 20 | within 500bp upstream of transcription start site | 1210 |
| myoC-855 | - | UAUAAACCUCUCUGGAGCUC | 20 | within 500bp upstream of transcription start site | 1211 |
| myoC-879 | + | UGGCCACGUGAGGCUGGGUG | 20 | within 500bp upstream of transcription start site | 1212 |
| myoC-870 | + | UGGGGAGCCAGCCCUUCAUG | 20 | within 500bp upstream of transcription start site | 1213 |
| myoC-843 | - | UGGGGUAUGGGUGCAUAAAU | 20 | within 500bp upstream of transcription start site | 1214 |
| myoC-883 | + | UGGGUGGGGCUGUGCACAGG | 20 | within 500bp upstream of transcription start site | 1215 |
| myoC-852 | - | UGUCUUCCCCCAUGAAGGGC | 20 | within 500bp upstream of transcription start site | 1216 |
| myoC-860 | + | UGUGCUGAGAGGUGCCUGGA | 20 | within 500bp upstream of transcription start site | 1217 |
| myoC-836 | - | UGUGUGUGUGUAAAACCAGG | 20 | within 500bp upstream of transcription start site | 1218 |
| myoC-847 | - | UUAUUUUCUAAGAAUCUUGC | 20 | within 500bp upstream of transcription start site | 1219 |
| myoC-873 | + | UUCAUGGGGGAAGACAGAGG | 20 | within 500bp upstream of transcription start site | 1220 |
| myoC-890 | + | UUGAGAACCUGCACUGUGCC | 20 | within 500bp upstream of transcription start site | 1221 |
| myoC-903 | - | AAACCAGGUGGAGAUAU | 17 | within 500bp upstream of transcription start site | 1222 |
| myoC-921 | - | AAACCUCUCUGGAGCUC | 17 | within 500bp upstream of transcription start site | 1223 |
| myoC-908 | - | AACUAUUAUUGGGGUAU | 17 | within 500bp upstream of transcription start site | 1224 |
| myoC-911 | - | AACUCCAAACAGACUUC | 17 | within 500bp upstream of transcription start site | 1225 |

TABLE 5C-continued

| 3rd Tier | | | | | |
|---|---|---|---|---|---|
| | selected based on location in promoter region | | | | |
| gRNA Name | DNA Strand | Targeting Domain | Target Site Length | Location | SEQ ID NO |
| myoC-940 | + | ACAGAGGUGGCCACGUG | 17 | within 500bp upstream of transcription start site | 1226 |
| myoC-954 | + | ACUUACACCAGGACUAC | 17 | within 500bp upstream of transcription start site | 1227 |
| myoC-956 | + | AGAACCUGCACUGUGCC | 17 | within 500bp upstream of transcription start site | 1228 |
| myoC-928 | + | AGAGGUGCCUGGAUGGG | 17 | within 500bp upstream of transcription start site | 1229 |
| myoC-932 | + | AGAGGUUUAUAUAUACU | 17 | within 500bp upstream of transcription start site | 1230 |
| myoC-923 | - | AGCAAGGCCACCCAUCC | 17 | within 500bp upstream of transcription start site | 1231 |
| myoC-924 | + | AGCUCUGCUGUGCUGAG | 17 | within 500bp upstream of transcription start site | 1232 |
| myoC-941 | + | AGGUGGCCACGUGAGGC | 17 | within 500bp upstream of transcription start site | 1233 |
| myoC-898 | - | AGUGCCUGGCACAGUGC | 17 | within 500bp upstream of transcription start site | 1234 |
| myoC-905 | - | AUAUAGGAACUAUUAUU | 17 | within 500bp upstream of transcription start site | 1235 |
| myoC-930 | + | AUGCCCGAGCUCCAGAG | 17 | within 500bp upstream of transcription start site | 1236 |
| myoC-939 | + | AUGGGGGAAGACAGAGG | 17 | within 500bp upstream of transcription start site | 1237 |
| myoC-900 | - | CAGCACACCAGUAGUCC | 17 | within 500bp upstream of transcription start site | 1238 |
| myoC-912 | - | CCAAACAGACUUCUGGA | 17 | within 500bp upstream of transcription start site | 1239 |
| myoC-945 | + | CCACGUGAGGCUGGGUG | 17 | within 500bp upstream of transcription start site | 1240 |
| myoC-915 | - | CCCCACCCAGCCUCACG | 17 | within 500bp upstream of transcription start site | 1241 |
| myoC-951 | + | CCUUCCAGAAGUCUGUU | 17 | within 500bp upstream of transcription start site | 1242 |
| myoC-927 | + | CUGAGAGGUGCCUGGAU | 17 | within 500bp upstream of transcription start site | 1243 |

TABLE 5C-continued

| gRNA Name | DNA Strand | Targeting Domain | Target Site Length | Location | SEQ ID NO |
|---|---|---|---|---|---|
| 3rd Tier | | | | | |
| | selected based on location in promoter region | | | | |
| myoC-917 | - | CUGUCUUCCCCCAUGAA | 17 | within 500bp upstream of transcription start site | 1244 |
| myoC-925 | + | CUGUGCUGAGAGGUGCC | 17 | within 500bp upstream of transcription start site | 1245 |
| myoC-918 | - | CUUCCCCCAUGAAGGGC | 17 | within 500bp upstream of transcription start site | 1246 |
| myoC-920 | - | UAAACCUCUCUGGAGCU | 17 | within 500bp upstream of transcription start site | 1247 |
| myoC-906 | - | UAUAGGAACUAUUAUUG | 17 | within 500bp upstream of transcription start site | 1248 |
| myoC-895 | - | UCCCUGCUACGUCUUAA | 17 | within 500bp upstream of transcription start site | 1249 |
| myoC-960 | + | UCCUUUAAGACGUAGCA | 17 | within 500bp upstream of transcription start site | 1250 |
| myoC-922 | - | UCGGGCAUGAGCCAGCA | 17 | within 500bp upstream of transcription start site | 1251 |
| myoC-916 | - | UCUGUCUUCCCCCAUGA | 17 | within 500bp upstream of transcription start site | 1252 |
| myoC-914 | - | UCUUGCUGGCAGCGUGA | 17 | within 500bp upstream of transcription start site | 1253 |
| myoC-899 | - | UGAGUUUGCAGAGUGAA | 17 | within 500bp upstream of transcription start site | 1254 |
| myoC-929 | + | UGGAUGGGUGGCCUUGC | 17 | within 500bp upstream of transcription start site | 1255 |
| myoC-950 | + | UGGGGCUGUGCACAGGG | 17 | within 500bp upstream of transcription start site | 1256 |
| myoC-946 | + | UGGGUGGGGCUGUGCAC | 17 | within 500bp upstream of transcription start site | 1257 |
| myoC-901 | - | UGUGUGUGUGUAAAACC | 17 | within 500bp upstream of transcription start site | 1258 |
| myoC-938 | + | UUCAUGGGGGAAGACAG | 17 | within 500bp upstream of transcription start site | 1259 |
| myoC-913 | - | UUUUCUAAGAAUCUUGC | 17 | within 500bp upstream of transcription start site | 1260 |

Table 5D provides exemplary targeting domains for repressing (i.e., knocking down or decreasing) expression of the MYOC gene selected according to the fourth tier parameters, and are selected based on the location in the promoter region that are not described in Tables 5A-C. In an embodiment, the targeting domain is the exact complement of the target domain. Any of the targeting domains in the table can be used with a *S. pyogenes* eiCas9 molecule to cause a steric block at the promoter region to block transcription resulting in the repression of the MYOC gene. Alternatively, any of the targeting domains in the table can be used with a *S. pyogenes* eiCas9 fused to a transcriptional repressor to decrease transcription and therefore downregulate gene expression.

TABLE 5D

4th Tier located in promoter region but not in regions described above

| gRNA Name | DNA Strand | Targeting Domain | Target Site Length | SEQ ID NO |
|---|---|---|---|---|
| myoC-961 | – | CAUCUGAGCUGGAGACUCCU | 20 | 1261 |
| myoC-962 | – | GCUGGAGACUCCUUGGCUCC | 20 | 1262 |
| myoC-963 | – | CUUGGCUCCAGGCUCCAGAA | 20 | 1263 |
| myoC-964 | – | UCCAGGCUCCAGAAAGGAAA | 20 | 1264 |
| myoC-965 | – | GCUCCAGAAAGGAAAUGGAG | 20 | 1265 |
| myoC-966 | – | CUCCAGAAAGGAAAUGGAGA | 20 | 1266 |
| myoC-967 | – | GGAGAGGGAAACUAGUCUAA | 20 | 1267 |
| myoC-968 | – | AACUAGUCUAACGGAGAAUC | 20 | 1268 |
| myoC-969 | – | UAGUCUAACGGAGAAUCUGG | 20 | 1269 |
| myoC-970 | – | AGUCUAACGGAGAAUCUGGA | 20 | 1270 |
| myoC-971 | – | GUCUAACGGAGAAUCUGGAG | 20 | 1271 |
| myoC-972 | – | AGGGGACAGUGUUUCCUCAG | 20 | 1272 |
| myoC-973 | – | GGGGACAGUGUUUCCUCAGA | 20 | 1273 |
| myoC-974 | – | CAGUGUUUCCUCAGAGGGAA | 20 | 1274 |
| myoC-975 | – | AGUGUUUCCUCAGAGGGAAA | 20 | 1275 |
| myoC-976 | – | GUGUUUCCUCAGAGGGAAAG | 20 | 1276 |
| myoC-977 | – | GGAAAGGGGCCUCCACGUCC | 20 | 1277 |
| myoC-978 | – | UCCACGUCCAGGAGAAUUCC | 20 | 1278 |
| myoC-979 | – | ACGUCCAGGAGAAUUCCAGG | 20 | 1279 |
| myoC-980 | – | UCCAGGAGAAUUCCAGGAGG | 20 | 1280 |
| myoC-981 | – | CCAGGAGAAUUCCAGGAGGU | 20 | 1281 |
| myoC-982 | – | CAGGAGAAUUCCAGGAGGUG | 20 | 1282 |
| myoC-983 | – | UUCCAGGAGGUGGGGACUGC | 20 | 1283 |
| myoC-984 | – | UCCAGGAGGUGGGGACUGCA | 20 | 1284 |
| myoC-985 | – | GAGGUGGGGACUGCAGGGAG | 20 | 1285 |
| myoC-986 | – | AGGUGGGGACUGCAGGGAGU | 20 | 1286 |

TABLE 5D-continued

4th Tier located in promoter region but not in regions described above

| gRNA Name | DNA Strand | Targeting Domain | Target Site Length | SEQ ID NO |
|---|---|---|---|---|
| myoC-987 | – | GGUGGGGACUGCAGGGAGUG | 20 | 1287 |
| myoC-988 | – | ACUGCAGGGAGUGGGGACGC | 20 | 1288 |
| myoC-989 | – | CUGCAGGGAGUGGGGACGCU | 20 | 1289 |
| myoC-990 | – | UGCAGGGAGUGGGGACGCUG | 20 | 1290 |
| myoC-991 | – | GUGGGGACGCUGGGGCUGAG | 20 | 1291 |
| myoC-992 | – | UGGGGACGCUGGGGCUGAGC | 20 | 1292 |
| myoC-993 | – | GGGGCUGAGCGGGUGCUGAA | 20 | 1293 |
| myoC-994 | – | CUGAGCGGGUGCUGAAAGGC | 20 | 1294 |
| myoC-995 | – | GCGGGUGCUGAAAGGCAGGA | 20 | 1295 |
| myoC-996 | – | UGAAAGGCAGGAAGGUGAAA | 20 | 1296 |
| myoC-997 | – | GAAAGGCAGGAAGGUGAAAA | 20 | 1297 |
| myoC-998 | – | GCAGGAAGGUGAAAAGGGCA | 20 | 1298 |
| myoC-999 | – | CAGAUGUUCAGUGUUGUUCA | 20 | 1299 |
| myoC-1000 | – | AGAUGUUCAGUGUUGUUCAC | 20 | 1300 |
| myoC-1001 | – | GAUGUUCAGUGUUGUUCACG | 20 | 1301 |
| myoC-1002 | – | UUCAGUGUUGUUCACGGGGC | 20 | 1302 |
| myoC-1003 | – | UCAGUGUUGUUCACGGGGCU | 20 | 1303 |
| myoC-1004 | – | CUUUUUAUCUUUUCUCUGCU | 20 | 1304 |
| myoC-1005 | – | UUUAUCUUUUCUCUGCUUGG | 20 | 1305 |
| myoC-1006 | – | AGAAGAAGUCUAUUUCAUGA | 20 | 1306 |
| myoC-1007 | – | GAAGAAGUCUAUUUCAUGAA | 20 | 1307 |
| myoC-1008 | – | AAGUCAGCUGUUAAAAUUCC | 20 | 1308 |
| myoC-1009 | – | AGUCAGCUGUUAAAAUUCCA | 20 | 1309 |
| myoC-1010 | – | UUAAAAUUCCAGGGUGUGCA | 20 | 1310 |
| myoC-1011 | – | UAAAAUUCCAGGGUGUGCAU | 20 | 1311 |
| myoC-1012 | – | GCAUGGGUUUUCCUUCACGA | 20 | 1312 |
| myoC-1013 | – | UCACGAAGGCCUUUAUUUAA | 20 | 1313 |
| myoC-1014 | – | CACGAAGGCCUUUAUUUAAU | 20 | 1314 |
| myoC-1015 | – | CCUUUAUUUAAUGGGAAUAU | 20 | 1315 |
| myoC-1016 | – | AGGAAGCGAGCUCAUUUCCU | 20 | 1316 |
| myoC-1017 | – | UUUCCUAGGCCGUUAAUUCA | 20 | 1317 |
| myoC-1018 | – | UAAUUCACGGAAGAAGUGAC | 20 | 1318 |
| myoC-1019 | – | GUCUUUUCUUUCAUGUCUUC | 20 | 1319 |
| myoC-1020 | – | UCUUUUCUUUCAUGUCUUCU | 20 | 1320 |
| myoC-1021 | – | UGGGCAACUACUCAGCCCUG | 20 | 1321 |
| myoC-1022 | – | GCAACUACUCAGCCCUGUGG | 20 | 1322 |

TABLE 5D-continued

4th Tier located in promoter region but not in regions described above

| gRNA Name | DNA Strand | Targeting Domain | Target Site Length | SEQ ID NO |
|---|---|---|---|---|
| myoC-1023 | - | ACUCAGCCCUGUGGUGGACU | 20 | 1323 |
| myoC-1024 | - | UGGACUUGGCUUAUGCAAGA | 20 | 1324 |
| myoC-1025 | - | UGCAAGACGGUCGAAAACCU | 20 | 1325 |
| myoC-1026 | - | CGGUCGAAAACCUUGGAAUC | 20 | 1326 |
| myoC-1027 | - | AACCUUGGAAUCAGGAGACU | 20 | 1327 |
| myoC-1028 | - | AGGAGACUCGGUUUUCUUUC | 20 | 1328 |
| myoC-1029 | - | UUUCUUUCUGGUUCUGCCAU | 20 | 1329 |
| myoC-1030 | - | UUUCUGGUUCUGCCAUUGGU | 20 | 1330 |
| myoC-1031 | - | AUUGGUUGGCUGUGCGACCG | 20 | 1331 |
| myoC-1032 | - | UUGGUUGGCUGUGCGACCGU | 20 | 1332 |
| myoC-1033 | - | GGCAAGUGUCUCUCCUUCCC | 20 | 1333 |
| myoC-1034 | - | GCAAGUGUCUCUCCUUCCCU | 20 | 1334 |
| myoC-1035 | - | CUUCCCUGUGAUUCUCUGUG | 20 | 1335 |
| myoC-1036 | - | UUCCCUGUGAUUCUCUGUGA | 20 | 1336 |
| myoC-1037 | - | UCCCUGUGAUUCUCUGUGAG | 20 | 1337 |
| myoC-1038 | - | CCCUGUGAUUCUCUGUGAGG | 20 | 1338 |
| myoC-1039 | - | CCUGUGAUUCUCUGUGAGGG | 20 | 1339 |
| myoC-1040 | - | CUGUGAGGGGGGAUGUUGAG | 20 | 1340 |
| myoC-1041 | - | UGUGAGGGGGGAUGUUGAGA | 20 | 1341 |
| myoC-1042 | - | GUGAGGGGGGAUGUUGAGAG | 20 | 1342 |
| myoC-1043 | - | GGGGGGAUGUUGAGAGGGGA | 20 | 1343 |
| myoC-1044 | - | GGGAUGUUGAGAGGGGAAGG | 20 | 1344 |
| myoC-1045 | - | AGAGGGGAAGGAGGCAGAGC | 20 | 1345 |
| myoC-1046 | - | AGCUGGAGCAGCUGAGCCAC | 20 | 1346 |
| myoC-1047 | - | GCUGGAGCAGCUGAGCCACA | 20 | 1347 |
| myoC-1048 | - | CUGGAGCAGCUGAGCCACAG | 20 | 1348 |
| myoC-1049 | - | GAGCAGCUGAGCCACAGGGG | 20 | 1349 |
| myoC-1050 | - | CAGCUGAGCCACAGGGGAGG | 20 | 1350 |
| myoC-1051 | - | CUGAGCCACAGGGGAGGUGG | 20 | 1351 |
| myoC-1052 | - | UGAGCCACAGGGGAGGUGGA | 20 | 1352 |
| myoC-1053 | - | GAGCCACAGGGGAGGUGGAG | 20 | 1353 |
| myoC-1054 | - | AGCCACAGGGGAGGUGGAGG | 20 | 1354 |
| myoC-1055 | - | CAGGGGAGGUGGAGGGGGAC | 20 | 1355 |
| myoC-1056 | - | GGAGGUGGAGGGGGACAGGA | 20 | 1356 |
| myoC-1057 | - | GUGGAGGGGGACAGGAAGGC | 20 | 1357 |
| myoC-1058 | - | ACAGGAAGGCAGGCAGAAGC | 20 | 1358 |
| myoC-1059 | - | CAGGAAGGCAGGCAGAAGCU | 20 | 1359 |
| myoC-1060 | - | CACUGAUCACGUCAGACUCC | 20 | 1360 |
| myoC-1061 | - | ACCGAGAGCCACAAUGCUUC | 20 | 1361 |
| myoC-1062 | - | CCUUCCCUAAGCAUAGACAA | 20 | 1362 |
| myoC-1063 | - | AAAAGAAUGCAGAGACUAAC | 20 | 1363 |
| myoC-1064 | - | AGAAUGCAGAGACUAACUGG | 20 | 1364 |
| myoC-1065 | - | AACUGGUGGUAGCUUUUGCC | 20 | 1365 |
| myoC-1066 | - | UUUGCCUGGCAUUCAAAAAC | 20 | 1366 |
| myoC-1067 | - | UUGCCUGGCAUUCAAAAACU | 20 | 1367 |
| myoC-1068 | - | AAAAACUGGGCCAGAGCAAG | 20 | 1368 |
| myoC-1069 | + | CUGGCAUUUUCCACUUGCUC | 20 | 1369 |
| myoC-1070 | + | UGGCCCAGUUUUUGAAUGCC | 20 | 1370 |
| myoC-1071 | + | GUUAGUCUCUGCAUUCUUUU | 20 | 1371 |
| myoC-1072 | + | UCUGCAUUCUUUUUGGUUAU | 20 | 1372 |
| myoC-1073 | + | AAAUGCCAUUGUCUAUGCUU | 20 | 1373 |
| myoC-1074 | + | AAUGCCAUUGUCUAUGCUUA | 20 | 1374 |
| myoC-1075 | + | CCAUUGUCUAUGCUUAGGGA | 20 | 1375 |
| myoC-1076 | + | AUGCUUAGGGAAGGAAAAUG | 20 | 1376 |
| myoC-1077 | + | GGGAAGGAAAAUGUGGCUGU | 20 | 1377 |
| myoC-1078 | + | GGAAGGAAAAUGUGGCUGUU | 20 | 1378 |
| myoC-1079 | + | UGAGCUUUCCUGAAGCAUUG | 20 | 1379 |
| myoC-1080 | + | UCCUGAAGCAUUGUGGCUCU | 20 | 1380 |
| myoC-1081 | + | AGCAUUGUGGCUCUCGGUCC | 20 | 1381 |
| myoC-1082 | + | GGAGUCUGACGUGAUCAGUG | 20 | 1382 |
| myoC-1083 | + | ACGUGAUCAGUGAGGACUGA | 20 | 1383 |
| myoC-1084 | + | GUCCCCCUCCACCUCCCCUG | 20 | 1384 |
| myoC-1085 | + | CCCCCCUCACAGAGAAUCAC | 20 | 1385 |
| myoC-1086 | + | CCCCCUCACAGAGAAUCACA | 20 | 1386 |
| myoC-1087 | + | CACAGAACACGAGAGCUGCA | 20 | 1387 |
| myoC-1088 | + | ACAGAACACGAGAGCUGCAA | 20 | 1388 |
| myoC-1089 | + | CUUUAUAGCAGAGAAGACUA | 20 | 1389 |
| myoC-1090 | + | AGCAGAGAAGACUAUGGCCC | 20 | 1390 |
| myoC-1091 | + | GCAGAGAAGACUAUGGCCCA | 20 | 1391 |
| myoC-1092 | + | AGAAGACUAUGGCCCAGGGA | 20 | 1392 |
| myoC-1093 | + | GAAGGAGAGACACUUGCCCA | 20 | 1393 |

TABLE 5D-continued

| 4th Tier | | | | |
|---|---|---|---|---|
| | located in promoter region but not in regions described above | | | |
| gRNA Name | DNA Strand | Targeting Domain | Target Site Length | SEQ ID NO |
| myoC-1094 | + | ACGGUCGCACAGCCAACCAA | 20 | 1394 |
| myoC-1095 | + | AACCGAGUCUCCUGAUUCCA | 20 | 1395 |
| myoC-1096 | + | GCAUAAGCCAAGUCCACCAC | 20 | 1396 |
| myoC-1097 | + | CAUAAGCCAAGUCCACCACA | 20 | 1397 |
| myoC-1098 | + | UCACUUCUUCCGUGAAUUAA | 20 | 1398 |
| myoC-1099 | + | CUUCCGUGAAUUAACGGCCU | 20 | 1399 |
| myoC-1100 | + | CCUAUAUUCCCAUUAAAUAA | 20 | 1400 |
| myoC-1101 | + | UUAAAUAAAGGCCUUCGUGA | 20 | 1401 |
| myoC-1102 | + | AGGAAAACCCAUGCACACCC | 20 | 1402 |
| myoC-1103 | + | CAAGCAGAGAAAAGAUAAAA | 20 | 1403 |
| myoC-1104 | + | GAAAAGAUAAAAAGGCUCAC | 20 | 1404 |
| myoC-1105 | + | AAAAGGCUCACAGGAAGCAA | 20 | 1405 |
| myoC-1106 | + | CGUGAACAACACUGAACAUC | 20 | 1406 |
| myoC-1107 | + | GUGAACAACACUGAACAUCU | 20 | 1407 |
| myoC-1108 | + | UCCCUGCAGUCCCCACCUCC | 20 | 1408 |
| myoC-1109 | + | CCCACCUCCUGGAAUUCUCC | 20 | 1409 |
| myoC-1110 | + | UCCUGGAAUUCUCCUGGACG | 20 | 1410 |
| myoC-1111 | + | UGGAAUUCUCCUGGACGUGG | 20 | 1411 |
| myoC-1112 | + | UGGAGGCCCCUUUCCCUCUG | 20 | 1412 |
| myoC-1113 | + | UUCCCUCUCCAUUUCCUUUC | 20 | 1413 |
| myoC-1114 | + | UCCAUUUCCUUUCUGGAGCC | 20 | 1414 |
| myoC-1115 | + | CUUUCUGGAGCCUGGAGCCA | 20 | 1415 |
| myoC-1116 | + | GUCUCCAGCUCAGAUGCACC | 20 | 1416 |
| myoC-1117 | − | AGCAGUGACUGCUGACAGCA | 20 | 1417 |
| myoC-1118 | − | CACGGAGUGACCUGCAGCGC | 20 | 1418 |
| myoC-1119 | − | ACGGAGUGACCUGCAGCGCA | 20 | 1419 |
| myoC-1120 | − | CGGAGUGACCUGCAGCGCAG | 20 | 1420 |
| myoC-1121 | − | AGUGACCUGCAGCGCAGGGG | 20 | 1421 |
| myoC-1122 | − | GGGGAGGAGAAGAAAAAGAG | 20 | 1422 |
| myoC-1123 | − | GGGAGGAGAAGAAAAAGAGA | 20 | 1423 |
| myoC-1124 | − | AAGAAAGACAGAUUCAUUCA | 20 | 1424 |
| myoC-1125 | − | AGAAAGACAGAUUCAUUCAA | 20 | 1425 |
| myoC-1126 | − | ACAGAUUCAUUCAAGGGCAG | 20 | 1426 |
| myoC-1127 | − | CAGAUUCAUUCAAGGGCAGU | 20 | 1427 |
| myoC-1128 | − | GGGCAGUGGGAAUUGACCAC | 20 | 1428 |

TABLE 5D-continued

| 4th Tier | | | | |
|---|---|---|---|---|
| | located in promoter region but not in regions described above | | | |
| gRNA Name | DNA Strand | Targeting Domain | Target Site Length | SEQ ID NO |
| myoC-1129 | − | GGCAGUGGGAAUUGACCACA | 20 | 1429 |
| myoC-1130 | − | GAUUAUAGUCCACGUGAUCC | 20 | 1430 |
| myoC-1131 | − | AUUAUAGUCCACGUGAUCCU | 20 | 1431 |
| myoC-1132 | − | UCCACGUGAUCCUGGGUUCU | 20 | 1432 |
| myoC-1133 | − | ACGUGAUCCUGGGUUCUAGG | 20 | 1433 |
| myoC-1134 | − | GAUCCUGGGUUCUAGGAGGC | 20 | 1434 |
| myoC-1135 | − | AUCCUGGGUUCUAGGAGGCA | 20 | 1435 |
| myoC-1136 | − | UAGGAGGCAGGGCUAUAUUG | 20 | 1436 |
| myoC-1137 | − | AGGAGGCAGGGCUAUAUUGU | 20 | 1437 |
| myoC-1138 | − | GGAGGCAGGGCUAUAUUGUG | 20 | 1438 |
| myoC-1139 | − | GAGGCAGGGCUAUAUUGUGG | 20 | 1439 |
| myoC-1140 | − | AGGCAGGGCUAUAUUGUGGG | 20 | 1440 |
| myoC-1141 | − | GGGGGGAAAAAAUCAGUUCA | 20 | 1441 |
| myoC-1142 | − | GGGGGAAAAAAUCAGUUCAA | 20 | 1442 |
| myoC-1143 | − | AAAAUCAGUUCAAGGGAAGU | 20 | 1443 |
| myoC-1144 | − | AAAUCAGUUCAAGGGAAGUC | 20 | 1444 |
| myoC-1145 | − | GUAAUUCUGAGCAAGUCACA | 20 | 1445 |
| myoC-1146 | − | AAGUCACAAGGUAGUAACUG | 20 | 1446 |
| myoC-1147 | − | UUACUUAGUUUCUCCUUAUU | 20 | 1447 |
| myoC-1148 | − | UUAGGAACUCUUUUUCUCUG | 20 | 1448 |
| myoC-1149 | − | UCUGUGGAGUUAGCAGCACA | 20 | 1449 |
| myoC-1150 | − | CUGUGGAGUUAGCAGCACAA | 20 | 1450 |
| myoC-1151 | − | GCAAUCCCGUUUCUUUUAAC | 20 | 1451 |
| myoC-1152 | − | AGCCAAACAGAUUCAAGCCU | 20 | 1452 |
| myoC-1153 | − | GGUCUUGCUGACUAUAUGAU | 20 | 1453 |
| myoC-1154 | − | AAAAUGAGACUAGUACCCUU | 20 | 1454 |
| myoC-1155 | − | UUUGUAAAUGUCUCAAGUUC | 20 | 1455 |
| myoC-1156 | − | CAAACUGUGUUUCUCCACUC | 20 | 1456 |
| myoC-1157 | − | ACUGUGUUUCUCCACUCUGG | 20 | 1457 |
| myoC-1158 | − | ACUCUGGAGGUGAGUCUGCC | 20 | 1458 |
| myoC-1159 | − | CUCUGGAGGUGAGUCUGCCA | 20 | 1459 |
| myoC-1160 | − | GUGAGUCUGCCAGGGCAGUU | 20 | 1460 |
| myoC-1161 | − | ACAAGUAUUGACACUGUUGU | 20 | 1461 |
| myoC-1162 | − | AACAACAUAAAGUUGCUCAA | 20 | 1462 |
| myoC-1163 | − | AAGGCAAUCAUUAUUUCAAG | 20 | 1463 |
| myoC-1164 | − | AAAGUUACUUCUGACAGUUU | 20 | 1464 |

TABLE 5D-continued

4th Tier located in promoter region but not in regions described above

| gRNA Name | DNA Strand | Targeting Domain | Target Site Length | SEQ ID NO |
|---|---|---|---|---|
| myoC-1165 | - | GACAGUUUUGGUAUAUUUAU | 20 | 1465 |
| myoC-1166 | - | UGCUUUUUGUUUUUUCUCUU | 20 | 1466 |
| myoC-1167 | - | GCUUUUUGUUUUUUCUCUUU | 20 | 1467 |
| myoC-1168 | - | UGGGUUUAUUAAUGUAAAGC | 20 | 1468 |
| myoC-1169 | - | GGGUUUAUUAAUGUAAAGCA | 20 | 1469 |
| myoC-1170 | - | AAAGCCUGUGAAUUUGAAUG | 20 | 1470 |
| myoC-1171 | - | AUAGAGCCAUAAACUCAAAG | 20 | 1471 |
| myoC-1172 | + | UUAUUACCACUUUGAGUUUA | 20 | 1472 |
| myoC-1173 | + | GUUUAUGGCUCUAUUCGCAA | 20 | 1473 |
| myoC-1174 | + | AAAUGUUAAAUUUAGUUAGA | 20 | 1474 |
| myoC-1175 | + | UGUUAAAUUUAGUUAGAAGG | 20 | 1475 |
| myoC-1176 | + | UUUUCCUCAUUCAAAUUCAC | 20 | 1476 |
| myoC-1177 | + | AUUCAAAUUCACAGGCUUUC | 20 | 1477 |
| myoC-1178 | + | UCACAGGCUUUCUGGACUGU | 20 | 1478 |
| myoC-1179 | + | GAGAAAAAACAAAAAGCAAA | 20 | 1479 |
| myoC-1180 | + | UAAAUAUUUCCAAACUGCCC | 20 | 1480 |
| myoC-1181 | + | UGGCAGACUCACCUCCAGAG | 20 | 1481 |
| myoC-1182 | + | AGAUUCUAUUCUUAUUUGAU | 20 | 1482 |
| myoC-1183 | + | GAACUUGAGACAUUUACAAA | 20 | 1483 |
| myoC-1184 | + | AACUUGAGACAUUUACAAAU | 20 | 1484 |
| myoC-1185 | + | GUUUGUUUACAGCUGACCAA | 20 | 1485 |
| myoC-1186 | + | UUUGUUUACAGCUGACCAAA | 20 | 1486 |
| myoC-1187 | + | UCAUAUAGUCAGCAAGACCU | 20 | 1487 |
| myoC-1188 | + | GACCUAGGCUUGAAUCUGUU | 20 | 1488 |
| myoC-1189 | + | AUCUGUUUGGCUUUACUCUU | 20 | 1489 |
| myoC-1190 | + | UUUCUUCCUGUUAAAAGAAA | 20 | 1490 |
| myoC-1191 | + | UUCUUCCUGUUAAAAGAAAC | 20 | 1491 |
| myoC-1192 | + | GAGAAAAAGAGUUCCUAAUA | 20 | 1492 |
| myoC-1193 | + | CAGAAUUACUCAGCUUGUAA | 20 | 1493 |
| myoC-1194 | + | AAAAUAUAGUAUUAGAAAUC | 20 | 1494 |
| myoC-1195 | + | AGCCCUGCCUCCUAGAACCC | 20 | 1495 |
| myoC-1196 | + | UCCUAGAACCCAGGAUCACG | 20 | 1496 |
| myoC-1197 | + | CACGUGGACUAUAAUCCCUG | 20 | 1497 |
| myoC-1198 | + | CUUCUCCUCCCCUGCGCUGC | 20 | 1498 |
| myoC-1199 | + | GCAGUCACUGCUGAGCUGCG | 20 | 1499 |
| myoC-1200 | + | CAGUCACUGCUGAGCUGCGU | 20 | 1500 |
| myoC-1201 | + | AGUCACUGCUGAGCUGCGUG | 20 | 1501 |
| myoC-1202 | + | UGCUGAGCUGCGUGGGGUGC | 20 | 1502 |
| myoC-1203 | + | AGCUGCGUGGGGUGCUGGUC | 20 | 1503 |
| myoC-1204 | + | GCUGCGUGGGGUGCUGGUCA | 20 | 1504 |
| myoC-1205 | - | UUUGAAAUUAGACCUCCUGC | 20 | 1505 |
| myoC-1206 | - | UUCCCCAGAUUUCACCAAUG | 20 | 1506 |
| myoC-1207 | - | GAUUUCACCAAUGAGGUUCU | 20 | 1507 |
| myoC-1208 | - | CAGAGUAAGAACUGAUUUAG | 20 | 1508 |
| myoC-1209 | - | UUAGAGGCUAACAUUGACAU | 20 | 1509 |
| myoC-1210 | - | GGGAAAUCUGCCGCUUCUAU | 20 | 1510 |
| myoC-1211 | - | UUCUAUAGGAAUGCUCUCCC | 20 | 1511 |
| myoC-1212 | - | GGAAUGCUCUCCCUGGAGCC | 20 | 1512 |
| myoC-1213 | - | UGCUCUCCCUGGAGCCUGGU | 20 | 1513 |
| myoC-1214 | - | GCUCUCCCUGGAGCCUGGUA | 20 | 1514 |
| myoC-1215 | - | AGGGUGCUGUCCUUGUGUUC | 20 | 1515 |
| myoC-1216 | + | CACAAGGACAGCACCCUACC | 20 | 1516 |
| myoC-1217 | + | ACAGCACCCUACCAGGCUCC | 20 | 1517 |
| myoC-1218 | + | CAGCACCCUACCAGGCUCCA | 20 | 1518 |
| myoC-1219 | + | GGAGAGCAUUCCUAUAGAAG | 20 | 1519 |
| myoC-1220 | + | UUAAAACAACUGUGUAUCUU | 20 | 1520 |
| myoC-1221 | + | UAAAACAACUGUGUAUCUUU | 20 | 1521 |
| myoC-1222 | + | UAAUUUCAGUCUUGCAUCUC | 20 | 1522 |
| myoC-1223 | + | GUGCAUGCCAAGAACCUCAU | 20 | 1523 |
| myoC-1224 | + | AGAACCUCAUUGGUGAAAUC | 20 | 1524 |
| myoC-1225 | + | GAACCUCAUUGGUGAAAUCU | 20 | 1525 |
| myoC-1226 | + | AACCUCAUUGGUGAAAUCUG | 20 | 1526 |
| myoC-1227 | + | AUAUAAAAUAUAGAUUACAA | 20 | 1527 |
| myoC-1228 | + | UGUUAAAAACAAGAUCCAGC | 20 | 1528 |
| myoC-1229 | + | UAAAAACAAGAUCCAGCAGG | 20 | 1529 |
| myoC-1230 | + | AAAAUGUCUGUGAUUUCUAU | 20 | 1530 |
| myoC-1231 | - | CUGAGCUGGAGACUCCU | 17 | 1531 |
| myoC-1232 | - | GGAGACUCCUUGGCUCC | 17 | 1532 |
| myoC-1233 | - | GGCUCCAGGCUCCAGAA | 17 | 1533 |
| myoC-1234 | - | AGGCUCCAGAAAGGAAA | 17 | 1534 |
| myoC-1235 | - | CCAGAAAGGAAAUGGAG | 17 | 1535 |

TABLE 5D-continued

4th Tier located in promoter region but not in regions described above

| gRNA Name | DNA Strand | Targeting Domain | Target Site Length | SEQ ID NO |
|---|---|---|---|---|
| myoC-1236 | - | CAGAAAGGAAAUGGAGA | 17 | 1536 |
| myoC-1237 | - | GAGGGAAACUAGUCUAA | 17 | 1537 |
| myoC-1238 | - | UAGUCUAACGGAGAAUC | 17 | 1538 |
| myoC-1239 | - | UCUAACGGAGAAUCUGG | 17 | 1539 |
| myoC-1240 | - | CUAACGGAGAAUCUGGA | 17 | 1540 |
| myoC-1241 | - | UAACGGAGAAUCUGGAG | 17 | 1541 |
| myoC-1242 | - | GGACAGUGUUUCCUCAG | 17 | 1542 |
| myoC-1243 | - | GACAGUGUUUCCUCAGA | 17 | 1543 |
| myoC-1244 | - | UGUUUCCUCAGAGGGAA | 17 | 1544 |
| myoC-1245 | - | GUUUCCUCAGAGGGAAA | 17 | 1545 |
| myoC-1246 | - | UUUCCUCAGAGGGAAAG | 17 | 1546 |
| myoC-1247 | - | AAGGGGCCUCCACGUCC | 17 | 1547 |
| myoC-1248 | - | ACGUCCAGGAGAAUUCC | 17 | 1548 |
| myoC-1249 | - | UCCAGGAGAAUUCCAGG | 17 | 1549 |
| myoC-1250 | - | AGGAGAAUUCCAGGAGG | 17 | 1550 |
| myoC-1251 | - | GGAGAAUUCCAGGAGGU | 17 | 1551 |
| myoC-1252 | - | GAGAAUUCCAGGAGGUG | 17 | 1552 |
| myoC-1253 | - | CAGGAGGUGGGGACUGC | 17 | 1553 |
| myoC-1254 | - | AGGAGGUGGGGACUGCA | 17 | 1554 |
| myoC-1255 | - | GUGGGGACUGCAGGGAG | 17 | 1555 |
| myoC-1256 | - | UGGGGACUGCAGGGAGU | 17 | 1556 |
| myoC-1257 | - | GGGGACUGCAGGGAGUG | 17 | 1557 |
| myoC-1258 | - | GCAGGGAGUGGGGACGC | 17 | 1558 |
| myoC-1259 | - | CAGGGAGUGGGGACGCU | 17 | 1559 |
| myoC-1260 | - | AGGGAGUGGGGACGCUG | 17 | 1560 |
| myoC-1261 | - | GGGACGCUGGGGCUGAG | 17 | 1561 |
| myoC-1262 | - | GGACGCUGGGGCUGAGC | 17 | 1562 |
| myoC-1263 | - | GCUGAGCGGGUGCUGAA | 17 | 1563 |
| myoC-1264 | - | AGCGGGUGCUGAAAGGC | 17 | 1564 |
| myoC-1265 | - | GGUGCUGAAAGGCAGGA | 17 | 1565 |
| myoC-1266 | - | AAGGCAGGAAGGUGAAA | 17 | 1566 |
| myoC-1267 | - | AGGCAGGAAGGUGAAAA | 17 | 1567 |
| myoC-1268 | - | GGAAGGUGAAAAGGGCA | 17 | 1568 |
| myoC-1269 | - | AUGUUCAGUGUUGUUCA | 17 | 1569 |
| myoC-1270 | - | UGUUCAGUGUUGUUCAC | 17 | 1570 |
| myoC-1271 | - | GUUCAGUGUUGUUCACG | 17 | 1571 |
| myoC-1272 | - | AGUGUUGUUCACGGGGC | 17 | 1572 |
| myoC-1273 | - | GUGUUGUUCACGGGGCU | 17 | 1573 |
| myoC-1274 | - | UUUAUCUUUUCUCUGCU | 17 | 1574 |
| myoC-1275 | - | AUCUUUUCUCUGCUUGG | 17 | 1575 |
| myoC-1276 | - | AGAAGUCUAUUUCAUGA | 17 | 1576 |
| myoC-1277 | - | GAAGUCUAUUUCAUGAA | 17 | 1577 |
| myoC-1278 | - | UCAGCUGUUAAAAUUCC | 17 | 1578 |
| myoC-1279 | - | CAGCUGUUAAAAUUCCA | 17 | 1579 |
| myoC-1280 | - | AAAUUCCAGGGUGUGCA | 17 | 1580 |
| myoC-1281 | - | AAUUCCAGGGUGUGCAU | 17 | 1581 |
| myoC-1282 | - | UGGGUUUUCCUUCACGA | 17 | 1582 |
| myoC-1283 | - | CGAAGGCCUUUAUUUAA | 17 | 1583 |
| myoC-1284 | - | GAAGGCCUUUAUUUAAU | 17 | 1584 |
| myoC-1285 | - | UUAUUUAAUGGGAAUAU | 17 | 1585 |
| myoC-1286 | - | AAGCGAGCUCAUUUCCU | 17 | 1586 |
| myoC-1287 | - | CCUAGGCCGUUAAUUCA | 17 | 1587 |
| myoC-1288 | - | UUCACGGAAGAAGUGAC | 17 | 1588 |
| myoC-1289 | - | UUUUCUUUCAUGUCUUC | 17 | 1589 |
| myoC-1290 | - | UUUCUUUCAUGUCUUCU | 17 | 1590 |
| myoC-1291 | - | GCAACUACUCAGCCCUG | 17 | 1591 |
| myoC-1292 | - | ACUACUCAGCCCUGUGG | 17 | 1592 |
| myoC-1293 | - | CAGCCCUGUGGUGGACU | 17 | 1593 |
| myoC-1294 | - | ACUUGGCUUAUGCAAGA | 17 | 1594 |
| myoC-1295 | - | AAGACGGUCGAAAACCU | 17 | 1595 |
| myoC-1296 | - | UCGAAAACCUUGGAAUC | 17 | 1596 |
| myoC-1297 | - | CUUGGAAUCAGGAGACU | 17 | 1597 |
| myoC-1298 | - | AGACUCGGUUUUCUUUC | 17 | 1598 |
| myoC-1299 | - | CUUUCUGGUUCUGCCAU | 17 | 1599 |
| myoC-1300 | - | CUGGUUCUGCCAUUGGU | 17 | 1600 |
| myoC-1301 | - | GGUUGGCUGUGCGACCG | 17 | 1601 |
| myoC-1302 | - | GUUGGCUGUGCGACCGU | 17 | 1602 |
| myoC-1303 | - | AAGUGUCUCUCCUUCCC | 17 | 1603 |
| myoC-1304 | - | AGUGUCUCUCCUUCCCU | 17 | 1604 |
| myoC-1305 | - | CCCUGUGAUUCUCUGUG | 17 | 1605 |
| myoC-1306 | - | CCUGUGAUUCUCUGUGA | 17 | 1606 |

TABLE 5D-continued

| 4th Tier | | | | |
|---|---|---|---|---|
| | located in promoter region but not in regions described above | | | |
| gRNA Name | DNA Strand | Targeting Domain | Target Site Length | SEQ ID NO |
| myoC-1307 | - | CUGUGAUUCUCUGUGAG | 17 | 1607 |
| myoC-1308 | - | UGUGAUUCUCUGUGAGG | 17 | 1608 |
| myoC-1309 | - | GUGAUUCUCUGUGAGGG | 17 | 1609 |
| myoC-1310 | - | UGAGGGGGGAUGUUGAG | 17 | 1610 |
| myoC-1311 | - | GAGGGGGGAUGUUGAGA | 17 | 1611 |
| myoC-1312 | - | AGGGGGGAUGUUGAGAG | 17 | 1612 |
| myoC-1313 | - | GGGAUGUUGAGAGGGGA | 17 | 1613 |
| myoC-1314 | - | AUGUUGAGAGGGGAAGG | 17 | 1614 |
| myoC-1315 | - | GGGGAAGGAGGCAGAGC | 17 | 1615 |
| myoC-1316 | - | UGGAGCAGCUGAGCCAC | 17 | 1616 |
| myoC-1317 | - | GGAGCAGCUGAGCCACA | 17 | 1617 |
| myoC-1318 | - | GAGCAGCUGAGCCACAG | 17 | 1618 |
| myoC-1319 | - | CAGCUGAGCCACAGGGG | 17 | 1619 |
| myoC-1320 | - | CUGAGCCACAGGGGAGG | 17 | 1620 |
| myoC-1321 | - | AGCCACAGGGGAGGUGG | 17 | 1621 |
| myoC-1322 | - | GCCACAGGGGAGGUGGA | 17 | 1622 |
| myoC-1323 | - | CCACAGGGGAGGUGGAG | 17 | 1623 |
| myoC-1324 | - | CACAGGGGAGGUGGAGG | 17 | 1624 |
| myoC-1325 | - | GGGAGGUGGAGGGGGAC | 17 | 1625 |
| myoC-1326 | - | GGUGGAGGGGGACAGGA | 17 | 1626 |
| myoC-1327 | - | GAGGGGGACAGGAAGGC | 17 | 1627 |
| myoC-1328 | - | GGAAGGCAGGCAGAAGC | 17 | 1628 |
| myoC-1329 | - | GAAGGCAGGCAGAAGCU | 17 | 1629 |
| myoC-1330 | - | UGAUCACGUCAGACUCC | 17 | 1630 |
| myoC-1331 | - | GAGAGCCACAAUGCUUC | 17 | 1631 |
| myoC-1332 | - | UCCCUAAGCAUAGACAA | 17 | 1632 |
| myoC-1333 | - | AGAAUGCAGAGACUAAC | 17 | 1633 |
| myoC-1334 | - | AUGCAGAGACUAACUGG | 17 | 1634 |
| myoC-1335 | - | UGGUGGUAGCUUUUGCC | 17 | 1635 |
| myoC-1336 | - | GCCUGGCAUUCAAAAAC | 17 | 1636 |
| myoC-1337 | - | CCUGGCAUUCAAAAACU | 17 | 1637 |
| myoC-1338 | - | AACUGGGCCAGAGCAAG | 17 | 1638 |
| myoC-1339 | + | GCAUUUUCCACUUGCUC | 17 | 1639 |
| myoC-1340 | + | CCCAGUUUUUGAAUGCC | 17 | 1640 |
| myoC-1341 | + | AGUCUCUGCAUUCUUUU | 17 | 1641 |
| myoC-1342 | + | GCAUUCUUUUUGGUUAU | 17 | 1642 |
| myoC-1343 | + | UGCCAUUGUCUAUGCUU | 17 | 1643 |
| myoC-1344 | + | GCCAUUGUCUAUGCUUA | 17 | 1644 |
| myoC-1345 | + | UUGUCUAUGCUUAGGGA | 17 | 1645 |
| myoC-1346 | + | CUUAGGGAAGGAAAAUG | 17 | 1646 |
| myoC-1347 | + | AAGGAAAAUGUGGCUGU | 17 | 1647 |
| myoC-1348 | + | AGGAAAAUGUGGCUGUU | 17 | 1648 |
| myoC-1349 | + | GCUUUCCUGAAGCAUUG | 17 | 1649 |
| myoC-1350 | + | UGAAGCAUUGUGGCUCU | 17 | 1650 |
| myoC-1351 | + | AUUGUGGCUCUCGGUCC | 17 | 1651 |
| myoC-1352 | + | GUCUGACGUGAUCAGUG | 17 | 1652 |
| myoC-1353 | + | UGAUCAGUGAGGACUGA | 17 | 1653 |
| myoC-1354 | + | CCCCUCCACCUCCCCUG | 17 | 1654 |
| myoC-1355 | + | CCCUCACAGAGAAUCAC | 17 | 1655 |
| myoC-1356 | + | CCUCACAGAGAAUCACA | 17 | 1656 |
| myoC-1357 | + | AGAACACGAGAGCUGCA | 17 | 1657 |
| myoC-1358 | + | GAACACGAGAGCUGCAA | 17 | 1658 |
| myoC-1359 | + | UAUAGCAGAGAAGACUA | 17 | 1659 |
| myoC-1360 | + | AGAGAAGACUAUGGCCC | 17 | 1660 |
| myoC-1361 | + | GAGAAGACUAUGGCCCA | 17 | 1661 |
| myoC-1362 | + | AGACUAUGGCCCAGGGA | 17 | 1662 |
| myoC-1363 | + | GGAGAGACACUUGCCCA | 17 | 1663 |
| myoC-1364 | + | GUCGCACAGCCAACCAA | 17 | 1664 |
| myoC-1365 | + | CGAGUCUCCUGAUUCCA | 17 | 1665 |
| myoC-1366 | + | UAAGCCAAGUCCACCAC | 17 | 1666 |
| myoC-1367 | + | AAGCCAAGUCCACCACA | 17 | 1667 |
| myoC-1368 | + | CUUCUUCCGUGAAUUAA | 17 | 1668 |
| myoC-1369 | + | CCGUGAAUUAACGGCCU | 17 | 1669 |
| myoC-1370 | + | AUAUUCCCAUUAAAUAA | 17 | 1670 |
| myoC-1371 | + | AAUAAAGGCCUUCGUGA | 17 | 1671 |
| myoC-1372 | + | AAAACCCAUGCACACCC | 17 | 1672 |
| myoC-1373 | + | GCAGAGAAAAGAUAAAA | 17 | 1673 |
| myoC-1374 | + | AAGAUAAAAAGGCUCAC | 17 | 1674 |
| myoC-1375 | + | AGGCUCACAGGAAGCAA | 17 | 1675 |
| myoC-1376 | + | GAACAACACUGAACAUC | 17 | 1676 |
| myoC-1377 | + | AACAACACUGAACAUCU | 17 | 1677 |

TABLE 5D-continued

4th Tier

| gRNA Name | DNA Strand | Targeting Domain (located in promoter region but not in regions described above) | Target Site Length | SEQ ID NO |
|---|---|---|---|---|
| myoC-1378 | + | CUGCAGUCCCCACCUCC | 17 | 1678 |
| myoC-1379 | + | ACCUCCUGGAAUUCUCC | 17 | 1679 |
| myoC-1380 | + | UGGAAUUCUCCUGGACG | 17 | 1680 |
| myoC-1381 | + | AAUUCUCCUGGACGUGG | 17 | 1681 |
| myoC-1382 | + | AGGCCCCUUUCCCUCUG | 17 | 1682 |
| myoC-1383 | + | CCUCUCCAUUUCCUUUC | 17 | 1683 |
| myoC-1384 | + | AUUUCCUUUCUGGAGCC | 17 | 1684 |
| myoC-1385 | + | UCUGGAGCCUGGAGCCA | 17 | 1685 |
| myoC-1386 | + | UCCAGCUCAGAUGCACC | 17 | 1686 |
| myoC-1387 | − | AGUGACUGCUGACAGCA | 17 | 1687 |
| myoC-1388 | − | GGAGUGACCUGCAGCGC | 17 | 1688 |
| myoC-1389 | − | GAGUGACCUGCAGCGCA | 17 | 1689 |
| myoC-1390 | − | AGUGACCUGCAGCGCAG | 17 | 1690 |
| myoC-1391 | − | GACCUGCAGCGCAGGGG | 17 | 1691 |
| myoC-1392 | − | GAGGAGAAGAAAAAGAG | 17 | 1692 |
| myoC-1393 | − | AGGAGAAGAAAAAGAGA | 17 | 1693 |
| myoC-1394 | − | AAAGACAGAUUCAUUCA | 17 | 1694 |
| myoC-1395 | − | AAGACAGAUUCAUUCAA | 17 | 1695 |
| myoC-1396 | − | GAUUCAUUCAAGGGCAG | 17 | 1696 |
| myoC-1397 | − | AUUCAUUCAAGGGCAGU | 17 | 1697 |
| myoC-1398 | − | CAGUGGGAAUUGACCAC | 17 | 1698 |
| myoC-1399 | − | AGUGGGAAUUGACCACA | 17 | 1699 |
| myoC-1400 | − | UAUAGUCCACGUGAUCC | 17 | 1700 |
| myoC-1401 | − | AUAGUCCACGUGAUCCU | 17 | 1701 |
| myoC-1402 | − | ACGUGAUCCUGGGUUCU | 17 | 1702 |
| myoC-1403 | − | UGAUCCUGGGUUCUAGG | 17 | 1703 |
| myoC-1404 | − | CCUGGGUUCUAGGAGGC | 17 | 1704 |
| myoC-1405 | − | CUGGGUUCUAGGAGGCA | 17 | 1705 |
| myoC-1406 | − | GAGGCAGGGCUAUAUUG | 17 | 1706 |
| myoC-1407 | − | AGGCAGGGCUAUAUUGU | 17 | 1707 |
| myoC-1408 | − | GGCAGGGCUAUAUUGUG | 17 | 1708 |
| myoC-1409 | − | GCAGGGCUAUAUUGUGG | 17 | 1709 |
| myoC-1410 | − | CAGGGCUAUAUUGUGGG | 17 | 1710 |
| myoC-1411 | − | GGGAAAAAAUCAGUUCA | 17 | 1711 |
| myoC-1412 | − | GGAAAAAAUCAGUUCAA | 17 | 1712 |

TABLE 5D-continued

4th Tier

| gRNA Name | DNA Strand | Targeting Domain (located in promoter region but not in regions described above) | Target Site Length | SEQ ID NO |
|---|---|---|---|---|
| myoC-1413 | − | AUCAGUUCAAGGGAAGU | 17 | 1713 |
| myoC-1414 | − | UCAGUUCAAGGGAAGUC | 17 | 1714 |
| myoC-1415 | − | AUUCUGAGCAAGUCACA | 17 | 1715 |
| myoC-1416 | − | UCACAAGGUAGUAACUG | 17 | 1716 |
| myoC-1417 | − | CUUAGUUUCUCCUUAUU | 17 | 1717 |
| myoC-1418 | − | GGAACUCUUUUUCUCUG | 17 | 1718 |
| myoC-1419 | − | GUGGAGUUAGCAGCACA | 17 | 1719 |
| myoC-1420 | − | UGGAGUUAGCAGCACAA | 17 | 1720 |
| myoC-1421 | − | AUCCCGUUUCUUUUAAC | 17 | 1721 |
| myoC-1422 | − | CAAACAGAUUCAAGCCU | 17 | 1722 |
| myoC-1423 | − | CUUGCUGACUAUAUGAU | 17 | 1723 |
| myoC-1424 | − | AUGAGACUAGUACCCUU | 17 | 1724 |
| myoC-1425 | − | GUAAAUGUCUCAAGUUC | 17 | 1725 |
| myoC-1426 | − | ACUGUGUUUCUCCACUC | 17 | 1726 |
| myoC-1427 | − | GUGUUUCUCCACUCUGG | 17 | 1727 |
| myoC-1428 | − | CUGGAGGUGAGUCUGCC | 17 | 1728 |
| myoC-1429 | − | UGGAGGUGAGUCUGCCA | 17 | 1729 |
| myoC-1430 | − | AGUCUGCCAGGGCAGUU | 17 | 1730 |
| myoC-1431 | − | AGUAUUGACACUGUUGU | 17 | 1731 |
| myoC-1432 | − | AACAUAAAGUUGCUCAA | 17 | 1732 |
| myoC-1433 | − | GCAAUCAUUAUUUCAAG | 17 | 1733 |
| myoC-1434 | − | GUUACUUCUGACAGUUU | 17 | 1734 |
| myoC-1435 | − | AGUUUUGGUAUAUUUAU | 17 | 1735 |
| myoC-1436 | − | UUUUUGUUUUUUCUCUU | 17 | 1736 |
| myoC-1437 | − | UUUUGUUUUUUCUCUUU | 17 | 1737 |
| myoC-1438 | − | GUUUAUUAAUGUAAAGC | 17 | 1738 |
| myoC-1439 | − | UUUAUUAAUGUAAAGCA | 17 | 1739 |
| myoC-1440 | − | GCCUGUGAAUUUGAAUG | 17 | 1740 |
| myoC-1441 | − | GAGCCAUAAACUCAAAG | 17 | 1741 |
| myoC-1442 | + | UUACCACUUUGAGUUUA | 17 | 1742 |
| myoC-1443 | + | UAUGGCUCUAUUCGCAA | 17 | 1743 |
| myoC-1444 | + | UGUUAAAUUUAGUUAGA | 17 | 1744 |
| myoC-1445 | + | UAAAUUUAGUUAGAAGG | 17 | 1745 |
| myoC-1446 | + | UCCUCAUUCAAAUUCAC | 17 | 1746 |
| myoC-1447 | + | CAAAUUCACAGGCUUUC | 17 | 1747 |
| myoC-1448 | + | CAGGCUUUCUGGACUGU | 17 | 1748 |

TABLE 5D-continued

| 4th Tier | | | | |
|---|---|---|---|---|
| | located in promoter region but not in regions described above | | | |
| gRNA Name | DNA Strand | Targeting Domain | Target Site Length | SEQ ID NO |
| myoC-1449 | + | AAAAAACAAAAAGCAAA | 17 | 1749 |
| myoC-1450 | + | AUAUUUCCAAACUGCCC | 17 | 1750 |
| myoC-1451 | + | CAGACUCACCUCCAGAG | 17 | 1751 |
| myoC-1452 | + | UUCUAUUCUUAUUUGAU | 17 | 1752 |
| myoC-1453 | + | CUUGAGACAUUUACAAA | 17 | 1753 |
| myoC-1454 | + | UUGAGACAUUUACAAAU | 17 | 1754 |
| myoC-1455 | + | UGUUUACAGCUGACCAA | 17 | 1755 |
| myoC-1456 | + | GUUUACAGCUGACCAAA | 17 | 1756 |
| myoC-1457 | + | UAUAGUCAGCAAGACCU | 17 | 1757 |
| myoC-1458 | + | CUAGGCUUGAAUCUGUU | 17 | 1758 |
| myoC-1459 | + | UGUUUGGCUUUACUCUU | 17 | 1759 |
| myoC-1460 | + | CUUCCUGUUAAAAGAAA | 17 | 1760 |
| myoC-1461 | + | UUCCUGUUAAAAGAAAC | 17 | 1761 |
| myoC-1462 | + | AAAAAGAGUUCCUAAUA | 17 | 1762 |
| myoC-1463 | + | AAUUACUCAGCUUGUAA | 17 | 1763 |
| myoC-1464 | + | AUAUAGUAUUAGAAAUC | 17 | 1764 |
| myoC-1465 | + | CCUGCCUCCUAGAACCC | 17 | 1765 |
| myoC-1466 | + | UAGAACCCAGGAUCACG | 17 | 1766 |
| myoC-1467 | + | GUGGACUAUAAUCCCUG | 17 | 1767 |
| myoC-1468 | + | CUCCUCCCCUGCGCUGC | 17 | 1768 |
| myoC-1469 | + | GUCACUGCUGAGCUGCG | 17 | 1769 |
| myoC-1470 | + | UCACUGCUGAGCUGCGU | 17 | 1770 |
| myoC-1471 | + | CACUGCUGAGCUGCGUG | 17 | 1771 |
| myoC-1472 | + | UGAGCUGCGUGGGGGUGC | 17 | 1772 |
| myoC-1473 | + | UGCGUGGGGGUGCUGGUC | 17 | 1773 |
| myoC-1474 | + | GCGUGGGGGUGCUGGUCA | 17 | 1774 |
| myoC-1475 | - | GAAAUUAGACCUCCUGC | 17 | 1775 |
| myoC-1476 | - | CCCAGAUUUCACCAAUG | 17 | 1776 |
| myoC-1477 | - | UUCACCAAUGAGGUUCU | 17 | 1777 |
| myoC-1478 | - | AGUAAGAACUGAUUUAG | 17 | 1778 |
| myoC-1479 | - | GAGGCUAACAUUGACAU | 17 | 1779 |
| myoC-1480 | - | AAAUCUGCCGCUUCUAU | 17 | 1780 |
| myoC-1481 | - | UAUAGGAAUGCUCUCCC | 17 | 1781 |
| myoC-1482 | - | AUGCUCUCCCUGGAGCC | 17 | 1782 |
| myoC-1483 | - | UCUCCCUGGAGCCUGGU | 17 | 1783 |
| myoC-1484 | - | CUCCCUGGAGCCUGGUA | 17 | 1784 |
| myoC-1485 | - | GUGCUGUCCUUGUGUUC | 17 | 1785 |
| myoC-1486 | + | AAGGACAGCACCCUACC | 17 | 1786 |
| myoC-1487 | + | GCACCCUACCAGGCUCC | 17 | 1787 |
| myoC-1488 | + | CACCCUACCAGGCUCCA | 17 | 1788 |
| myoC-1489 | + | GAGCAUUCCUAUAGAAG | 17 | 1789 |
| myoC-1490 | + | AAACAACUGUGUAUCUU | 17 | 1790 |
| myoC-1491 | + | AACAACUGUGUAUCUUU | 17 | 1791 |
| myoC-1492 | + | UUUCAGUCUUGCAUCUC | 17 | 1792 |
| myoC-1493 | + | CAUGCCAAGAACCUCAU | 17 | 1793 |
| myoC-1494 | + | ACCUCAUUGGUGAAAUC | 17 | 1794 |
| myoC-1495 | + | CCUCAUUGGUGAAAUCU | 17 | 1795 |
| myoC-1496 | + | CUCAUUGGUGAAAUCUG | 17 | 1796 |
| myoC-1497 | + | UAAAAUAUAGAUUACAA | 17 | 1797 |
| myoC-1498 | + | UAAAAACAAGAUCCAGC | 17 | 1798 |
| myoC-1499 | + | AAACAAGAUCCAGCAGG | 17 | 1799 |
| myoC-1500 | + | AUGUCUGUGAUUUCUAU | 17 | 1800 |

Table 5E provides exemplary targeting domains for repressing (i.e., knocking down or decreasing) expression of the MYOC gene. Any of the targeting domains in the table can be used with a *S. aureus* eiCas9 molecule to cause a steric block in the promoter region to block transcription elongation resulting in the repression of the MYOC gene. Any of the targeting domains in the table can be used with a *S. aureus* eiCas9 fused to a transcriptional repressor to decrease transcription and therefore downregulate gene expression.

TABLE 5E

| gRNA Name | DNA Strand | Targeting Domain | Target Site Length | SEQ ID NO |
|---|---|---|---|---|
| myoC-1812 | - | GGCAGAGGUUUCCUCUCCAG | 20 | 2032 |
| myoC-676 | - | GCAGAGGUUUCCUCUCCAGC | 20 | 1006 |
| myoC-677 | - | CAGAGGUUUCCUCUCCAGCU | 20 | 1097 |
| myoC-678 | - | AGAGGUUUCCUCUCCAGCUG | 20 | 1085 |
| myoC-679 | - | GAGGUUUCCUCUCCAGCUGG | 20 | 1005 |
| myoC-1817 | - | UGGGGGAGCCCUGCAAGCAC | 20 | 2033 |
| myoC-680 | - | GGGGGAGCCCUGCAAGCACC | 20 | 1020 |
| myoC-1819 | - | CCCUGCAAGCACCCGGGGUC | 20 | 2034 |

TABLE 5E-continued

| gRNA Name | DNA Strand | Targeting Domain | Target Site Length | SEQ ID NO |
|---|---|---|---|---|
| myoC-1820 | - | CACCCGGGGUCCUGGGUGUC | 20 | 2035 |
| myoC-1821 | - | GUUGUUUUGUUAUCACUCUC | 20 | 2036 |
| myoC-686 | - | UUGUUUUGUUAUCACUCUCU | 20 | 1124 |
| myoC-1823 | - | AGGCAUUCAUUGACAAUUUA | 20 | 2037 |
| myoC-1824 | - | UACUUAUAUCUGCCAGACAC | 20 | 2038 |
| myoC-1825 | - | CAGACACCAGAGACAAAAUG | 20 | 2039 |
| myoC-1826 | - | GCAGUCACUGCCCUACCUUC | 20 | 2040 |
| myoC-690 | - | CAGUCACUGCCCUACCUUCG | 20 | 1100 |
| myoC-1828 | - | CGUGGAGGUGACAGUUUCUC | 20 | 2041 |
| myoC-692 | - | GUGGAGGUGACAGUUUCUCA | 20 | 1021 |
| myoC-1830 | - | AGUUUCUCAUGGAAGACGUG | 20 | 2042 |
| myoC-1831 | - | UUCUCAUGGAAGACGUGCAG | 20 | 2043 |
| myoC-1832 | - | CAGCCAACUUAAACCCAGUG | 20 | 2044 |
| myoC-1833 | - | CAACUUAAACCCAGUGCUGA | 20 | 2045 |
| myoC-1834 | - | UUAAACCCAGUGCUGAAAGA | 20 | 2046 |
| myoC-693 | - | UAAACCCAGUGCUGAAAGAA | 20 | 1113 |
| myoC-1836 | - | GAAAGGAAAUAAACACCAUC | 20 | 2047 |
| myoC-1837 | - | AGGAAAUAAACACCAUCUUG | 20 | 2048 |
| myoC-1838 | - | CCCUGCUGCCUCCAUCGUGC | 20 | 2049 |
| myoC-695 | - | CCUGCUGCCUCCAUCGUGCC | 20 | 1104 |
| myoC-1840 | - | GUGCCCGGAGGCCCCCAAGC | 20 | 2050 |
| myoC-1841 | - | GCUGGCCUGCCUCGCUUCCC | 20 | 2051 |
| myoC-1842 | - | CGUGAAUCGUCCUGGUGCAU | 20 | 2052 |
| myoC-1843 | - | AUCGUCCUGGUGCAUCUGAG | 20 | 2053 |
| myoC-1844 | - | UCGUCCUGGUGCAUCUGAGC | 20 | 2054 |
| myoC-1845 | - | GACUCCUUGGCUCCAGGCUC | 20 | 2055 |
| myoC-1846 | - | CCUUGGCUCCAGGCUCCAGA | 20 | 2056 |
| myoC-963 | - | CUUGGCUCCAGGCUCCAGAA | 20 | 1263 |
| myoC-1848 | - | CUCCAGGCUCCAGAAAGGAA | 20 | 2057 |
| myoC-964 | - | UCCAGGCUCCAGAAAGGAAA | 20 | 1264 |
| myoC-1850 | - | CAGGCUCCAGAAAGGAAAUG | 20 | 2058 |
| myoC-1851 | - | GGCUCCAGAAAGGAAAUGGA | 20 | 2059 |
| myoC-965 | - | GCUCCAGAAAGGAAAUGGAG | 20 | 1265 |
| myoC-966 | - | CUCCAGAAAGGAAAUGGAGA | 20 | 1266 |
| myoC-1854 | - | UGGAGAGGGAAACUAGUCUA | 20 | 2060 |
| myoC-967 | - | GGAGAGGGAAACUAGUCUAA | 20 | 1267 |
| myoC-1856 | - | AGAGGGAAACUAGUCUAACG | 20 | 2061 |
| myoC-1857 | - | AAACUAGUCUAACGGAGAAU | 20 | 2062 |
| myoC-968 | - | AACUAGUCUAACGGAGAAUC | 20 | 1268 |
| myoC-1859 | - | CUAGUCUAACGGAGAAUCUG | 20 | 2063 |
| myoC-969 | - | UAGUCUAACGGAGAAUCUGG | 20 | 1269 |
| myoC-970 | - | AGUCUAACGGAGAAUCUGGA | 20 | 1270 |
| myoC-1862 | - | UGGAGGGGACAGUGUUUCCU | 20 | 2064 |
| myoC-1863 | - | GAGGGGACAGUGUUUCCUCA | 20 | 2065 |
| myoC-972 | - | AGGGGACAGUGUUUCCUCAG | 20 | 1272 |
| myoC-973 | - | GGGGACAGUGUUUCCUCAGA | 20 | 1273 |
| myoC-1866 | - | ACAGUGUUUCCUCAGAGGGA | 20 | 2066 |
| myoC-974 | - | CAGUGUUUCCUCAGAGGGAA | 20 | 1274 |
| myoC-1868 | - | GGGAAAGGGGCCUCCACGUC | 20 | 2067 |
| myoC-977 | - | GGAAAGGGGCCUCCACGUCC | 20 | 1277 |
| myoC-1870 | - | AAAGGGGCCUCCACGUCCAG | 20 | 2068 |
| myoC-1871 | - | CUCCACGUCCAGGAGAAUUC | 20 | 2069 |
| myoC-978 | - | UCCACGUCCAGGAGAAUUCC | 20 | 1278 |
| myoC-1873 | - | GUCCAGGAGAAUUCCAGGAG | 20 | 2070 |
| myoC-980 | - | UCCAGGAGAAUUCCAGGAGG | 20 | 1280 |
| myoC-981 | - | CCAGGAGAAUUCCAGGAGGU | 20 | 1281 |
| myoC-1876 | - | AUUCCAGGAGGUGGGGACUG | 20 | 2071 |
| myoC-983 | - | UUCCAGGAGGUGGGGACUGC | 20 | 1283 |
| myoC-984 | - | UCCAGGAGGUGGGGACUGCA | 20 | 1284 |
| myoC-1879 | - | GGAGGUGGGGACUGCAGGGA | 20 | 2072 |
| myoC-985 | - | GAGGUGGGGACUGCAGGGAG | 20 | 1285 |
| myoC-986 | - | AGGUGGGGACUGCAGGGAGU | 20 | 1286 |
| myoC-1882 | - | GACUGCAGGGAGUGGGGACG | 20 | 2073 |
| myoC-988 | - | ACUGCAGGGAGUGGGGACGC | 20 | 1288 |
| myoC-1884 | - | AGGGAGUGGGGACGCUGGGG | 20 | 2074 |
| myoC-1885 | - | AGUGGGGACGCUGGGGCUGA | 20 | 2075 |
| myoC-1886 | - | ACGCUGGGGCUGAGCGGGUG | 20 | 2076 |
| myoC-1887 | - | GCUGAGCGGGUGCUGAAAGG | 20 | 2077 |
| myoC-994 | - | CUGAGCGGGUGCUGAAAGGC | 20 | 1294 |
| myoC-1889 | - | GGGUGCUGAAAGGCAGGAAG | 20 | 2078 |
| myoC-1890 | - | CUGAAAGGCAGGAAGGUGAA | 20 | 2079 |
| myoC-1891 | - | GGAAGGUGAAAAGGGCAAGG | 20 | 2080 |
| myoC-1892 | - | CCAGAUGUUCAGUGUUGUUC | 20 | 2081 |
| myoC-999 | - | CAGAUGUUCAGUGUUGUUCA | 20 | 1299 |
| myoC-1894 | - | GUUCAGUGUUGUUCACGGGG | 20 | 2082 |
| myoC-1002 | - | UUCAGUGUUGUUCACGGGGC | 20 | 1302 |

TABLE 5E-continued

| gRNA Name | DNA Strand | Targeting Domain | Target Site Length | SEQ ID NO |
|---|---|---|---|---|
| myoC-1003 | - | UCAGUGUUGUUCACGGGGCU | 20 | 1303 |
| myoC-1897 | - | GGAGUUUUCCGUUGCUUCCU | 20 | 2083 |
| myoC-1898 | - | CCUUUUUAUCUUUUCUCUGC | 20 | 2084 |
| myoC-1004 | - | CUUUUUAUCUUUUCUCUGCU | 20 | 1304 |
| myoC-1900 | - | UUUUAUCUUUUCUCUGCUUG | 20 | 2085 |
| myoC-1005 | - | UUUAUCUUUUCUCUGCUUGG | 20 | 1305 |
| myoC-1902 | - | UAUCUUUUCUCUGCUUGGAG | 20 | 2086 |
| myoC-1903 | - | CUUUUCUCUGCUUGGAGGAG | 20 | 2087 |
| myoC-1904 | - | GAGGAGAAGAAGUCUAUUUC | 20 | 2088 |
| myoC-1905 | - | GAGAAGAAGUCUAUUUCAUG | 20 | 2089 |
| myoC-1006 | - | AGAAGAAGUCUAUUUCAUGA | 20 | 1306 |
| myoC-1907 | - | AAAGUCAGCUGUUAAAAUUC | 20 | 2090 |
| myoC-1908 | - | GUUAAAAUUCCAGGGUGUGC | 20 | 2091 |
| myoC-1909 | - | GUGUGCAUGGGUUUUCCUUC | 20 | 2092 |
| myoC-1910 | - | UUCACGAAGGCCUUUAUUUA | 20 | 2093 |
| myoC-1013 | - | UCACGAAGGCCUUUAUUUAA | 20 | 1313 |
| myoC-1014 | - | CACGAAGGCCUUUAUUUAAU | 20 | 1314 |
| myoC-1913 | - | GCCUUUAUUUAAUGGGAAUA | 20 | 2094 |
| myoC-1015 | - | CCUUUAUUUAAUGGGAAUAU | 20 | 1315 |
| myoC-1915 | - | AUUUAAUGGGAAUAUAGGAA | 20 | 2095 |
| myoC-1916 | - | AUUUCCUAGGCCGUUAAUUC | 20 | 2096 |
| myoC-1017 | - | UUUCCUAGGCCGUUAAUUCA | 20 | 1317 |
| myoC-1918 | - | CCUAGGCCGUUAAUUCACGG | 20 | 2097 |
| myoC-1919 | - | UUAAUUCACGGAAGAAGUGA | 20 | 2098 |
| myoC-1018 | - | UAAUUCACGGAAGAAGUGAC | 20 | 1318 |
| myoC-1921 | - | AGUCUUUUCUUUCAUGUCUU | 20 | 2099 |
| myoC-1922 | - | GGCAACUACUCAGCCCUGUG | 20 | 2100 |
| myoC-1923 | - | ACUUGGCUUAUGCAAGACGG | 20 | 2101 |
| myoC-1924 | - | AUGCAAGACGGUCGAAAACC | 20 | 2102 |
| myoC-1025 | - | UGCAAGACGGUCGAAAACCU | 20 | 1325 |
| myoC-1926 | - | ACGGUCGAAAACCUUGGAAU | 20 | 2103 |
| myoC-1026 | - | CGGUCGAAAACCUUGGAAUC | 20 | 1326 |
| myoC-1928 | - | CAUUGGUUGGCUGUGCGACC | 20 | 2104 |
| myoC-1929 | - | GGGCAAGUGUCUCUCCUUCC | 20 | 2105 |
| myoC-1930 | - | CCUUGCAGCUCUCGUGUUCU | 20 | 2106 |
| myoC-1931 | - | ACACUUCCCUGUGAUUCUCU | 20 | 2107 |
| myoC-1932 | - | ACUUCCCUGUGAUUCUCUGU | 20 | 2108 |
| myoC-1035 | - | CUUCCCUGUGAUUCUCUGUG | 20 | 1335 |
| myoC-1036 | - | UUCCCUGUGAUUCUCUGUGA | 20 | 1336 |
| myoC-1037 | - | UCCCUGUGAUUCUCUGUGAG | 20 | 1337 |
| myoC-1038 | - | CCCUGUGAUUCUCUGUGAGG | 20 | 1338 |
| myoC-1937 | - | AUUCUCUGUGAGGGGGGAUG | 20 | 2109 |
| myoC-1938 | - | UCUCUGUGAGGGGGGAUGUU | 20 | 2110 |
| myoC-1939 | - | UCUGUGAGGGGGGAUGUUGA | 20 | 2111 |
| myoC-1040 | - | CUGUGAGGGGGGAUGUUGAG | 20 | 1340 |
| myoC-1041 | - | UGUGAGGGGGGAUGUUGAGA | 20 | 1341 |
| myoC-1042 | - | GUGAGGGGGGAUGUUGAGAG | 20 | 1342 |
| myoC-1943 | - | AGGGGGGAUGUUGAGAGGGG | 20 | 2112 |
| myoC-1043 | - | GGGGGGAUGUUGAGAGGGGA | 20 | 1343 |
| myoC-1945 | - | AUGUUGAGAGGGGAAGGAGG | 20 | 2113 |
| myoC-1946 | - | GAGAGGGGAAGGAGGCAGAG | 20 | 2114 |
| myoC-1045 | - | AGAGGGGAAGGAGGCAGAGC | 20 | 1345 |
| myoC-1948 | - | AGGAGGCAGAGCUGGAGCAG | 20 | 2115 |
| myoC-1949 | - | GAGCUGGAGCAGCUGAGCCA | 20 | 2116 |
| myoC-1046 | - | AGCUGGAGCAGCUGAGCCAC | 20 | 1346 |
| myoC-1047 | - | GCUGGAGCAGCUGAGCCACA | 20 | 1347 |
| myoC-1048 | - | CUGGAGCAGCUGAGCCACAG | 20 | 1348 |
| myoC-1953 | - | GCAGCUGAGCCACAGGGGAG | 20 | 2117 |
| myoC-1050 | - | CAGCUGAGCCACAGGGGAGG | 20 | 1350 |
| myoC-1955 | - | GCUGAGCCACAGGGGAGGUG | 20 | 2118 |
| myoC-1051 | - | CUGAGCCACAGGGGAGGUGG | 20 | 1351 |
| myoC-1052 | - | UGAGCCACAGGGGAGGUGGA | 20 | 1352 |
| myoC-1053 | - | GAGCCACAGGGGAGGUGGAG | 20 | 1353 |
| myoC-1959 | - | ACAGGGGAGGUGGAGGGGGA | 20 | 2119 |
| myoC-1055 | - | CAGGGGAGGUGGAGGGGGAC | 20 | 1355 |
| myoC-1961 | - | GAGGGGGACAGGAAGGCAGG | 20 | 2120 |
| myoC-1962 | - | GACAGGAAGGCAGGCAGAAG | 20 | 2121 |
| myoC-1963 | - | UCACUGAUCACGUCAGACUC | 20 | 2122 |
| myoC-1964 | - | GAUCACGUCAGACUCCAGGA | 20 | 2123 |
| myoC-1965 | - | UCACGUCAGACUCCAGGACC | 20 | 2124 |
| myoC-1966 | - | GACCGAGAGCCACAAUGCUU | 20 | 2125 |
| myoC-1061 | - | ACCGAGAGCCACAAUGCUUC | 20 | 1361 |
| myoC-1968 | - | CAAUGCUUCAGGAAAGCUCA | 20 | 2126 |
| myoC-1969 | - | GGCAUUUGCCAAUAACCAAA | 20 | 2127 |
| myoC-1970 | - | GCCAAUAACCAAAAAGAAUG | 20 | 2128 |
| myoC-1971 | - | UUUUGCCUGGCAUUCAAAAA | 20 | 2129 |

TABLE 5E-continued

| gRNA Name | DNA Strand | Targeting Domain | Target Site Length | SEQ ID NO |
|---|---|---|---|---|
| myoC-1972 | – | CUGGCAUUCAAAAACUGGGC | 20 | 2130 |
| myoC-1973 | – | CAAAAACUGGGCCAGAGCAA | 20 | 2131 |
| myoC-1068 | – | AAAAACUGGGCCAGAGCAAG | 20 | 1368 |
| myoC-1975 | – | CCAGAGCAAGUGGAAAAUGC | 20 | 2132 |
| myoC-1976 | – | CAGCAGUGACUGCUGACAGC | 20 | 2133 |
| myoC-1117 | – | AGCAGUGACUGCUGACAGCA | 20 | 1417 |
| myoC-1978 | – | GCACGGAGUGACCUGCAGCG | 20 | 2134 |
| myoC-1118 | – | CACGGAGUGACCUGCAGCGC | 20 | 1418 |
| myoC-1119 | – | ACGGAGUGACCUGCAGCGCA | 20 | 1419 |
| myoC-1120 | – | CGGAGUGACCUGCAGCGCAG | 20 | 1420 |
| myoC-1982 | – | GAGUGACCUGCAGCGCAGGG | 20 | 2135 |
| myoC-1121 | – | AGUGACCUGCAGCGCAGGGG | 20 | 1421 |
| myoC-1984 | – | UGACCUGCAGCGCAGGGGAG | 20 | 2136 |
| myoC-1985 | – | CCUGCAGCGCAGGGGAGGAG | 20 | 2137 |
| myoC-1986 | – | GCGCAGGGGAGGAGAAGAAA | 20 | 2138 |
| myoC-1987 | – | GCAGGGGAGGAGAAGAAAAA | 20 | 2139 |
| myoC-1988 | – | AGGGGAGGAGAAGAAAAAGA | 20 | 2140 |
| myoC-1122 | – | GGGGAGGAGAAGAAAAAGAG | 20 | 1422 |
| myoC-1990 | – | GAAAAAGAGAGGGAUAGUGU | 20 | 2141 |
| myoC-1991 | – | GAGAGGGAUAGUGUAUGAGC | 20 | 2142 |
| myoC-1992 | – | CAAGAAAGACAGAUUCAUUC | 20 | 2143 |
| myoC-1993 | – | GACAGAUUCAUUCAAGGGCA | 20 | 2144 |
| myoC-1126 | – | ACAGAUUCAUUCAAGGGCAG | 20 | 1426 |
| myoC-1127 | – | CAGAUUCAUUCAAGGGCAGU | 20 | 1427 |
| myoC-1996 | – | AGGGCAGUGGGAAUUGACCA | 20 | 2145 |
| myoC-1128 | – | GGGCAGUGGGAAUUGACCAC | 20 | 1428 |
| myoC-1998 | – | GGAUUAUAGUCCACGUGAUC | 20 | 2146 |
| myoC-1999 | – | GUCCACGUGAUCCUGGGUUC | 20 | 2147 |
| myoC-1132 | – | UCCACGUGAUCCUGGGUUCU | 20 | 1432 |
| myoC-2001 | – | UGAUCCUGGGUUCUAGGAGG | 20 | 2148 |
| myoC-2002 | – | CUAGGAGGCAGGGCUAUAUU | 20 | 2149 |
| myoC-1136 | – | UAGGAGGCAGGGCUAUAUUG | 20 | 1436 |
| myoC-1137 | – | AGGAGGCAGGGCUAUAUUGU | 20 | 1437 |
| myoC-1138 | – | GGAGGCAGGGCUAUAUUGUG | 20 | 1438 |
| myoC-1139 | – | GAGGCAGGGCUAUAUUGUGG | 20 | 1439 |
| myoC-1140 | – | AGGCAGGGCUAUAUUGUGGG | 20 | 1440 |
| myoC-2008 | – | UGGGGGGAAAAAAUCAGUUC | 20 | 2150 |
| myoC-1141 | – | GGGGGGAAAAAAUCAGUUCA | 20 | 1441 |
| myoC-1142 | – | GGGGGAAAAAAUCAGUUCAA | 20 | 1442 |
| myoC-2011 | – | AAAAAUCAGUUCAAGGGAAG | 20 | 2151 |
| myoC-1143 | – | AAAAUCAGUUCAAGGGAAGU | 20 | 1443 |
| myoC-1144 | – | AAAUCAGUUCAAGGGAAGUC | 20 | 1444 |
| myoC-2014 | – | CUAUAUUUUUCCUUUACAAG | 20 | 2152 |
| myoC-2015 | – | CCUUUACAAGCUGAGUAAUU | 20 | 2153 |
| myoC-2016 | – | AGCAAGUCACAAGGUAGUAA | 20 | 2154 |
| myoC-2017 | – | AUUACUUAGUUUCUCCUUAU | 20 | 2155 |
| myoC-1147 | – | UUACUUAGUUUCUCCUUAUU | 20 | 1447 |
| myoC-2019 | – | AUUAGGAACUCUUUUUCUCU | 20 | 2156 |
| myoC-1148 | – | UUAGGAACUCUUUUUCUCUG | 20 | 1448 |
| myoC-2021 | – | CUCUGUGGAGUUAGCAGCAC | 20 | 2157 |
| myoC-2022 | – | GGCAAUCCCGUUUCUUUUAA | 20 | 2158 |
| myoC-1151 | – | GCAAUCCCGUUUCUUUUAAC | 20 | 1451 |
| myoC-2024 | – | AUCCCGUUUCUUUUAACAGG | 20 | 2159 |
| myoC-2025 | – | AACAGGAAGAAAACAUUCCU | 20 | 2160 |
| myoC-2026 | – | CUGACUAUAUGAUUGGUUUU | 20 | 2161 |
| myoC-2027 | – | GCGAUGUUUACUAUCUGAUU | 20 | 2162 |
| myoC-2028 | – | UUUACUAUCUGAUUCAGAAA | 20 | 2163 |
| myoC-2029 | – | CUCAAGUUCAGGCUUAACUG | 20 | 2164 |
| myoC-2030 | – | AACUGCAGAACCAAUCAAAU | 20 | 2165 |
| myoC-2031 | – | CAGAACCAAUCAAAUAAGAA | 20 | 2166 |
| myoC-2032 | – | UCAAAUAAGAAUAGAAUCUU | 20 | 2167 |
| myoC-2033 | – | GCAAACUGUGUUUCUCCACU | 20 | 2168 |
| myoC-1156 | – | CAAACUGUGUUUCUCCACUC | 20 | 1456 |
| myoC-2035 | – | UGUGUUUCUCCACUCUGGAG | 20 | 2169 |
| myoC-2036 | – | CACUCUGGAGGUGAGUCUGC | 20 | 2170 |
| myoC-2037 | – | GGUGAGUCUGCCAGGGCAGU | 20 | 2171 |
| myoC-1160 | – | GUGAGUCUGCCAGGGCAGUU | 20 | 1460 |
| myoC-2039 | – | UUGCUUUUUGUUUUUUCUCU | 20 | 2172 |
| myoC-2040 | – | UUGGGUUUAUUAAUGUAAAG | 20 | 2173 |
| myoC-1168 | – | UGGGUUUAUUAAUGUAAAGC | 20 | 1468 |
| myoC-2042 | – | GGGAUUAUUAACCUACAGUC | 20 | 2174 |
| myoC-2043 | – | ACCUACAGUCCAGAAAGCCU | 20 | 2175 |
| myoC-2044 | – | AGUCCAGAAAGCCUGUGAAU | 20 | 2176 |
| myoC-2045 | – | CAGAAAGCCUGUGAAUUUGA | 20 | 2177 |
| myoC-2046 | – | GAAAGCCUGUGAAUUUGAAU | 20 | 2178 |
| myoC-1170 | – | AAAGCCUGUGAAUUUGAAUG | 20 | 1470 |

TABLE 5E-continued

| gRNA Name | DNA Strand | Targeting Domain | Target Site Length | SEQ ID NO |
|---|---|---|---|---|
| myoC-2048 | - | AUUUAACAUUUUAUUCCAUU | 20 | 2179 |
| myoC-2049 | - | ACAUUUUAUUCCAUUGCGAA | 20 | 2180 |
| myoC-2050 | - | UGUGAUUUUGUCAUUACCAA | 20 | 2181 |
| myoC-2051 | - | UUGUUGCAGAUACGUUGUAA | 20 | 2182 |
| myoC-2052 | - | UAUUUAUACUCAAAACUACU | 20 | 2183 |
| myoC-2053 | - | CUUUGAAAUUAGACCUCCUG | 20 | 2184 |
| myoC-2054 | - | GUAAUCUAUAUUUUAUAUAU | 20 | 2185 |
| myoC-2055 | - | AUAUAUUUGAAAACAUCUUU | 20 | 2186 |
| myoC-2056 | - | AUAUUUGAAAACAUCUUUCU | 20 | 2187 |
| myoC-2057 | - | UUUGAAAACAUCUUUCUGAG | 20 | 2188 |
| myoC-2058 | - | GAGUUCCCCAGAUUUCACCA | 20 | 2189 |
| myoC-2059 | - | GUUCUUGGCAUGCACACACA | 20 | 2190 |
| myoC-2060 | - | GGCAUGCACACACACAGAGU | 20 | 2191 |
| myoC-2061 | - | ACACAGAGUAAGAACUGAUU | 20 | 2192 |
| myoC-2062 | - | GCUAACAUUGACAUUGGUGC | 20 | 2193 |
| myoC-2063 | - | UUGGUGCCUGAGAUGCAAGA | 20 | 2194 |
| myoC-2064 | - | CUGAGAUGCAAGACUGAAAU | 20 | 2195 |
| myoC-2065 | - | AUACACAGUUGUUUUAAAGC | 20 | 2196 |
| myoC-2066 | - | UACACAGUUGUUUUAAAGCU | 20 | 2197 |
| myoC-2067 | - | CAGUUGUUUUAAAGCUAGGG | 20 | 2198 |
| myoC-2068 | - | GUUGUUUUAAAGCUAGGGGU | 20 | 2199 |
| myoC-2069 | - | UUGUUUUAAAGCUAGGGGUG | 20 | 2200 |
| myoC-2070 | - | UGUUUUAAAGCUAGGGGUGA | 20 | 2201 |
| myoC-2071 | - | GUUUUAAAGCUAGGGGUGAG | 20 | 2202 |
| myoC-2072 | - | UUUUAAAGCUAGGGGUGAGG | 20 | 2203 |
| myoC-2073 | - | UUUAAAGCUAGGGGUGAGGG | 20 | 2204 |
| myoC-2074 | - | GGGGAAAUCUGCCGCUUCUA | 20 | 2205 |
| myoC-1210 | - | GGGAAAUCUGCCGCUUCUAU | 20 | 1510 |
| myoC-2076 | - | CUUCUAUAGGAAUGCUCUCC | 20 | 2206 |
| myoC-1211 | - | UUCUAUAGGAAUGCUCUCCC | 20 | 1511 |
| myoC-2078 | - | AUGCUCUCCCUGGAGCCUGG | 20 | 2207 |
| myoC-2079 | - | UCUGUCCCUGCUACGUCUUA | 20 | 2208 |
| myoC-2080 | - | CUACGUCUUAAAGGACUUGU | 20 | 2209 |
| myoC-2081 | - | UGGCACAGUGCAGGUUCUCA | 20 | 2210 |
| myoC-2082 | - | GCAGGUUCUCAAUGAGUUUG | 20 | 2211 |
| myoC-2083 | - | GUUCUCAAUGAGUUUGCAGA | 20 | 2212 |
| myoC-2084 | - | UCAAUGAGUUUGCAGAGUGA | 20 | 2213 |
| myoC-833 | - | CAAUGAGUUUGCAGAGUGAA | 20 | 1188 |
| myoC-2086 | - | GAGUGAAUGGAAAUAUAAAC | 20 | 2214 |
| myoC-2087 | - | AAACUAGAAAUAUAUCCUUG | 20 | 2215 |
| myoC-2088 | - | GUGUGUGUGUGUAAAACCAG | 20 | 2216 |
| myoC-836 | - | UGUGUGUGUGUAAAACCAGG | 20 | 1218 |
| myoC-2090 | - | UGUAAAACCAGGUGGAGAUA | 20 | 2217 |
| myoC-837 | - | GUAAAACCAGGUGGAGAUAU | 20 | 994 |
| myoC-2092 | - | UGGAGAUAUAGGAACUAUUA | 20 | 2218 |
| myoC-838 | - | GGAGAUAUAGGAACUAUUAU | 20 | 991 |
| myoC-2094 | - | AUAGGAACUAUUAUUGGGGU | 20 | 2219 |
| myoC-2095 | - | UUGGGGUAUGGGUGCAUAAA | 20 | 2220 |
| myoC-843 | - | UGGGGUAUGGGUGCAUAAAU | 20 | 1214 |
| myoC-2097 | - | AUUGGGAUGUUCUUUUUAAA | 20 | 2221 |
| myoC-2098 | - | AAGAAACUCCAAACAGACUU | 20 | 2222 |
| myoC-845 | - | AGAAACUCCAAACAGACUUC | 20 | 1179 |
| myoC-2100 | - | CUUCUGGAAGGUUAUUUUCU | 20 | 2223 |
| myoC-2101 | - | CUAAGAAUCUUGCUGGCAGC | 20 | 2224 |
| myoC-2102 | - | GGCCACCUCUGUCUUCCCCC | 20 | 2225 |
| myoC-2103 | - | CACCUCUGUCUUCCCCCAUG | 20 | 2226 |
| myoC-2104 | - | CCCAGUAUAUAUAAACCUCU | 20 | 2227 |
| myoC-853 | - | CCAGUAUAUAUAAACCUCUC | 20 | 1197 |
| myoC-2106 | - | UAUAUAAACCUCUCUGGAGC | 20 | 2228 |
| myoC-2107 | - | AACCUCUCUGGAGCUCGGGC | 20 | 2229 |
| myoC-2108 | - | CCAGGCACCUCUCAGCACAG | 20 | 2230 |
| myoC-2109 | - | CUCAGCACAGCAGAGCUUUC | 20 | 2231 |
| myoC-2110 | - | CAGCACAGCAGAGCUUUCCA | 20 | 2232 |
| myoC-2111 | - | AGCACAGCAGAGCUUUCCAG | 20 | 2233 |
| myoC-749 | + | CUGGAGAGGAAACCUCUGCC | 20 | 1110 |
| myoC-748 | + | GCUGGAGAGGAAACCUCUGC | 20 | 1010 |
| myoC-2114 | + | AGCUGGAGAGGAAACCUCUG | 20 | 2234 |
| myoC-747 | + | CAGGGCUCCCCCAGCUGGAG | 20 | 1099 |
| myoC-2116 | + | GCAGGGCUCCCCCAGCUGGA | 20 | 2235 |
| myoC-2117 | + | UUGCAGGGCUCCCCCAGCUG | 20 | 2236 |
| myoC-746 | + | GCUUGCAGGGCUCCCCCAGC | 20 | 1012 |
| myoC-2119 | + | UGCUUGCAGGGCUCCCCCAG | 20 | 2237 |
| myoC-2120 | + | CCCAGGACCCCGGGUGCUUG | 20 | 2238 |
| myoC-2121 | + | UGCUCAGGACACCCAGGACC | 20 | 2239 |
| myoC-2122 | + | GGCAGGUUGCUCAGGACACC | 20 | 2240 |
| myoC-2123 | + | GCACGGGCUGGCAGGUUGCU | 20 | 2241 |

TABLE 5E-continued

| gRNA Name | DNA Strand | Targeting Domain | Target Site Length | SEQ ID NO |
|---|---|---|---|---|
| myoC-2124 | + | AUAACAAAACAACCAGUGGC | 20 | 2242 |
| myoC-2125 | + | UAGAAAGCAACAGGUCCCUA | 20 | 2243 |
| myoC-2126 | + | AAUAGAAAGCAACAGGUCCC | 20 | 2244 |
| myoC-2127 | + | AUGAACGAGUCACACAGAAA | 20 | 2245 |
| myoC-2128 | + | GGAUGAAUGAACGAGUCACA | 20 | 2246 |
| myoC-2129 | + | AUGAAUGCCUGGAUGAAUGA | 20 | 2247 |
| myoC-2130 | + | GUCAAUGAAUGCCUGGAUGA | 20 | 2248 |
| myoC-2131 | + | AAUUGUCAAUGAAUGCCUGG | 20 | 2249 |
| myoC-2132 | + | AAUAAAUUGUCAAUGAAUGC | 20 | 2250 |
| myoC-2133 | + | AAGUACUCAAUAAAUUGUCA | 20 | 2251 |
| myoC-2134 | + | AACUGUCACCUCCACGAAGG | 20 | 2252 |
| myoC-2135 | + | CAUGAGAAACUGUCACCUCC | 20 | 2253 |
| myoC-2136 | + | UUCUUCUGCACGUCUUCCAU | 20 | 2254 |
| myoC-2137 | + | UUUUCUUCUGCACGUCUUCC | 20 | 2255 |
| myoC-2138 | + | UUAUUUCCUUUCUUUCAGCA | 20 | 2256 |
| myoC-721 | + | CUAGGGAGGUGGCCUUGUUA | 20 | 1106 |
| myoC-2140 | + | GCUAGGGAGGUGGCCUUGUU | 20 | 2257 |
| myoC-718 | + | GGAGGCAGCAGGGGGCGCUA | 20 | 1015 |
| myoC-717 | + | UGGAGGCAGCAGGGGGCGCU | 20 | 1120 |
| myoC-2143 | + | AUGGAGGCAGCAGGGGGCGC | 20 | 2258 |
| myoC-714 | + | CGGGCACGAUGGAGGCAGCA | 20 | 1105 |
| myoC-713 | + | CCGGGCACGAUGGAGGCAGC | 20 | 1102 |
| myoC-2146 | + | UCCGGGCACGAUGGAGGCAG | 20 | 2259 |
| myoC-711 | + | UUGGGGGCCUCCGGGCACGA | 20 | 1123 |
| myoC-2148 | + | CUUGGGGGCCUCCGGGCACG | 20 | 2260 |
| myoC-2149 | + | AGACUCGGGCUUGGGGGCCU | 20 | 2261 |
| myoC-706 | + | GGCUUGGAAGACUCGGGCUU | 20 | 978 |
| myoC-705 | + | AGGCUUGGAAGACUCGGGCU | 20 | 1091 |
| myoC-2152 | + | GAGGCUUGGAAGACUCGGGC | 20 | 2262 |
| myoC-2153 | + | GAGGAGGAGGCUUGGAAGAC | 20 | 2263 |
| myoC-702 | + | GACUGAUGGAGGAGGAGGCU | 20 | 1004 |
| myoC-2155 | + | UGACUGAUGGAGGAGGAGGC | 20 | 2264 |
| myoC-700 | + | AGCGCUGUGACUGAUGGAGG | 20 | 1088 |
| myoC-2157 | + | CAGCGCUGUGACUGAUGGAG | 20 | 2265 |
| myoC-699 | + | UGCAGCGCUGUGACUGAUGG | 20 | 1118 |
| myoC-2159 | + | CUGCAGCGCUGUGACUGAUG | 20 | 2266 |
| myoC-698 | + | AGCUGCAGCGCUGUGACUGA | 20 | 1089 |
| myoC-2161 | + | CAGCUGCAGCGCUGUGACUG | 20 | 2267 |

TABLE 5E-continued

| gRNA Name | DNA Strand | Targeting Domain | Target Site Length | SEQ ID NO |
|---|---|---|---|---|
| myoC-2162 | + | ACCAGGACGAUUCACGGGAA | 20 | 2268 |
| myoC-2163 | + | GAUGCACCAGGACGAUUCAC | 20 | 2269 |
| myoC-2164 | + | AGAUGCACCAGGACGAUUCA | 20 | 2270 |
| myoC-2165 | + | CAGAUGCACCAGGACGAUUC | 20 | 2271 |
| myoC-2166 | + | AGUCUCCAGCUCAGAUGCAC | 20 | 2272 |
| myoC-1115 | + | CUUUCUGGAGCCUGGAGCCA | 20 | 1415 |
| myoC-2168 | + | CCUUUCUGGAGCCUGGAGCC | 20 | 2273 |
| myoC-1114 | + | UCCAUUUCCUUUCUGGAGCC | 20 | 1414 |
| myoC-2170 | + | CUCCAUUUCCUUUCUGGAGC | 20 | 2274 |
| myoC-1113 | + | UUCCCUCUCCAUUUCCUUUC | 20 | 1413 |
| myoC-2172 | + | UUUCCCUCUCCAUUUCCUUU | 20 | 2275 |
| myoC-1112 | + | UGGAGGCCCCUUUCCCUCUG | 20 | 1412 |
| myoC-2174 | + | GUGGAGGCCCCUUUCCCUCU | 20 | 2276 |
| myoC-2175 | + | ACGUGGAGGCCCCUUUCCCU | 20 | 2277 |
| myoC-1110 | + | UCCUGGAAUUCUCCUGGACG | 20 | 1410 |
| myoC-2177 | + | CUCCUGGAAUUCUCCUGGAC | 20 | 2278 |
| myoC-2178 | + | CCCCACCUCCUGGAAUUCUC | 20 | 2279 |
| myoC-1108 | + | UCCCUGCAGUCCCCACCUCC | 20 | 1408 |
| myoC-2180 | + | CUCCCUGCAGUCCCCACCUC | 20 | 2280 |
| myoC-2181 | + | CCGUGAACAACACUGAACAU | 20 | 2281 |
| myoC-2182 | + | UCCCAGCCCCGUGAACAACA | 20 | 2282 |
| myoC-2183 | + | AACGGAAAACUCCCAGCCCC | 20 | 2283 |
| myoC-1105 | + | AAAAGGCUCACAGGAAGCAA | 20 | 1405 |
| myoC-2185 | + | AAAAAGGCUCACAGGAAGCA | 20 | 2284 |
| myoC-1104 | + | GAAAAGAUAAAAAGGCUCAC | 20 | 1404 |
| myoC-2187 | + | AGAAAAGAUAAAAAGGCUCA | 20 | 2285 |
| myoC-2188 | + | GACUUCUUCUCCUCCAAGCA | 20 | 2286 |
| myoC-2189 | + | UAGACUUCUUCUCCUCCAAG | 20 | 2287 |
| myoC-2190 | + | UUAUGAAACUGCAUCCCUUC | 20 | 2288 |
| myoC-2191 | + | GAAUUUUAACAGCUGACUUU | 20 | 2289 |
| myoC-1102 | + | AGGAAAACCCAUGCACACCC | 20 | 1402 |
| myoC-2193 | + | AAGGAAAACCCAUGCACACC | 20 | 2290 |
| myoC-1101 | + | UUAAAUAAAGGCCUUCGUGA | 20 | 1401 |
| myoC-2195 | + | AUUAAAUAAAGGCCUUCGUG | 20 | 2291 |
| myoC-2196 | + | CCCAUUAAAUAAAGGCCUUC | 20 | 2292 |
| myoC-2197 | + | GUGAAUUAACGGCCUAGGAA | 20 | 2293 |
| myoC-1099 | + | CUUCCGUGAAUUAACGGCCU | 20 | 1399 |
| myoC-2199 | + | UCUUCCGUGAAUUAACGGCC | 20 | 2294 |

TABLE 5E-continued

| gRNA Name | DNA Strand | Targeting Domain | Target Site Length | SEQ ID NO |
|---|---|---|---|---|
| myoC-2200 | + | AGACUCCAGUCACUUCUUCC | 20 | 2295 |
| myoC-2201 | + | UAGUUGCCCAGAAGACAUGA | 20 | 2296 |
| myoC-2202 | + | UGAGUAGUUGCCCAGAAGAC | 20 | 2297 |
| myoC-2203 | + | CACAGGGCUGAGUAGUUGCC | 20 | 2298 |
| myoC-2204 | + | AAGCCAAGUCCACCACAGGG | 20 | 2299 |
| myoC-2205 | + | UGCAUAAGCCAAGUCCACCA | 20 | 2300 |
| myoC-2206 | + | UGGCAGAACCAGAAAGAAAA | 20 | 2301 |
| myoC-2207 | + | CAACCAAUGGCAGAACCAGA | 20 | 2302 |
| myoC-2208 | + | CAGCCAACCAAUGGCAGAAC | 20 | 2303 |
| myoC-2209 | + | GUCGCACAGCCAACCAAUGG | 20 | 2304 |
| myoC-2210 | + | AAGACUAUGGCCCAGGGAAG | 20 | 2305 |
| myoC-1092 | + | AGAAGACUAUGGCCCAGGGA | 20 | 1392 |
| myoC-2212 | + | GAGAAGACUAUGGCCCAGGG | 20 | 2306 |
| myoC-1091 | + | GCAGAGAAGACUAUGGCCCA | 20 | 1391 |
| myoC-1090 | + | AGCAGAGAAGACUAUGGCCC | 20 | 1390 |
| myoC-2215 | + | UAGCAGAGAAGACUAUGGCC | 20 | 2307 |
| myoC-2216 | + | CUGCAAGGGUCUUUAUAGCA | 20 | 2308 |
| myoC-2217 | + | AGCUGCAAGGGUCUUUAUAG | 20 | 2309 |
| myoC-2218 | + | UCACAGAACACGAGAGCUGC | 20 | 2310 |
| myoC-2219 | + | GGGAAGUGUUCACAGAACAC | 20 | 2311 |
| myoC-2220 | + | CAGGGAAGUGUUCACAGAAC | 20 | 2312 |
| myoC-2221 | + | GAAUCACAGGGAAGUGUUCA | 20 | 2313 |
| myoC-1086 | + | CCCCCUCACAGAGAAUCACA | 20 | 1386 |
| myoC-1085 | + | CCCCCCUCACAGAGAAUCAC | 20 | 1385 |
| myoC-2224 | + | UCCCCCCUCACAGAGAAUCA | 20 | 2314 |
| myoC-2225 | + | UCUCAACAUCCCCCCUCACA | 20 | 2315 |
| myoC-2226 | + | CCUCUCAACAUCCCCCCUCA | 20 | 2316 |
| myoC-1083 | + | ACGUGAUCAGUGAGGACUGA | 20 | 1383 |
| myoC-2228 | + | GACGUGAUCAGUGAGGACUG | 20 | 2317 |
| myoC-2229 | + | UGGAGUCUGACGUGAUCAGU | 20 | 2318 |
| myoC-2230 | + | CCUGGAGUCUGACGUGAUCA | 20 | 2319 |
| myoC-1081 | + | AGCAUUGUGGCUCUCGGUCC | 20 | 1381 |
| myoC-2232 | + | AAGCAUUGUGGCUCUCGGUC | 20 | 2320 |
| myoC-2233 | + | GUUGGGUUCAUUGAGCUUUC | 20 | 2321 |
| myoC-2234 | + | AAAUGUGGCUGUUGGGUUCA | 20 | 2322 |
| myoC-2235 | + | AGGGAAGGAAAAUGUGGCUG | 20 | 2323 |
| myoC-1075 | + | CCAUUGUCUAUGCUUAGGGA | 20 | 1375 |
| myoC-2237 | + | GCCAUUGUCUAUGCUUAGGG | 20 | 2324 |

TABLE 5E-continued

| gRNA Name | DNA Strand | Targeting Domain | Target Site Length | SEQ ID NO |
|---|---|---|---|---|
| myoC-1074 | + | AAUGCCAUUGUCUAUGCUUA | 20 | 1374 |
| myoC-1073 | + | AAAUGCCAUUGUCUAUGCUU | 20 | 1373 |
| myoC-2240 | + | CAAAUGCCAUUGUCUAUGCU | 20 | 2325 |
| myoC-2241 | + | CACUUGCUCUGGCCCAGUUU | 20 | 2326 |
| myoC-2242 | + | UGCGUGGGGUGCUGGUCAGG | 20 | 2327 |
| myoC-2243 | + | GAGCUGCGUGGGGUGCUGGU | 20 | 2328 |
| myoC-1199 | + | GCAGUCACUGCUGAGCUGCG | 20 | 1499 |
| myoC-2245 | + | AGCAGUCACUGCUGAGCUGC | 20 | 2329 |
| myoC-2246 | + | CGUGCUGUCAGCAGUCACUG | 20 | 2330 |
| myoC-2247 | + | UCAAUUCCCACUGCCCUUGA | 20 | 2331 |
| myoC-2248 | + | GUGGUCAAUUCCCACUGCCC | 20 | 2332 |
| myoC-2249 | + | CUCCUAGAACCCAGGAUCAC | 20 | 2333 |
| myoC-2250 | + | UAGCCCUGCCUCCUAGAACC | 20 | 2334 |
| myoC-2251 | + | CACAAUAUAGCCCUGCCUCC | 20 | 2335 |
| myoC-2252 | + | AUCAGGUCUCCCGACUUCCC | 20 | 2336 |
| myoC-2253 | + | GUAAAGGAAAAAUAUAGUAU | 20 | 2337 |
| myoC-1193 | + | CAGAAUUACUCAGCUUGUAA | 20 | 1493 |
| myoC-2255 | + | UCAGAAUUACUCAGCUUGUA | 20 | 2338 |
| myoC-2256 | + | UUACUACCUUGUGACUUGCU | 20 | 2339 |
| myoC-2257 | + | GAAAAAGAGUUCCUAAUAAG | 20 | 2340 |
| myoC-1192 | + | GAGAAAAAGAGUUCCUAAUA | 20 | 1492 |
| myoC-2259 | + | AGAGAAAAAGAGUUCCUAAU | 20 | 2341 |
| myoC-2260 | + | CUGCUAACUCCACAGAGAAA | 20 | 2342 |
| myoC-2261 | + | CUUGUGCUGCUAACUCCACA | 20 | 2343 |
| myoC-2262 | + | CCCUUGUGCUGCUAACUCCA | 20 | 2344 |
| myoC-1190 | + | UUUCUUCCUGUUAAAAGAAA | 20 | 1490 |
| myoC-2264 | + | UUUUCUUCCUGUUAAAAGAA | 20 | 2345 |
| myoC-2265 | + | GAAUGUUUUCUUCCUGUUAA | 20 | 2346 |
| myoC-1189 | + | AUCUGUUUGGCUUUACUCUU | 20 | 1489 |
| myoC-2267 | + | AAUCUGUUUGGCUUUACUCU | 20 | 2347 |
| myoC-2268 | + | AUAGUCAGCAAGACCUAGGC | 20 | 2348 |
| myoC-2269 | + | GAAUCAGAUAGUAAACAUCG | 20 | 2349 |
| myoC-2270 | + | AAGGGUACUAGUCUCAUUUU | 20 | 2350 |
| myoC-2271 | + | UGUUUGUUUACAGCUGACCA | 20 | 2351 |
| myoC-2272 | + | UGAACUUGAGACAUUUACAA | 20 | 2352 |
| myoC-2273 | + | UUCUGCAGUUAAGCCUGAAC | 20 | 2353 |
| myoC-2274 | + | GAUUGGUUCUGCAGUUAAGC | 20 | 2354 |
| myoC-2275 | + | GCAGACUCACCUCCAGAGUG | 20 | 2355 |

TABLE 5E-continued

| gRNA Name | DNA Strand | Targeting Domain | Target Site Length | SEQ ID NO |
|---|---|---|---|---|
| myoC-1181 | + | UGGCAGACUCACCUCCAGAG | 20 | 1481 |
| myoC-2277 | + | CUGGCAGACUCACCUCCAGA | 20 | 2356 |
| myoC-2278 | + | UGCCCUGGCAGACUCACCUC | 20 | 2357 |
| myoC-2279 | + | CAACAACAGUGUCAAUACUU | 20 | 2358 |
| myoC-2280 | + | ACUUGAAAUAAUGAUUGCCU | 20 | 2359 |
| myoC-2281 | + | CAGAAGUAACUUUAAGCCAC | 20 | 2360 |
| myoC-2282 | + | AAUAAAUAUACCAAAACUGU | 20 | 2361 |
| myoC-2283 | + | UUUACAUUAAUAAACCCAAA | 20 | 2362 |
| myoC-2284 | + | GCUUUACAUUAAUAAACCCA | 20 | 2363 |
| myoC-2285 | + | CAUUCAAAUUCACAGGCUUU | 20 | 2364 |
| myoC-2286 | + | AAUAAAAUGUUAAAUUUAGU | 20 | 2365 |
| myoC-1173 | + | GUUUAUGGCUCUAUUCGCAA | 20 | 1473 |
| myoC-2288 | + | AGUUUAUGGCUCUAUUCGCA | 20 | 2366 |
| myoC-2289 | + | CAGGUACUGUUAUUACCACU | 20 | 2367 |
| myoC-2290 | + | GGUCUAAUUUCAAAGUAGUU | 20 | 2368 |
| myoC-1228 | + | UGUUAAAAACAAGAUCCAGC | 20 | 1528 |
| myoC-2292 | + | AUGUUAAAAACAAGAUCCAG | 20 | 2369 |
| myoC-2293 | + | UACAAAGGAAACAAAUGAUA | 20 | 2370 |
| myoC-1227 | + | AUAUAAAAUAUAGAUUACAA | 20 | 1527 |
| myoC-2295 | + | UAUAUAAAAUAUAGAUUACA | 20 | 2371 |
| myoC-2296 | + | GAAAUCUGGGGAACUCUUCU | 20 | 2372 |
| myoC-1226 | + | AACCUCAUUGGUGAAAUCUG | 20 | 1526 |
| myoC-1225 | + | GAACCUCAUUGGUGAAAUCU | 20 | 1525 |
| myoC-1224 | + | AGAACCUCAUUGGUGAAAUC | 20 | 1524 |
| myoC-2300 | + | AAGAACCUCAUUGGUGAAAU | 20 | 2373 |
| myoC-2301 | + | GCAUGCCAAGAACCUCAUUG | 20 | 2374 |
| myoC-2302 | + | ACUCUGUGUGUGUGCAUGCC | 20 | 2375 |
| myoC-2303 | + | AAACAACUGUGUAUCUUUGG | 20 | 2376 |
| myoC-1221 | + | UAAAACAACUGUGUAUCUUU | 20 | 1521 |
| myoC-1220 | + | UUAAAACAACUGUGUAUCUU | 20 | 1520 |
| myoC-2306 | + | UUUAAAACAACUGUGUAUCU | 20 | 2377 |
| myoC-2307 | + | CUCCAGGGAGAGCAUUCCUA | 20 | 2378 |
| myoC-2308 | + | GCACCCUACCAGGCUCCAGG | 20 | 2379 |
| myoC-1218 | + | CAGCACCCUACCAGGCUCCA | 20 | 1518 |
| myoC-1217 | + | ACAGCACCCUACCAGGCUCC | 20 | 1517 |
| myoC-2311 | + | GACAGCACCCUACCAGGCUC | 20 | 2380 |
| myoC-2312 | + | AUAACAGCCAGCCAGAACAC | 20 | 2381 |
| myoC-2313 | + | AGAGAAAAAUAACAGCCAGC | 20 | 2382 |

TABLE 5E-continued

| gRNA Name | DNA Strand | Targeting Domain | Target Site Length | SEQ ID NO |
|---|---|---|---|---|
| myoC-2314 | + | UUUAAGACGUAGCAGGGACA | 20 | 2383 |
| myoC-2315 | + | CCUUUAAGACGUAGCAGGGA | 20 | 2384 |
| myoC-893 | + | CAAGUCCUUUAAGACGUAGC | 20 | 1187 |
| myoC-2317 | + | ACAAGUCCUUUAAGACGUAG | 20 | 2385 |
| myoC-892 | + | CCAGGCACUAUGCUAGGAAC | 20 | 1196 |
| myoC-2319 | + | GCCAGGCACUAUGCUAGGAA | 20 | 2386 |
| myoC-891 | + | ACUGUGCCAGGCACUAUGCU | 20 | 1178 |
| myoC-2321 | + | CACUGUGCCAGGCACUAUGC | 20 | 2387 |
| myoC-2322 | + | AUUCACUCUGCAAACUCAUU | 20 | 2388 |
| myoC-2323 | + | CCAUUCACUCUGCAAACUCA | 20 | 2389 |
| myoC-2324 | + | ACUGGUGUGCUGAUUUCAAC | 20 | 2390 |
| myoC-2325 | + | ACACGUACACACACUUACAC | 20 | 2391 |
| myoC-2326 | + | GUUUGGAGUUUCUUUUUAAA | 20 | 2392 |
| myoC-885 | + | UAACCUUCCAGAAGUCUGUU | 20 | 1208 |
| myoC-2328 | + | AUAACCUUCCAGAAGUCUGU | 20 | 2393 |
| myoC-2329 | + | AUUCUUAGAAAAUAACCUUC | 20 | 2394 |
| myoC-2330 | + | CACGCUGCCAGCAAGAUUCU | 20 | 2395 |
| myoC-882 | + | CUGGGUGGGGCUGUGCACAG | 20 | 1205 |
| myoC-881 | + | GCUGGGUGGGGCUGUGCACA | 20 | 1050 |
| myoC-880 | + | GGCUGGGUGGGGCUGUGCAC | 20 | 1051 |
| myoC-2334 | + | AGGCUGGGUGGGGCUGUGCA | 20 | 2396 |
| myoC-877 | + | GGUGGCCACGUGAGGCUGGG | 20 | 1053 |
| myoC-2336 | + | AGGUGGCCACGUGAGGCUGG | 20 | 2397 |
| myoC-2337 | + | ACAGAGGUGGCCACGUGAGG | 20 | 2398 |
| myoC-2338 | + | GGGAAGACAGAGGUGGCCAC | 20 | 2399 |
| myoC-2339 | + | CAGCCCUUCAUGGGGGAAGA | 20 | 2400 |
| myoC-871 | + | GGGGAGCCAGCCCUUCAUGG | 20 | 992 |
| myoC-870 | + | UGGGGAGCCAGCCCUUCAUG | 20 | 1213 |
| myoC-869 | + | CUGGGGAGCCAGCCCUUCAU | 20 | 1204 |
| myoC-868 | + | ACUGGGGAGCCAGCCCUUCA | 20 | 1177 |
| myoC-2344 | + | UACUGGGGAGCCAGCCCUUC | 20 | 2401 |
| myoC-867 | + | AGAGAGGUUUAUAUAUACUG | 20 | 1180 |
| myoC-866 | + | CAGAGAGGUUUAUAUAUACU | 20 | 1191 |
| myoC-865 | + | CCAGAGAGGUUUAUAUAUAC | 20 | 1195 |
| myoC-2348 | + | UCCAGAGAGGUUUAUAUAUA | 20 | 2402 |
| myoC-2349 | + | UGGCUCAUGCCCGAGCUCCA | 20 | 2403 |
| myoC-2350 | + | GCUGGCUCAUGCCCGAGCUC | 20 | 2404 |
| myoC-2351 | + | GUGGCCUUGCUGGCUCAUGC | 20 | 2405 |

TABLE 5E-continued

| gRNA Name | DNA Strand | Targeting Domain | Target Site Length | SEQ ID NO |
|---|---|---|---|---|
| myoC-2352 | + | CUGUGCUGAGAGGUGCCUGG | 20 | 2406 |
| myoC-2353 | + | UCUGCUGUGCUGAGAGGUGC | 20 | 2407 |
| myoC-2354 | + | CUGGAAAGCUCUGCUGUGCU | 20 | 2408 |
| myoC-2355 | + | CUCUGGAAAGCUCUGCUGUG | 20 | 2409 |
| myoC-2356 | + | AGGCUUGGUGAGGCUUCCUC | 20 | 2410 |
| myoC-2357 | + | GAGGCUUGGUGAGGCUUCCU | 20 | 2411 |
| myoC-2358 | - | AGAGGUUUCCUCUCCAG | 17 | 2412 |
| myoC-752 | - | GAGGUUUCCUCUCCAGC | 17 | 1026 |
| myoC-753 | - | AGGUUUCCUCUCCAGCU | 17 | 1142 |
| myoC-754 | - | GGUUUCCUCUCCAGCUG | 17 | 1045 |
| myoC-755 | - | GUUUCCUCUCCAGCUGG | 17 | 1047 |
| myoC-2363 | - | GGGAGCCCUGCAAGCAC | 17 | 2413 |
| myoC-756 | - | GGAGCCCUGCAAGCACC | 17 | 1035 |
| myoC-2365 | - | UGCAAGCACCCGGGGUC | 17 | 2414 |
| myoC-2366 | - | CCGGGGUCCUGGGUGUC | 17 | 2415 |
| myoC-2367 | - | GUUUUGUUAUCACUCUC | 17 | 2416 |
| myoC-762 | - | UUUUGUUAUCACUCUCU | 17 | 1171 |
| myoC-2369 | - | CAUUCAUUGACAAUUUA | 17 | 2417 |
| myoC-2370 | - | UUAUAUCUGCCAGACAC | 17 | 2418 |
| myoC-2371 | - | ACACCAGAGACAAAAUG | 17 | 2419 |
| myoC-2372 | - | GUCACUGCCCUACCUUC | 17 | 2420 |
| myoC-766 | - | UCACUGCCCUACCUUCG | 17 | 1160 |
| myoC-2374 | - | GGAGGUGACAGUUUCUC | 17 | 2421 |
| myoC-768 | - | GAGGUGACAGUUUCUCA | 17 | 1025 |
| myoC-2376 | - | UUCUCAUGGAAGACGUG | 17 | 2422 |
| myoC-2377 | - | UCAUGGAAGACGUGCAG | 17 | 2423 |
| myoC-2378 | - | CCAACUUAAACCCAGUG | 17 | 2424 |
| myoC-2379 | - | CUUAAACCCAGUGCUGA | 17 | 2425 |
| myoC-2380 | - | AACCCAGUGCUGAAAGA | 17 | 2426 |
| myoC-769 | - | ACCCAGUGCUGAAAGAA | 17 | 1130 |
| myoC-2382 | - | AGGAAAUAAACACCAUC | 17 | 2427 |
| myoC-2383 | - | AAAUAAACACCAUCUUG | 17 | 2428 |
| myoC-2384 | - | UGCUGCCUCCAUCGUGC | 17 | 2429 |
| myoC-771 | - | GCUGCCUCCAUCGUGCC | 17 | 1030 |
| myoC-2386 | - | CCCGGAGGCCCCCAAGC | 17 | 2430 |
| myoC-2387 | - | GGCCUGCCUCGCUUCCC | 17 | 2431 |
| myoC-2388 | - | GAAUCGUCCUGGUGCAU | 17 | 2432 |
| myoC-2389 | - | GUCCUGGUGCAUCUGAG | 17 | 2433 |

TABLE 5E-continued

| gRNA Name | DNA Strand | Targeting Domain | Target Site Length | SEQ ID NO |
|---|---|---|---|---|
| myoC-2390 | - | UCCUGGUGCAUCUGAGC | 17 | 2434 |
| myoC-2391 | - | UCCUUGGCUCCAGGCUC | 17 | 2435 |
| myoC-2392 | - | UGGCUCCAGGCUCCAGA | 17 | 2436 |
| myoC-1233 | - | GGCUCCAGGCUCCAGAA | 17 | 1533 |
| myoC-2394 | - | CAGGCUCCAGAAAGGAA | 17 | 2437 |
| myoC-1234 | - | AGGCUCCAGAAAGGAAA | 17 | 1534 |
| myoC-2396 | - | GCUCCAGAAAGGAAAUG | 17 | 2438 |
| myoC-2397 | - | UCCAGAAAGGAAAUGGA | 17 | 2439 |
| myoC-1235 | - | CCAGAAAGGAAAUGGAG | 17 | 1535 |
| myoC-1236 | - | CAGAAAGGAAAUGGAGA | 17 | 1536 |
| myoC-2400 | - | AGAGGGAAACUAGUCUA | 17 | 2440 |
| myoC-1237 | - | GAGGGAAACUAGUCUAA | 17 | 1537 |
| myoC-2402 | - | GGGAAACUAGUCUAACG | 17 | 2441 |
| myoC-2403 | - | CUAGUCUAACGGAGAAU | 17 | 2442 |
| myoC-1238 | - | UAGUCUAACGGAGAAUC | 17 | 1538 |
| myoC-2405 | - | GUCUAACGGAGAAUCUG | 17 | 2443 |
| myoC-1239 | - | UCUAACGGAGAAUCUGG | 17 | 1539 |
| myoC-1240 | - | CUAACGGAGAAUCUGGA | 17 | 1540 |
| myoC-2408 | - | AGGGGACAGUGUUUCCU | 17 | 2444 |
| myoC-2409 | - | GGGACAGUGUUUCCUCA | 17 | 2445 |
| myoC-1242 | - | GGACAGUGUUUCCUCAG | 17 | 1542 |
| myoC-1243 | - | GACAGUGUUUCCUCAGA | 17 | 1543 |
| myoC-2412 | - | GUGUUUCCUCAGAGGGA | 17 | 2446 |
| myoC-1244 | - | UGUUUCCUCAGAGGGAA | 17 | 1544 |
| myoC-2414 | - | AAAGGGGCCUCCACGUC | 17 | 2447 |
| myoC-1247 | - | AAGGGGCCUCCACGUCC | 17 | 1547 |
| myoC-2416 | - | GGGGCCUCCACGUCCAG | 17 | 2448 |
| myoC-2417 | - | CACGUCCAGGAGAAUUC | 17 | 2449 |
| myoC-1248 | - | ACGUCCAGGAGAAUUCC | 17 | 1548 |
| myoC-2419 | - | CAGGAGAAUUCCAGGAG | 17 | 2450 |
| myoC-1250 | - | AGGAGAAUUCCAGGAGG | 17 | 1550 |
| myoC-1251 | - | GGAGAAUUCCAGGAGGU | 17 | 1551 |
| myoC-2422 | - | CCAGGAGGUGGGGACUG | 17 | 2451 |
| myoC-1253 | - | CAGGAGGUGGGGACUGC | 17 | 1553 |
| myoC-1254 | - | AGGAGGUGGGGACUGCA | 17 | 1554 |
| myoC-2425 | - | GGUGGGGACUGCAGGGA | 17 | 2452 |
| myoC-1255 | - | GUGGGGACUGCAGGGAG | 17 | 1555 |
| myoC-1256 | - | UGGGGACUGCAGGGAGU | 17 | 1556 |

TABLE 5E-continued

| gRNA Name | DNA Strand | Targeting Domain | Target Site Length | SEQ ID NO |
|---|---|---|---|---|
| myoC-2428 | - | UGCAGGGAGUGGGGACG | 17 | 2453 |
| myoC-1258 | - | GCAGGGAGUGGGGACGC | 17 | 1558 |
| myoC-2430 | - | GAGUGGGGACGCUGGGG | 17 | 2454 |
| myoC-2431 | - | GGGGACGCUGGGGCUGA | 17 | 2455 |
| myoC-2432 | - | CUGGGGCUGAGCGGGUG | 17 | 2456 |
| myoC-2433 | - | GAGCGGGUGCUGAAAGG | 17 | 2457 |
| myoC-1264 | - | AGCGGGUGCUGAAAGGC | 17 | 1564 |
| myoC-2435 | - | UGCUGAAAGGCAGGAAG | 17 | 2458 |
| myoC-2436 | - | AAAGGCAGGAAGGUGAA | 17 | 2459 |
| myoC-2437 | - | AGGUGAAAAGGGCAAGG | 17 | 2460 |
| myoC-2438 | - | GAUGUUCAGUGUUGUUC | 17 | 2461 |
| myoC-1269 | - | AUGUUCAGUGUUGUUCA | 17 | 1569 |
| myoC-2440 | - | CAGUGUUGUUCACGGGG | 17 | 2462 |
| myoC-1272 | - | AGUGUUGUUCACGGGGC | 17 | 1572 |
| myoC-1273 | - | GUGUUGUUCACGGGGCU | 17 | 1573 |
| myoC-2443 | - | GUUUUCCGUUGCUUCCU | 17 | 2463 |
| myoC-2444 | - | UUUUAUCUUUUCUCUGC | 17 | 2464 |
| myoC-1274 | - | UUUAUCUUUUCUCUGCU | 17 | 1574 |
| myoC-2446 | - | UAUCUUUUCUCUGCUUG | 17 | 2465 |
| myoC-1275 | - | AUCUUUUCUCUGCUUGG | 17 | 1575 |
| myoC-2448 | - | CUUUUCUCUGCUUGGAG | 17 | 2466 |
| myoC-2449 | - | UUCUCUGCUUGGAGGAG | 17 | 2467 |
| myoC-2450 | - | GAGAAGAAGUCUAUUUC | 17 | 2468 |
| myoC-2451 | - | AAGAAGUCUAUUUCAUG | 17 | 2469 |
| myoC-1276 | - | AGAAGUCUAUUUCAUGA | 17 | 1576 |
| myoC-2453 | - | GUCAGCUGUUAAAAUUC | 17 | 2470 |
| myoC-2454 | - | AAAAUUCCAGGGUGUGC | 17 | 2471 |
| myoC-2455 | - | UGCAUGGGUUUUCCUUC | 17 | 2472 |
| myoC-2456 | - | ACGAAGGCCUUUAUUUA | 17 | 2473 |
| myoC-1283 | - | CGAAGGCCUUUAUUUAA | 17 | 1583 |
| myoC-1284 | - | GAAGGCCUUUAUUUAAU | 17 | 1584 |
| myoC-2459 | - | UUUAUUUAAUGGGAAUA | 17 | 2474 |
| myoC-1285 | - | UUAUUUAAUGGGAAUAU | 17 | 1585 |
| myoC-2461 | - | UAAUGGGAAUAUAGGAA | 17 | 2475 |
| myoC-2462 | - | UCCUAGGCCGUUAAUUC | 17 | 2476 |
| myoC-1287 | - | CCUAGGCCGUUAAUUCA | 17 | 1587 |
| myoC-2464 | - | AGGCCGUUAAUUCACGG | 17 | 2477 |
| myoC-2465 | - | AUUCACGGAAGAAGUGA | 17 | 2478 |
| myoC-1288 | - | UUCACGGAAGAAGUGAC | 17 | 1588 |
| myoC-2467 | - | CUUUUCUUUCAUGUCUU | 17 | 2479 |
| myoC-2468 | - | AACUACUCAGCCCUGUG | 17 | 2480 |
| myoC-2469 | - | UGGCUUAUGCAAGACGG | 17 | 2481 |
| myoC-2470 | - | CAAGACGGUCGAAAACC | 17 | 2482 |
| myoC-1295 | - | AAGACGGUCGAAAACCU | 17 | 1595 |
| myoC-2472 | - | GUCGAAAACCUUGGAAU | 17 | 2483 |
| myoC-1296 | - | UCGAAAACCUUGGAAUC | 17 | 1596 |
| myoC-2474 | - | UGGUUGGCUGUGCGACC | 17 | 2484 |
| myoC-2475 | - | CAAGUGUCUCUCCUUCC | 17 | 2485 |
| myoC-2476 | - | UGCAGCUCUCGUGUUCU | 17 | 2486 |
| myoC-2477 | - | CUUCCCUGUGAUUCUCU | 17 | 2487 |
| myoC-2478 | - | UCCCUGUGAUUCUCUGU | 17 | 2488 |
| myoC-1305 | - | CCCUGUGAUUCUCUGUG | 17 | 1605 |
| myoC-1306 | - | CCUGUGAUUCUCUGUGA | 17 | 1606 |
| myoC-1307 | - | CUGUGAUUCUCUGUGAG | 17 | 1607 |
| myoC-1308 | - | UGUGAUUCUCUGUGAGG | 17 | 1608 |
| myoC-2483 | - | CUCUGUGAGGGGGGAUG | 17 | 2489 |
| myoC-2484 | - | CUGUGAGGGGGGAUGUU | 17 | 2490 |
| myoC-2485 | - | GUGAGGGGGGAUGUUGA | 17 | 2491 |
| myoC-1310 | - | UGAGGGGGGAUGUUGAG | 17 | 1610 |
| myoC-1311 | - | GAGGGGGGAUGUUGAGA | 17 | 1611 |
| myoC-1312 | - | AGGGGGGAUGUUGAGAG | 17 | 1612 |
| myoC-2489 | - | GGGGAUGUUGAGAGGGG | 17 | 2492 |
| myoC-1313 | - | GGGAUGUUGAGAGGGGA | 17 | 1613 |
| myoC-2491 | - | UUGAGAGGGGAAGGAGG | 17 | 2493 |
| myoC-2492 | - | AGGGGAAGGAGGCAGAG | 17 | 2494 |
| myoC-1315 | - | GGGGAAGGAGGCAGAGC | 17 | 1615 |
| myoC-2494 | - | AGGCAGAGCUGGAGCAG | 17 | 2495 |
| myoC-2495 | - | CUGGAGCAGCUGAGCCA | 17 | 2496 |
| myoC-1316 | - | UGGAGCAGCUGAGCCAC | 17 | 1616 |
| myoC-1317 | - | GGAGCAGCUGAGCCACA | 17 | 1617 |
| myoC-1318 | - | GAGCAGCUGAGCCACAG | 17 | 1618 |
| myoC-2499 | - | GCUGAGCCACAGGGGAG | 17 | 2497 |
| myoC-1320 | - | CUGAGCCACAGGGGAGG | 17 | 1620 |
| myoC-2501 | - | GAGCCACAGGGGAGGUG | 17 | 2498 |
| myoC-1321 | - | AGCCACAGGGGAGGUGG | 17 | 1621 |
| myoC-1322 | - | GCCACAGGGGAGGUGGA | 17 | 1622 |

TABLE 5E-continued

| gRNA Name | DNA Strand | Targeting Domain | Target Site Length | SEQ ID NO |
|---|---|---|---|---|
| myoC-1323 | - | CCACAGGGGAGGUGGAG | 17 | 1623 |
| myoC-2505 | - | GGGGAGGUGGAGGGGGA | 17 | 2499 |
| myoC-1325 | - | GGGAGGUGGAGGGGGAC | 17 | 1625 |
| myoC-2507 | - | GGGGACAGGAAGGCAGG | 17 | 2500 |
| myoC-2508 | - | AGGAAGGCAGGCAGAAG | 17 | 2501 |
| myoC-2509 | - | CUGAUCACGUCAGACUC | 17 | 2502 |
| myoC-2510 | - | CACGUCAGACUCCAGGA | 17 | 2503 |
| myoC-2511 | - | CGUCAGACUCCAGGACC | 17 | 2504 |
| myoC-2512 | - | CGAGAGCCACAAUGCUU | 17 | 2505 |
| myoC-1331 | - | GAGAGCCACAAUGCUUC | 17 | 1631 |
| myoC-2514 | - | UGCUUCAGGAAAGCUCA | 17 | 2506 |
| myoC-2515 | - | AUUUGCCAAUAACCAAA | 17 | 2507 |
| myoC-2516 | - | AAUAACCAAAAAGAAUG | 17 | 2508 |
| myoC-2517 | - | UGCCUGGCAUUCAAAAA | 17 | 2509 |
| myoC-2518 | - | GCAUUCAAAAACUGGGC | 17 | 2510 |
| myoC-2519 | - | AAACUGGGCCAGAGCAA | 17 | 2511 |
| myoC-1338 | - | AACUGGGCCAGAGCAAG | 17 | 1638 |
| myoC-2521 | - | GAGCAAGUGGAAAAUGC | 17 | 2512 |
| myoC-2522 | - | CAGUGACUGCUGACAGC | 17 | 2513 |
| myoC-1387 | - | AGUGACUGCUGACAGCA | 17 | 1687 |
| myoC-2524 | - | CGGAGUGACCUGCAGCG | 17 | 2514 |
| myoC-1388 | - | GGAGUGACCUGCAGCGC | 17 | 1688 |
| myoC-1389 | - | GAGUGACCUGCAGCGCA | 17 | 1689 |
| myoC-1390 | - | AGUGACCUGCAGCGCAG | 17 | 1690 |
| myoC-2528 | - | UGACCUGCAGCGCAGGG | 17 | 2515 |
| myoC-1391 | - | GACCUGCAGCGCAGGGG | 17 | 1691 |
| myoC-2530 | - | CCUGCAGCGCAGGGGAG | 17 | 2516 |
| myoC-2531 | - | GCAGCGCAGGGGAGGAG | 17 | 2517 |
| myoC-2532 | - | CAGGGGAGGAGAAGAAA | 17 | 2518 |
| myoC-2533 | - | GGGGAGGAGAAGAAAAA | 17 | 2519 |
| myoC-2534 | - | GGAGGAGAAGAAAAAGA | 17 | 2520 |
| myoC-1392 | - | GAGGAGAAGAAAAAGAG | 17 | 1692 |
| myoC-2536 | - | AAAGAGAGGGAUAGUGU | 17 | 2521 |
| myoC-2537 | - | AGGGAUAGUGUAUGAGC | 17 | 2522 |
| myoC-2538 | - | GAAAGACAGAUUCAUUC | 17 | 2523 |
| myoC-2539 | - | AGAUUCAUUCAAGGGCA | 17 | 2524 |
| myoC-1396 | - | GAUUCAUUCAAGGGCAG | 17 | 1696 |
| myoC-1397 | - | AUUCAUUCAAGGGCAGU | 17 | 1697 |

TABLE 5E-continued

| gRNA Name | DNA Strand | Targeting Domain | Target Site Length | SEQ ID NO |
|---|---|---|---|---|
| myoC-2542 | - | GCAGUGGGAAUUGACCA | 17 | 2525 |
| myoC-1398 | - | CAGUGGGAAUUGACCAC | 17 | 1698 |
| myoC-2544 | - | UUAUAGUCCACGUGAUC | 17 | 2526 |
| myoC-2545 | - | CACGUGAUCCUGGGUUC | 17 | 2527 |
| myoC-1402 | - | ACGUGAUCCUGGGUUCU | 17 | 1702 |
| myoC-2547 | - | UCCUGGGUUCUAGGAGG | 17 | 2528 |
| myoC-2548 | - | GGAGGCAGGGCUAUAUU | 17 | 2529 |
| myoC-1406 | - | GAGGCAGGGCUAUAUUG | 17 | 1706 |
| myoC-1407 | - | AGGCAGGGCUAUAUUGU | 17 | 1707 |
| myoC-1408 | - | GGCAGGGCUAUAUUGUG | 17 | 1708 |
| myoC-1409 | - | GCAGGGCUAUAUUGUGG | 17 | 1709 |
| myoC-1410 | - | CAGGGCUAUAUUGUGGG | 17 | 1710 |
| myoC-2554 | - | GGGGAAAAAAUCAGUUC | 17 | 2530 |
| myoC-1411 | - | GGGAAAAAAUCAGUUCA | 17 | 1711 |
| myoC-1412 | - | GGAAAAAAUCAGUUCAA | 17 | 1712 |
| myoC-2557 | - | AAUCAGUUCAAGGGAAG | 17 | 2531 |
| myoC-1413 | - | AUCAGUUCAAGGGAAGU | 17 | 1713 |
| myoC-1414 | - | UCAGUUCAAGGGAAGUC | 17 | 1714 |
| myoC-2560 | - | UAUUUUUCCUUUACAAG | 17 | 2532 |
| myoC-2561 | - | UUACAAGCUGAGUAAUU | 17 | 2533 |
| myoC-2562 | - | AAGUCACAAGGUAGUAA | 17 | 2534 |
| myoC-2563 | - | ACUUAGUUUCUCCUUAU | 17 | 2535 |
| myoC-1417 | - | CUUAGUUUCUCCUUAUU | 17 | 1717 |
| myoC-2565 | - | AGGAACUCUUUUUCUCU | 17 | 2536 |
| myoC-1418 | - | GGAACUCUUUUUCUCUG | 17 | 1718 |
| myoC-2567 | - | UGUGGAGUUAGCAGCAC | 17 | 2537 |
| myoC-2568 | - | AAUCCCGUUUCUUUUAA | 17 | 2538 |
| myoC-1421 | - | AUCCCGUUUCUUUUAAC | 17 | 1721 |
| myoC-2570 | - | CCGUUUCUUUUAACAGG | 17 | 2539 |
| myoC-2571 | - | AGGAAGAAAACAUUCCU | 17 | 2540 |
| myoC-2572 | - | ACUAUAUGAUUGGUUUU | 17 | 2541 |
| myoC-2573 | - | AUGUUUACUAUCUGAUU | 17 | 2542 |
| myoC-2574 | - | ACUAUCUGAUUCAGAAA | 17 | 2543 |
| myoC-2575 | - | AAGUUCAGGCUUAACUG | 17 | 2544 |
| myoC-2576 | - | UGCAGAACCAAUCAAAU | 17 | 2545 |
| myoC-2577 | - | AACCAAUCAAAUAAGAA | 17 | 2546 |
| myoC-2578 | - | AAUAAGAAUAGAAUCUU | 17 | 2547 |
| myoC-2579 | - | AACUGUGUUUCUCCACU | 17 | 2548 |

TABLE 5E-continued

| gRNA Name | DNA Strand | Targeting Domain | Target Site Length | SEQ ID NO |
|---|---|---|---|---|
| myoC-1426 | - | ACUGUGUUUCUCCACUC | 17 | 1726 |
| myoC-2581 | - | GUUUCUCCACUCUGGAG | 17 | 2549 |
| myoC-2582 | - | UCUGGAGGUGAGUCUGC | 17 | 2550 |
| myoC-2583 | - | GAGUCUGCCAGGGCAGU | 17 | 2551 |
| myoC-1430 | - | AGUCUGCCAGGGCAGUU | 17 | 1730 |
| myoC-2585 | - | CUUUUUGUUUUUUCUCU | 17 | 2552 |
| myoC-2586 | - | GGUUUAUUAAUGUAAAG | 17 | 2553 |
| myoC-1438 | - | GUUUAUUAAUGUAAAGC | 17 | 1738 |
| myoC-2588 | - | AUUAUUAACCUACAGUC | 17 | 2554 |
| myoC-2589 | - | UACAGUCCAGAAAGCCU | 17 | 2555 |
| myoC-2590 | - | CCAGAAAGCCUGUGAAU | 17 | 2556 |
| myoC-2591 | - | AAAGCCUGUGAAUUUGA | 17 | 2557 |
| myoC-2592 | - | AGCCUGUGAAUUUGAAU | 17 | 2558 |
| myoC-1440 | - | GCCUGUGAAUUUGAAUG | 17 | 1740 |
| myoC-2594 | - | UAACAUUUUAUUCCAUU | 17 | 2559 |
| myoC-2595 | - | UUUUAUUCCAUUGCGAA | 17 | 2560 |
| myoC-2596 | - | GAUUUUGUCAUUACCAA | 17 | 2561 |
| myoC-2597 | - | UUGCAGAUACGUUGUAA | 17 | 2562 |
| myoC-2598 | - | UUAUACUCAAAACUACU | 17 | 2563 |
| myoC-2599 | - | UGAAAUUAGACCUCCUG | 17 | 2564 |
| myoC-2600 | - | AUCUAUAUUUUAUAUAU | 17 | 2565 |
| myoC-2601 | - | UAUUUGAAAACAUCUUU | 17 | 2566 |
| myoC-2602 | - | UUUGAAAACAUCUUUCU | 17 | 2567 |
| myoC-2603 | - | GAAAACAUCUUUCUGAG | 17 | 2568 |
| myoC-2604 | - | UUCCCCAGAUUUCACCA | 17 | 2569 |
| myoC-2605 | - | CUUGGCAUGCACACACA | 17 | 2570 |
| myoC-2606 | - | AUGCACACACACAGAGU | 17 | 2571 |
| myoC-2607 | - | CAGAGUAAGAACUGAUU | 17 | 2572 |
| myoC-2608 | - | AACAUUGACAUUGGUGC | 17 | 2573 |
| myoC-2609 | - | GUGCCUGAGAUGCAAGA | 17 | 2574 |
| myoC-2610 | - | AGAUGCAAGACUGAAAU | 17 | 2575 |
| myoC-2611 | - | CACAGUUGUUUUAAAGC | 17 | 2576 |
| myoC-2612 | - | ACAGUUGUUUUAAAGCU | 17 | 2577 |
| myoC-2613 | - | UUGUUUUAAAGCUAGGG | 17 | 2578 |
| myoC-2614 | - | GUUUUAAAGCUAGGGGU | 17 | 2579 |
| myoC-2615 | - | UUUUAAAGCUAGGGGUG | 17 | 2580 |
| myoC-2616 | - | UUUAAAGCUAGGGGUGA | 17 | 2581 |
| myoC-2617 | - | UUAAAGCUAGGGGUGAG | 17 | 2582 |
| myoC-2618 | - | UAAAGCUAGGGGUGAGG | 17 | 2583 |
| myoC-2619 | - | AAAGCUAGGGGUGAGGG | 17 | 2584 |
| myoC-2620 | - | GAAAUCUGCCGCUUCUA | 17 | 2585 |
| myoC-1480 | - | AAAUCUGCCGCUUCUAU | 17 | 1780 |
| myoC-2622 | - | CUAUAGGAAUGCUCUCC | 17 | 2586 |
| myoC-1481 | - | UAUAGGAAUGCUCUCCC | 17 | 1781 |
| myoC-2624 | - | CUCUCCCUGGAGCCUGG | 17 | 2587 |
| myoC-2625 | - | GUCCCUGCUACGUCUUA | 17 | 2588 |
| myoC-2626 | - | CGUCUUAAAGGACUUGU | 17 | 2589 |
| myoC-2627 | - | CACAGUGCAGGUUCUCA | 17 | 2590 |
| myoC-2628 | - | GGUUCUCAAUGAGUUUG | 17 | 2591 |
| myoC-2629 | - | CUCAAUGAGUUUGCAGA | 17 | 2592 |
| myoC-2630 | - | AUGAGUUUGCAGAGUGA | 17 | 2593 |
| myoC-899 | - | UGAGUUUGCAGAGUGAA | 17 | 1254 |
| myoC-2632 | - | UGAAUGGAAAUAUAAAC | 17 | 2594 |
| myoC-2633 | - | CUAGAAAUAUAUCCUUG | 17 | 2595 |
| myoC-2634 | - | UGUGUGUGUAAAACCAG | 17 | 2596 |
| myoC-902 | - | GUGUGUGUAAAACCAGG | 17 | 1073 |
| myoC-2636 | - | AAAACCAGGUGGAGAUA | 17 | 2597 |
| myoC-903 | - | AAACCAGGUGGAGAUAU | 17 | 1222 |
| myoC-2638 | - | AGAUAUAGGAACUAUUA | 17 | 2598 |
| myoC-904 | - | GAUAUAGGAACUAUUAU | 17 | 1058 |
| myoC-2640 | - | GGAACUAUUAUUGGGGU | 17 | 2599 |
| myoC-2641 | - | GGGUAUGGGUGCAUAAA | 17 | 2600 |
| myoC-909 | - | GGUAUGGGUGCAUAAAU | 17 | 1067 |
| myoC-2643 | - | GGGAUGUUCUUUUUAAA | 17 | 2601 |
| myoC-2644 | - | AAACUCCAAACAGACUU | 17 | 2602 |
| myoC-911 | - | AACUCCAAACAGACUUC | 17 | 1225 |
| myoC-2646 | - | CUGGAAGGUUAUUUUCU | 17 | 2603 |
| myoC-2647 | - | AGAAUCUUGCUGGCAGC | 17 | 2604 |
| myoC-2648 | - | CACCUCUGUCUUCCCCC | 17 | 2605 |
| myoC-2649 | - | CUCUGUCUUCCCCCAUG | 17 | 2606 |
| myoC-2650 | - | AGUAUAUAUAAACCUCU | 17 | 2607 |
| myoC-919 | - | GUAUAUAUAAACCUCUC | 17 | 998 |
| myoC-2652 | - | AUAAACCUCUCUGGAGC | 17 | 2608 |
| myoC-2653 | - | CUCUCUGGAGCUCGGGC | 17 | 2609 |
| myoC-2654 | - | GGCACCUCUCAGCACAG | 17 | 2610 |
| myoC-2655 | - | AGCACAGCAGAGCUUUC | 17 | 2611 |

TABLE 5E-continued

| gRNA Name | DNA Strand | Targeting Domain | Target Site Length | SEQ ID NO |
|---|---|---|---|---|
| myoC-2656 | − | CACAGCAGAGCUUUCCA | 17 | 2612 |
| myoC-2657 | − | ACAGCAGAGCUUUCCAG | 17 | 2613 |
| myoC-826 | + | GAGAGGAAACCUCUGCC | 17 | 1023 |
| myoC-825 | + | GGAGAGGAAACCUCUGC | 17 | 1034 |
| myoC-2660 | + | UGGAGAGGAAACCUCUG | 17 | 2614 |
| myoC-824 | + | GGCUCCCCCAGCUGGAG | 17 | 1040 |
| myoC-2662 | + | GGGCUCCCCCAGCUGGA | 17 | 2615 |
| myoC-2663 | + | CAGGGCUCCCCCAGCUG | 17 | 2616 |
| myoC-823 | + | UGCAGGGCUCCCCCAGC | 17 | 1165 |
| myoC-2665 | + | UUGCAGGGCUCCCCCAG | 17 | 2617 |
| myoC-2666 | + | AGGACCCCGGGUGCUUG | 17 | 2618 |
| myoC-2667 | + | UCAGGACACCCAGGACC | 17 | 2619 |
| myoC-2668 | + | AGGUUGCUCAGGACACC | 17 | 2620 |
| myoC-2669 | + | CGGGCUGGCAGGUUGCU | 17 | 2621 |
| myoC-2670 | + | ACAAAACAACCAGUGGC | 17 | 2622 |
| myoC-2671 | + | AAAGCAACAGGUCCCUA | 17 | 2623 |
| myoC-2672 | + | AGAAAGCAACAGGUCCC | 17 | 2624 |
| myoC-2673 | + | AACGAGUCACACAGAAA | 17 | 2625 |
| myoC-2674 | + | UGAAUGAACGAGUCACA | 17 | 2626 |
| myoC-2675 | + | AAUGCCUGGAUGAAUGA | 17 | 2627 |
| myoC-2676 | + | AAUGAAUGCCUGGAUGA | 17 | 2628 |
| myoC-2677 | + | UGUCAAUGAAUGCCUGG | 17 | 2629 |
| myoC-2678 | + | AAAUUGUCAAUGAAUGC | 17 | 2630 |
| myoC-2679 | + | UACUCAAUAAAUUGUCA | 17 | 2631 |
| myoC-2680 | + | UGUCACCUCCACGAAGG | 17 | 2632 |
| myoC-2681 | + | GAGAAACUGUCACCUCC | 17 | 2633 |
| myoC-2682 | + | UUCUGCACGUCUUCCAU | 17 | 2634 |
| myoC-2683 | + | UCUUCUGCACGUCUUCC | 17 | 2635 |
| myoC-2684 | + | UUUCCUUUCUUUCAGCA | 17 | 2636 |
| myoC-798 | + | GGGAGGUGGCCUUGUUA | 17 | 1041 |
| myoC-2686 | + | AGGGAGGUGGCCUUGUU | 17 | 2637 |
| myoC-795 | + | GGCAGCAGGGGGCGCUA | 17 | 1039 |
| myoC-794 | + | AGGCAGCAGGGGGCGCU | 17 | 1140 |
| myoC-2689 | + | GAGGCAGCAGGGGGCGC | 17 | 2638 |
| myoC-791 | + | GCACGAUGGAGGCAGCA | 17 | 1028 |
| myoC-790 | + | GGCACGAUGGAGGCAGC | 17 | 1038 |
| myoC-2692 | + | GGGCACGAUGGAGGCAG | 17 | 2639 |
| myoC-788 | + | GGGGCCUCCGGGCACGA | 17 | 1043 |
| myoC-2694 | + | GGGGGCCUCCGGGCACG | 17 | 2640 |
| myoC-2695 | + | CUCGGGCUUGGGGGCCU | 17 | 2641 |
| myoC-783 | + | UUGGAAGACUCGGGCUU | 17 | 1169 |
| myoC-782 | + | CUUGGAAGACUCGGGCU | 17 | 1158 |
| myoC-2698 | + | GCUUGGAAGACUCGGGC | 17 | 2642 |
| myoC-2699 | + | GAGGAGGCUUGGAAGAC | 17 | 2643 |
| myoC-779 | + | UGAUGGAGGAGGAGGCU | 17 | 1163 |
| myoC-2701 | + | CUGAUGGAGGAGGAGGC | 17 | 2644 |
| myoC-777 | + | GCUGUGACUGAUGGAGG | 17 | 1031 |
| myoC-2703 | + | CGCUGUGACUGAUGGAG | 17 | 2645 |
| myoC-776 | + | AGCGCUGUGACUGAUGG | 17 | 1137 |
| myoC-2705 | + | CAGCGCUGUGACUGAUG | 17 | 2646 |
| myoC-775 | + | UGCAGCGCUGUGACUGA | 17 | 1164 |
| myoC-2707 | + | CUGCAGCGCUGUGACUG | 17 | 2647 |
| myoC-2708 | + | AGGACGAUUCACGGGAA | 17 | 2648 |
| myoC-2709 | + | GCACCAGGACGAUUCAC | 17 | 2649 |
| myoC-2710 | + | UGCACCAGGACGAUUCA | 17 | 2650 |
| myoC-2711 | + | AUGCACCAGGACGAUUC | 17 | 2651 |
| myoC-2712 | + | CUCCAGCUCAGAUGCAC | 17 | 2652 |
| myoC-1385 | + | UCUGGAGCCUGGAGCCA | 17 | 1685 |
| myoC-2714 | + | UUCUGGAGCCUGGAGCC | 17 | 2653 |
| myoC-1384 | + | AUUUCCUUUCUGGAGCC | 17 | 1684 |
| myoC-2716 | + | CAUUUCCUUUCUGGAGC | 17 | 2654 |
| myoC-1383 | + | CCUCUCCAUUUCCUUUC | 17 | 1683 |
| myoC-2718 | + | CCCUCUCCAUUUCCUUU | 17 | 2655 |
| myoC-1382 | + | AGGCCCCUUUCCCUCUG | 17 | 1682 |
| myoC-2720 | + | GAGGCCCCUUUCCCUCU | 17 | 2656 |
| myoC-2721 | + | UGGAGGCCCCUUUCCCU | 17 | 2657 |
| myoC-1380 | + | UGGAAUUCUCCUGGACG | 17 | 1680 |
| myoC-2723 | + | CUGGAAUUCUCCUGGAC | 17 | 2658 |
| myoC-2724 | + | CACCUCCUGGAAUUCUC | 17 | 2659 |
| myoC-1378 | + | CUGCAGUCCCCACCUCC | 17 | 1678 |
| myoC-2726 | + | CCUGCAGUCCCCACCUC | 17 | 2660 |
| myoC-2727 | + | UGAACAACACUGAACAU | 17 | 2661 |
| myoC-2728 | + | CAGCCCCGUGAACAACA | 17 | 2662 |
| myoC-2729 | + | GGAAAACUCCCAGCCCC | 17 | 2663 |
| myoC-1375 | + | AGGCUCACAGGAAGCAA | 17 | 1675 |
| myoC-2731 | + | AAGGCUCACAGGAAGCA | 17 | 2664 |

TABLE 5E-continued

| gRNA Name | DNA Strand | Targeting Domain | Target Site Length | SEQ ID NO |
|---|---|---|---|---|
| myoC-1374 | + | AAGAUAAAAAGGCUCAC | 17 | 1674 |
| myoC-2733 | + | AAAGAUAAAAAGGCUCA | 17 | 2665 |
| myoC-2734 | + | UUCUUCUCCUCCAAGCA | 17 | 2666 |
| myoC-2735 | + | ACUUCUUCUCCUCCAAG | 17 | 2667 |
| myoC-2736 | + | UGAAACUGCAUCCCUUC | 17 | 2668 |
| myoC-2737 | + | UUUUAACAGCUGACUUU | 17 | 2669 |
| myoC-1372 | + | AAAACCCAUGCACACCC | 17 | 1672 |
| myoC-2739 | + | GAAAACCCAUGCACACC | 17 | 2670 |
| myoC-1371 | + | AAUAAAGGCCUUCGUGA | 17 | 1671 |
| myoC-2741 | + | AAAUAAAGGCCUUCGUG | 17 | 2671 |
| myoC-2742 | + | AUUAAAUAAAGGCCUUC | 17 | 2672 |
| myoC-2743 | + | AAUUAACGGCCUAGGAA | 17 | 2673 |
| myoC-1369 | + | CCGUGAAUUAACGGCCU | 17 | 1669 |
| myoC-2745 | + | UCCGUGAAUUAACGGCC | 17 | 2674 |
| myoC-2746 | + | CUCCAGUCACUUCUUCC | 17 | 2675 |
| myoC-2747 | + | UUGCCCAGAAGACAUGA | 17 | 2676 |
| myoC-2748 | + | GUAGUUGCCCAGAAGAC | 17 | 2677 |
| myoC-2749 | + | AGGGCUGAGUAGUUGCC | 17 | 2678 |
| myoC-2750 | + | CCAAGUCCACCACAGGG | 17 | 2679 |
| myoC-2751 | + | AUAAGCCAAGUCCACCA | 17 | 2680 |
| myoC-2752 | + | CAGAACCAGAAAGAAAA | 17 | 2681 |
| myoC-2753 | + | CCAAUGGCAGAACCAGA | 17 | 2682 |
| myoC-2754 | + | CCAACCAAUGGCAGAAC | 17 | 2683 |
| myoC-2755 | + | GCACAGCCAACCAAUGG | 17 | 2684 |
| myoC-2756 | + | ACUAUGGCCCAGGGAAG | 17 | 2685 |
| myoC-1362 | + | AGACUAUGGCCCAGGGA | 17 | 1662 |
| myoC-2758 | + | AAGACUAUGGCCCAGGG | 17 | 2686 |
| myoC-1361 | + | GAGAAGACUAUGGCCCA | 17 | 1661 |
| myoC-1360 | + | AGAGAAGACUAUGGCCC | 17 | 1660 |
| myoC-2761 | + | CAGAGAAGACUAUGGCC | 17 | 2687 |
| myoC-2762 | + | CAAGGGUCUUUAUAGCA | 17 | 2688 |
| myoC-2763 | + | UGCAAGGGUCUUUAUAG | 17 | 2689 |
| myoC-2764 | + | CAGAACACGAGAGCUGC | 17 | 2690 |
| myoC-2765 | + | AAGUGUUCACAGAACAC | 17 | 2691 |
| myoC-2766 | + | GGAAGUGUUCACAGAAC | 17 | 2692 |
| myoC-2767 | + | UCACAGGGAAGUGUUCA | 17 | 2693 |
| myoC-1356 | + | CCUCACAGAGAAUCACA | 17 | 1656 |
| myoC-1355 | + | CCCUCACAGAGAAUCAC | 17 | 1655 |
| myoC-2770 | + | CCCCUCACAGAGAAUCA | 17 | 2694 |
| myoC-2771 | + | CAACAUCCCCCCUCACA | 17 | 2695 |
| myoC-2772 | + | CUCAACAUCCCCCCUCA | 17 | 2696 |
| myoC-1353 | + | UGAUCAGUGAGGACUGA | 17 | 1653 |
| myoC-2774 | + | GUGAUCAGUGAGGACUG | 17 | 2697 |
| myoC-2775 | + | AGUCUGACGUGAUCAGU | 17 | 2698 |
| myoC-2776 | + | GGAGUCUGACGUGAUCA | 17 | 2699 |
| myoC-1351 | + | AUUGUGGCUCUCGGUCC | 17 | 1651 |
| myoC-2778 | + | CAUUGUGGCUCUCGGUC | 17 | 2700 |
| myoC-2779 | + | GGGUUCAUUGAGCUUUC | 17 | 2701 |
| myoC-2780 | + | UGUGGCUGUUGGGUUCA | 17 | 2702 |
| myoC-2781 | + | GAAGGAAAAUGUGGCUG | 17 | 2703 |
| myoC-1345 | + | UUGUCUAUGCUUAGGGA | 17 | 1645 |
| myoC-2783 | + | AUUGUCUAUGCUUAGGG | 17 | 2704 |
| myoC-1344 | + | GCCAUUGUCUAUGCUUA | 17 | 1644 |
| myoC-1343 | + | UGCCAUUGUCUAUGCUU | 17 | 1643 |
| myoC-2786 | + | AUGCCAUUGUCUAUGCU | 17 | 2705 |
| myoC-2787 | + | UUGCUCUGGCCCAGUUU | 17 | 2706 |
| myoC-2788 | + | GUGGGGUGCUGGUCAGG | 17 | 2707 |
| myoC-2789 | + | CUGCGUGGGGUGCUGGU | 17 | 2708 |
| myoC-1469 | + | GUCACUGCUGAGCUGCG | 17 | 1769 |
| myoC-2791 | + | AGUCACUGCUGAGCUGC | 17 | 2709 |
| myoC-2792 | + | GCUGUCAGCAGUCACUG | 17 | 2710 |
| myoC-2793 | + | AUUCCCACUGCCCUUGA | 17 | 2711 |
| myoC-2794 | + | GUCAAUUCCCACUGCCC | 17 | 2712 |
| myoC-2795 | + | CUAGAACCCAGGAUCAC | 17 | 2713 |
| myoC-2796 | + | CCCUGCCUCCUAGAACC | 17 | 2714 |
| myoC-2797 | + | AAUAUAGCCCUGCCUCC | 17 | 2715 |
| myoC-2798 | + | AGGUCUCCCGACUUCCC | 17 | 2716 |
| myoC-2799 | + | AAGGAAAAAUAUAGUAU | 17 | 2717 |
| myoC-1463 | + | AAUUACUCAGCUUGUAA | 17 | 1763 |
| myoC-2801 | + | GAAUUACUCAGCUUGUA | 17 | 2718 |
| myoC-2802 | + | CUACCUUGUGACUUGCU | 17 | 2719 |
| myoC-2803 | + | AAAGAGUUCCUAAUAAG | 17 | 2720 |
| myoC-1462 | + | AAAAAGAGUUCCUAAUA | 17 | 1762 |
| myoC-2805 | + | GAAAAAGAGUUCCUAAU | 17 | 2721 |
| myoC-2806 | + | CUAACUCCACAGAGAAA | 17 | 2722 |
| myoC-2807 | + | GUGCUGCUAACUCCACA | 17 | 2723 |

TABLE 5E-continued

| gRNA Name | DNA Strand | Targeting Domain | Target Site Length | SEQ ID NO |
|---|---|---|---|---|
| myoC-2808 | + | UUGUGCUGCUAACUCCA | 17 | 2724 |
| myoC-1460 | + | CUUCCUGUUAAAAGAAA | 17 | 1760 |
| myoC-2810 | + | UCUUCCUGUUAAAAGAA | 17 | 2725 |
| myoC-2811 | + | UGUUUUCUUCCUGUUAA | 17 | 2726 |
| myoC-1459 | + | UGUUUGGCUUUACUCUU | 17 | 1759 |
| myoC-2813 | + | CUGUUUGGCUUUACUCU | 17 | 2727 |
| myoC-2814 | + | GUCAGCAAGACCUAGGC | 17 | 2728 |
| myoC-2815 | + | UCAGAUAGUAAACAUCG | 17 | 2729 |
| myoC-2816 | + | GGUACUAGUCUCAUUUU | 17 | 2730 |
| myoC-2817 | + | UUGUUUACAGCUGACCA | 17 | 2731 |
| myoC-2818 | + | ACUUGAGACAUUUACAA | 17 | 2732 |
| myoC-2819 | + | UGCAGUUAAGCCUGAAC | 17 | 2733 |
| myoC-2820 | + | UGGUUCUGCAGUUAAGC | 17 | 2734 |
| myoC-2821 | + | GACUCACCUCCAGAGUG | 17 | 2735 |
| myoC-1451 | + | CAGACUCACCUCCAGAG | 17 | 1751 |
| myoC-2823 | + | GCAGACUCACCUCCAGA | 17 | 2736 |
| myoC-2824 | + | CCUGGCAGACUCACCUC | 17 | 2737 |
| myoC-2825 | + | CAACAGUGUCAAUACUU | 17 | 2738 |
| myoC-2826 | + | UGAAAUAAUGAUUGCCU | 17 | 2739 |
| myoC-2827 | + | AAGUAACUUUAAGCCAC | 17 | 2740 |
| myoC-2828 | + | AAAUAUACCAAAACUGU | 17 | 2741 |
| myoC-2829 | + | ACAUUAAUAAACCCAAA | 17 | 2742 |
| myoC-2830 | + | UUACAUUAAUAAACCCA | 17 | 2743 |
| myoC-2831 | + | UCAAAUUCACAGGCUUU | 17 | 2744 |
| myoC-2832 | + | AAAAUGUUAAAUUUAGU | 17 | 2745 |
| myoC-1443 | + | UAUGGCUCUAUUCGCAA | 17 | 1743 |
| myoC-2834 | + | UUAUGGCUCUAUUCGCA | 17 | 2746 |
| myoC-2835 | + | GUACUGUUAUUACCACU | 17 | 2747 |
| myoC-2836 | + | CUAAUUUCAAAGUAGUU | 17 | 2748 |
| myoC-1498 | + | UAAAAACAAGAUCCAGC | 17 | 1798 |
| myoC-2838 | + | UUAAAAACAAGAUCCAG | 17 | 2749 |
| myoC-2839 | + | AAAGGAAACAAAUGAUA | 17 | 2750 |
| myoC-1497 | + | UAAAAUAUAGAUUACAA | 17 | 1797 |
| myoC-2841 | + | AUAAAAUAUAGAUUACA | 17 | 2751 |
| myoC-2842 | + | AUCUGGGGAACUCUUCU | 17 | 2752 |
| myoC-1496 | + | CUCAUUGGUGAAAUCUG | 17 | 1796 |
| myoC-1495 | + | CCUCAUUGGUGAAAUCU | 17 | 1795 |
| myoC-1494 | + | ACCUCAUUGGUGAAAUC | 17 | 1794 |

TABLE 5E-continued

| gRNA Name | DNA Strand | Targeting Domain | Target Site Length | SEQ ID NO |
|---|---|---|---|---|
| myoC-2846 | + | AACCUCAUUGGUGAAAU | 17 | 2753 |
| myoC-2847 | + | UGCCAAGAACCUCAUUG | 17 | 2754 |
| myoC-2848 | + | CUGUGUGUGUGCAUGCC | 17 | 2755 |
| myoC-2849 | + | CAACUGUGUAUCUUUGG | 17 | 2756 |
| myoC-1491 | + | AACAACUGUGUAUCUUU | 17 | 1791 |
| myoC-1490 | + | AAACAACUGUGUAUCUU | 17 | 1790 |
| myoC-2852 | + | AAAACAACUGUGUAUCU | 17 | 2757 |
| myoC-2853 | + | CAGGGAGAGCAUUCCUA | 17 | 2758 |
| myoC-2854 | + | CCCUACCAGGCUCCAGG | 17 | 2759 |
| myoC-1488 | + | CACCCUACCAGGCUCCA | 17 | 1788 |
| myoC-1487 | + | GCACCCUACCAGGCUCC | 17 | 1787 |
| myoC-2857 | + | AGCACCCUACCAGGCUC | 17 | 2760 |
| myoC-2858 | + | ACAGCCAGCCAGAACAC | 17 | 2761 |
| myoC-2859 | + | GAAAAAUAACAGCCAGC | 17 | 2762 |
| myoC-2860 | + | AAGACGUAGCAGGGACA | 17 | 2763 |
| myoC-2861 | + | UUAAGACGUAGCAGGGA | 17 | 2764 |
| myoC-959 | + | GUCCUUUAAGACGUAGC | 17 | 1000 |
| myoC-2863 | + | AGUCCUUUAAGACGUAG | 17 | 2765 |
| myoC-958 | + | GGCACUAUGCUAGGAAC | 17 | 1062 |
| myoC-2865 | + | AGGCACUAUGCUAGGAA | 17 | 2766 |
| myoC-957 | + | GUGCCAGGCACUAUGCU | 17 | 1071 |
| myoC-2867 | + | UGUGCCAGGCACUAUGC | 17 | 2767 |
| myoC-2868 | + | CACUCUGCAAACUCAUU | 17 | 2768 |
| myoC-2869 | + | UUCACUCUGCAAACUCA | 17 | 2769 |
| myoC-2870 | + | GGUGUGCUGAUUUCAAC | 17 | 2770 |
| myoC-2871 | + | CGUACACACACUUACAC | 17 | 2771 |
| myoC-2872 | + | UGGAGUUUCUUUUUAAA | 17 | 2772 |
| myoC-951 | + | CCUUCCAGAAGUCUGUU | 17 | 1242 |
| myoC-2874 | + | ACCUUCCAGAAGUCUGU | 17 | 2773 |
| myoC-2875 | + | CUUAGAAAAUAACCUUC | 17 | 2774 |
| myoC-2876 | + | GCUGCCAGCAAGAUUCU | 17 | 2775 |
| myoC-948 | + | GGUGGGGCUGUGCACAG | 17 | 1069 |
| myoC-947 | + | GGGUGGGGCUGUGCACA | 17 | 1066 |
| myoC-946 | + | UGGGUGGGGCUGUGCAC | 17 | 1257 |
| myoC-2880 | + | CUGGGUGGGGCUGUGCA | 17 | 2776 |
| myoC-943 | + | GGCCACGUGAGGCUGGG | 17 | 1063 |
| myoC-2882 | + | UGGCCACGUGAGGCUGG | 17 | 2777 |
| myoC-2883 | + | GAGGUGGCCACGUGAGG | 17 | 2778 |

TABLE 5E-continued

| gRNA Name | DNA Strand | Targeting Domain | Target Site Length | SEQ ID NO |
|---|---|---|---|---|
| myoC-2884 | + | AAGACAGAGGUGGCCAC | 17 | 2779 |
| myoC-2885 | + | CCCUUCAUGGGGGAAGA | 17 | 2780 |
| myoC-937 | + | GAGCCAGCCCUUCAUGG | 17 | 1056 |
| myoC-936 | + | GGAGCCAGCCCUUCAUG | 17 | 1061 |
| myoC-935 | + | GGGAGCCAGCCCUUCAU | 17 | 1064 |
| myoC-934 | + | GGGGAGCCAGCCCUUCA | 17 | 1065 |
| myoC-2890 | + | UGGGGAGCCAGCCCUUC | 17 | 2781 |
| myoC-933 | + | GAGGUUUAUAUAUACUG | 17 | 1057 |
| myoC-932 | + | AGAGGUUUAUAUAUACU | 17 | 1230 |
| myoC-931 | + | GAGAGGUUUAUAUAUAC | 17 | 997 |
| myoC-2894 | + | AGAGAGGUUUAUAUAUA | 17 | 2782 |
| myoC-2895 | + | CUCAUGCCCGAGCUCCA | 17 | 2783 |
| myoC-2896 | + | GGCUCAUGCCCGAGCUC | 17 | 2784 |
| myoC-2897 | + | GCCUUGCUGGCUCAUGC | 17 | 2785 |
| myoC-2898 | + | UGCUGAGAGGUGCCUGG | 17 | 2786 |
| myoC-2899 | + | GCUGUGCUGAGAGGUGC | 17 | 2787 |
| myoC-2900 | + | GAAAGCUCUGCUGUGCU | 17 | 2788 |
| myoC-2901 | + | UGGAAAGCUCUGCUGUG | 17 | 2789 |
| myoC-2902 | + | CUUGGUGAGGCUUCCUC | 17 | 2790 |
| myoC-2903 | + | GCUUGGUGAGGCUUCCU | 17 | 2791 |

Table 5F provides exemplary targeting domains for repressing (i.e., knocking down or decreasing) expression of the MYOC gene. Any of the targeting domains in the table can be used with an *N. meningitidis* eiCas9 molecule to cause a steric block in the promoter region to block transcription elongation resulting in the repression of the MYOC gene. Any of the targeting domains in the table can be used with an *N. meningitidis* eiCas9 fused to a transcriptional repressor to decrease transcription and therefore downregulate gene expression.

TABLE 5F

| gRNA Name | DNA Strand | Targeting Domain | Target Site Length | SEQ ID NO |
|---|---|---|---|---|
| myoC-3098 | − | CGUGUUCUGUGAACACUUCC | 20 | 2856 |
| myoC-1975 | − | CCAGAGCAAGUGGAAAAUGC | 20 | 2132 |
| myoC-3100 | − | GAUAGUGUAUGAGCAAGAAA | 20 | 2857 |
| myoC-1996 | − | AGGGCAGUGGGAAUUGACCA | 20 | 2145 |
| myoC-3102 | − | AGUUCAAGGGAAGUCGGGAG | 20 | 2858 |
| myoC-3103 | − | ACAAGGUAGUAACUGAGGCU | 20 | 2859 |
| myoC-3104 | − | CAUUCCUAAGAGUAAAGCCA | 20 | 2860 |
| myoC-3105 | − | AAGCCUAGGUCUUGCUGACU | 20 | 2861 |

TABLE 5F-continued

| gRNA Name | DNA Strand | Targeting Domain | Target Site Length | SEQ ID NO |
|---|---|---|---|---|
| myoC-3106 | − | UCAUUUCAGCGAUGUUUACU | 20 | 2862 |
| myoC-2040 | − | UUGGGUUUAUUAAUGUAAAG | 20 | 2173 |
| myoC-3108 | − | CAAAGUGGUAAUAACAGUAC | 20 | 2863 |
| myoC-3109 | − | CAUCUUUCUGAGAAGAGUUC | 20 | 2864 |
| myoC-3110 | − | AUGCACACACACAGAGUAAG | 20 | 2865 |
| myoC-3111 | + | UCUCCAGCUCAGAUGCACCA | 20 | 2866 |
| myoC-3112 | + | UCUGAGGAAACACUGUCCCC | 20 | 2867 |
| myoC-3113 | + | ACCAGAAAGAAAACCGAGUC | 20 | 2868 |
| myoC-3114 | + | AGGUCUCCCGACUUCCCUUG | 20 | 2869 |
| myoC-2264 | + | UUUUCUUCCUGUUAAAAGAA | 20 | 2345 |
| myoC-3116 | + | UCAGAUAGUAAACAUCGCUG | 20 | 2870 |
| myoC-3117 | + | GCUCUAAAGAUUCUAUUCUU | 20 | 2871 |
| myoC-3118 | + | UGGAGAAACACAGUUUGCUC | 20 | 2872 |
| myoC-3119 | + | UAACUUUAAGCCACUUGAAA | 20 | 2873 |
| myoC-3120 | + | UGUAAUAUAGUAUAAAAUGU | 20 | 2874 |
| myoC-3121 | + | AGGAAACAAAUGAUAAUGAA | 20 | 2875 |
| myoC-3122 | + | AUGUUUUCAAAUAUAUAAAA | 20 | 2876 |
| myoC-3123 | + | GAGAGCAUUCCUAUAGAAGC | 20 | 2877 |
| myoC-3124 | + | UUACACCAGGACUACUGGUG | 20 | 2878 |
| myoC-3125 | + | GGGUUGCCUUCACGCUGCCA | 20 | 2879 |
| myoC-3126 | − | GUUCUGUGAACACUUCC | 17 | 2880 |
| myoC-2521 | − | GAGCAAGUGGAAAAUGC | 17 | 2512 |
| myoC-3128 | − | AGUGUAUGAGCAAGAAA | 17 | 2881 |
| myoC-2542 | − | GCAGUGGGAAUUGACCA | 17 | 2525 |
| myoC-3130 | − | UCAAGGGAAGUCGGGAG | 17 | 2882 |
| myoC-3131 | − | AGGUAGUAACUGAGGCU | 17 | 2883 |
| myoC-3132 | − | UCCUAAGAGUAAAGCCA | 17 | 2884 |
| myoC-3133 | − | CCUAGGUCUUGCUGACU | 17 | 2885 |
| myoC-3134 | − | UUUCAGCGAUGUUUACU | 17 | 2886 |
| myoC-2586 | − | GGUUUAUUAAUGUAAAG | 17 | 2553 |
| myoC-3136 | − | AGUGGUAAUAACAGUAC | 17 | 2887 |
| myoC-3137 | − | CUUUCUGAGAAGAGUUC | 17 | 2888 |
| myoC-3138 | − | CACACACACAGAGUAAG | 17 | 2889 |
| myoC-3139 | + | CCAGCUCAGAUGCACCA | 17 | 2890 |
| myoC-3140 | + | GAGGAAACACUGUCCCC | 17 | 2891 |
| myoC-3141 | + | AGAAAGAAAACCGAGUC | 17 | 2892 |
| myoC-3142 | + | UCUCCCGACUUCCCUUG | 17 | 2893 |
| myoC-2810 | + | UCUUCCUGUUAAAAGAA | 17 | 2725 |

TABLE 5F-continued

| gRNA Name | DNA Strand | Targeting Domain | Target Site Length | SEQ ID NO |
|---|---|---|---|---|
| myoC-3144 | + | GAUAGUAAACAUCGCUG | 17 | 2894 |
| myoC-3145 | + | CUAAAGAUUCUAUUCUU | 17 | 2895 |
| myoC-3146 | + | AGAAACACAGUUUGCUC | 17 | 2896 |
| myoC-3147 | + | CUUUAAGCCACUUGAAA | 17 | 2897 |
| myoC-3148 | + | AAUAUAGUAUAAAAUGU | 17 | 2898 |
| myoC-3149 | + | AAACAAAUGAUAAUGAA | 17 | 2899 |
| myoC-3150 | + | UUUUCAAAUAUAUAAAA | 17 | 2900 |
| myoC-3151 | + | AGCAUUCCUAUAGAAGC | 17 | 2901 |
| myoC-3152 | + | CACCAGGACUACUGGUG | 17 | 2902 |
| myoC-3153 | + | UUGCCUUCACGCUGCCA | 17 | 2903 |

Table 6A provides exemplary targeting domains for knocking out the MYOC gene selected according to the first tier parameters. The targeting domains bind within the first 500 bp of the coding sequence (e.g., within 500 bp downstream from the start codon), have a high level of orthogonality and start with a 5'G. It is contemplated herein that in an embodiment the targeting domain hybridizes to the target domain through complementary base pairing. Any of the targeting domains in the Table 1 can be used with a *S. pyogenes* Cas9 molecule that generates a double stranded break (Cas9 nuclease) or a single-stranded break (Cas9 nickase).

TABLE 6A

1st Tier

| gRNA Name | DNA Strand | Targeting Domain | Target Site Length | SEQ ID NO |
|---|---|---|---|---|
| myoC-163 | + | GUUAUGGAUGACUGACA | 17 | 496 |
| myoC-155 | + | GUCCCGCUCCCGCCUCA | 17 | 546 |
| myoC-167 | + | GCUGGAUUCAUUGGGAC | 17 | 497 |
| myoC-139 | - | GCGGGAGCGGGACCAGC | 17 | 534 |
| myoC-138 | - | GCACCCUGAGGCGGGAG | 17 | 533 |
| myoC-152 | + | GAACUGACUUGUCUCGG | 17 | 492 |
| myoC-157 | + | GGUCCAAGGUCAAUUGG | 17 | 493 |
| myoC-161 | + | GCUGAGUCGAGCUUUGG | 17 | 495 |
| myoC-166 | + | GGGCAGCUGGAUUCAUU | 17 | 553 |
| myoC-129 | - | GCACGUUGCUGCAGCUU | 17 | 488 |
| myoC-160 | + | GGAGCUGAGUCGAGCUU | 17 | 494 |
| myoC-126 | + | GCAGCUGGAUUCAUUGGGAC | 20 | 523 |
| myoC-107 | - | GAGGUUGGAAAGCAGCAGCC | 20 | 511 |
| myoC-113 | + | GCUGCUGCUUUCCAACCUCC | 20 | 515 |
| myoC-123 | + | GUCGAGCUUUGGUGGCCUCC | 20 | 485 |

TABLE 6A-continued

1st Tier

| gRNA Name | DNA Strand | Targeting Domain | Target Site Length | SEQ ID NO |
|---|---|---|---|---|
| myoC-105 | - | GAGGCGGGAGCGGGACCAGC | 20 | 510 |
| myoC-104 | - | GGGCACCCUGAGGCGGGAGC | 20 | 509 |
| myoC-117 | + | GCUGGUCCCGCUCCCGCCUC | 20 | 484 |
| myoC-125 | + | GACAUGGCCUGGCUCUGCUC | 20 | 522 |
| myoC-114 | + | GAACUGACUUGUCUCGGAGG | 20 | 482 |
| myoC-121 | + | GGUCCAAGGUCAAUUGGUGG | 20 | 520 |
| myoC-122 | + | GGAGCUGAGUCGAGCUUUGG | 20 | 521 |
| myoC-127 | + | GCAUCGGCCACUCUGGUCAU | 20 | 487 |
| myoC-106 | - | GGAAACCCAAACCAGAGAGU | 20 | 479 |
| myoC-95 | - | GCCUGCCUGGUGUGGGAUGU | 20 | 500 |
| myoC-115 | + | GUCUCGGAGGAGGUUGCUGU | 20 | 516 |
| myoC-93 | - | GCUUCUGGCCUGCCUGGUGU | 20 | 478 |
| myoC-124 | + | GGCCUCCAGGUCUAAGCGUU | 20 | 486 |
| myoC-91 | - | GUGCACGUUGCUGCAGCUUU | 20 | 477 |

Table 6B provides exemplary targeting domains for knocking out the MYOC gene selected according to the second tier parameters. The targeting domains bind within the first 500 bp of the coding sequence (e.g., within 500 bp downstream from the start codon) and have a high level of orthogonality. It is contemplated herein that in an embodiment the targeting domain hybridizes to the target domain through complementary base pairing. Any of the targeting domains in the Table 1 can be used with a *S. pyogenes* Cas9 molecule that generates a double stranded break (Cas9 nuclease) or a single-stranded break (Cas9 nickase).

TABLE 6B

2nd Tier

| gRNA Name | DNA Strand | Targeting Domain | Target Site Length | SEQ ID NO |
|---|---|---|---|---|
| myoC-271 | - | AAGAGAAGAAGCGACUA | 17 | 657 |
| myoC-303 | + | CCACACUGAAGGUAUAC | 17 | 689 |
| myoC-254 | - | CACCCAACGCUUAGACC | 17 | 640 |
| myoC-258 | - | CCAAUUGACCUUGGACC | 17 | 644 |
| myoC-256 | - | AGCUCGACUCAGCUCCC | 17 | 642 |
| myoC-305 | + | ACUGGCAUCGGCCACUC | 17 | 691 |
| myoC-2902 | + | CUUGGUGAGGCUUCCUC | 17 | 2790 |
| myoC-269 | - | CCGAGACAAGUCAGUUC | 17 | 655 |
| myoC-296 | + | AGGUCAAUUGGUGGAGG | 17 | 682 |
| myoC-255 | - | CCAACGCUUAGACCUGG | 17 | 641 |
| myoC-270 | - | AGACAAGUCAGUUCUGG | 17 | 656 |

TABLE 6B-continued

| 2nd Tier | | | | |
|---|---|---|---|---|
| gRNA Name | DNA Strand | Targeting Domain | Target Site Length | SEQ ID NO |
| myoC-3158 | - | ACCAAGCCUCUGCAAUG | 17 | 2904 |
| myoC-252 | - | CCAGUAUACCUUCAGUG | 17 | 638 |
| myoC-294 | + | CCUGGUCCAAGGUCAAU | 17 | 680 |
| myoC-304 | + | UGAAGGUAUACUGGCAU | 17 | 690 |
| myoC-306 | + | UCGGCCACUCUGGUCAU | 17 | 692 |
| myoC-257 | - | CCUCCACCAAUUGACCU | 17 | 643 |
| myoC-281 | + | CCAGAACUGACUUGUCU | 17 | 667 |
| myoC-268 | - | AACCCAAACCAGAGAGU | 17 | 654 |
| myoC-297 | + | CCUCCAGGUCUAAGCGU | 17 | 683 |
| myoC-298 | + | CUCCAGGUCUAAGCGUU | 17 | 684 |
| myoC-227 | + | UAAGUUAUGGAUGACUGACA | 20 | 613 |
| myoC-213 | + | CUGGUCCCGCUCCCGCCUCA | 20 | 599 |
| myoC-233 | + | AUUGGGACUGGCCACACUGA | 20 | 619 |
| myoC-226 | + | UGCUGUCUCUCUGUAAGUUA | 20 | 612 |
| myoC-234 | + | UGGCCACACUGAAGGUAUAC | 20 | 620 |
| myoC-179 | - | CAGCACCCAACGCUUAGACC | 20 | 565 |
| myoC-183 | - | CCACCAAUUGACCUUGGACC | 20 | 569 |
| myoC-181 | - | CAAAGCUCGACUCAGCUCCC | 20 | 567 |
| myoC-228 | + | UAUGGAUGACUGACAUGGCC | 20 | 614 |
| myoC-222 | + | AUUGGUGGAGGAGGCUCUCC | 20 | 608 |
| myoC-212 | + | CUCUGGUUUGGGUUUCCAGC | 20 | 598 |
| myoC-239 | + | CCCCACAUCCCACACCAGGC | 20 | 625 |
| myoC-236 | + | UAUACUGGCAUCGGCCACUC | 20 | 622 |
| myoC-2356 | + | AGGCUUGGUGAGGCUUCCUC | 20 | 2410 |
| myoC-241 | + | AGCUGGACAGCUGGCAUCUC | 20 | 627 |
| myoC-170 | - | AGCUGUCCAGCUGCUGCUUC | 20 | 556 |
| myoC-191 | - | CCUCCGAGACAAGUCAGUUC | 20 | 577 |
| myoC-3159 | + | ACAGAAGAACCUCAUUGCAG | 20 | 2905 |
| myoC-190 | - | UGGGCACCCUGAGGCGGGAG | 20 | 576 |
| myoC-221 | + | CCAAGGUCAAUUGGUGGAGG | 20 | 607 |
| myoC-209 | + | CCAGAACUGACUUGUCUCGG | 20 | 595 |
| myoC-180 | - | CACCCAACGCUUAGACCUGG | 20 | 566 |
| myoC-192 | - | CCGAGACAAGUCAGUUCUGG | 20 | 578 |
| myoC-220 | + | CCUGGUCCAAGGUCAAUUGG | 20 | 606 |
| myoC-3160 | - | CUCACCAAGCCUCUGCAAUG | 20 | 2906 |
| myoC-177 | - | AUGCCAGUAUACCUUCAGUG | 20 | 563 |
| myoC-3161 | + | CUCAUUGCAGAGGCUUGGUG | 20 | 2907 |

TABLE 6B-continued

| 2nd Tier | | | | |
|---|---|---|---|---|
| gRNA Name | DNA Strand | Targeting Domain | Target Site Length | SEQ ID NO |
| myoC-219 | + | CAGCCUGGUCCAAGGUCAAU | 20 | 605 |
| myoC-235 | + | CACUGAAGGUAUACUGGCAU | 20 | 621 |
| myoC-182 | - | CCUCCUCCACCAAUUGACCU | 20 | 568 |
| myoC-3162 | + | AGAACCUCAUUGCAGAGGCU | 20 | 2908 |
| myoC-208 | + | CCUCCAGAACUGACUUGUCU | 20 | 594 |
| myoC-225 | + | UGGCCUCCAGGUCUAAGCGU | 20 | 611 |
| myoC-197 | - | UGAGAAUCUGGCCAGGAGGU | 20 | 583 |
| myoC-232 | + | UCUGGGCAGCUGGAUUCAUU | 20 | 618 |
| myoC-169 | - | UGUGCACGUUGCUGCAGCUU | 20 | 555 |
| myoC-224 | + | CAGGGAGCUGAGUCGAGCUU | 20 | 610 |
| myoC-210 | + | CAGUCUCCAACUCUCUGGUU | 20 | 596 |

Table 6C provides exemplary targeting domains for knocking out the MYOC gene selected according to the third tier parameters. The targeting domains bind within the first 500 bp of the coding sequence (e.g., within 500 bp downstream from the start codon) and start with a 5'G. It is contemplated herein that in an embodiment the targeting domain hybridizes to the target domain through complementary base pairing. Any of the targeting domains in the Table 1 can be used with a *S. pyogenes* Cas9 molecule that generates a double stranded break (Cas9 nuclease) or a single-stranded break (Cas9 nickase).

TABLE 6C

| 3rd Tier | | | | |
|---|---|---|---|---|
| gRNA Name | DNA Strand | Targeting Domain | Target Site Length | SEQ ID NO |
| myoC-159 | + | GUGGAGGAGGCUCUCCA | 17 | 549 |
| myoC-132 | - | GACAGCUCAGCUCAGGA | 17 | 527 |
| myoC-168 | + | GGGACUGGCCACACUGA | 17 | 554 |
| myoC-142 | - | GUUGGAAAGCAGCAGCC | 17 | 537 |
| myoC-164 | + | GGAUGACUGACAUGGCC | 17 | 551 |
| myoC-130 | - | GCUGCUUCUGGCCUGCC | 17 | 525 |
| myoC-151 | + | GCUGCUUUCCAACCUCC | 17 | 543 |
| myoC-162 | + | GAGCUUUGGUGGCCUCC | 17 | 550 |
| myoC-158 | + | GGUGGAGGAGGCUCUCC | 17 | 548 |
| myoC-156 | + | GCCCCUCCUGGGUCUCC | 17 | 547 |
| myoC-165 | + | GCUCUGCUCUGGGCAGC | 17 | 552 |
| myoC-134 | - | GGGGCUGCAGAGGGAGC | 17 | 529 |
| myoC-137 | - | GCUGGGCACCCUGAGGC | 17 | 532 |
| myoC-140 | - | GCAAGAAAAUGAGAAUC | 17 | 535 |

TABLE 6C-continued

| 3rd Tier | | | | |
|---|---|---|---|---|
| gRNA Name | DNA Strand | Targeting Domain | Target Site Length | SEQ ID NO |
| myoC-154 | + | GGUCCCGCUCCCGCCUC | 17 | 545 |
| myoC-153 | + | GGCAGUCUCCAACUCUC | 17 | 544 |
| myoC-3163 | + | GAAGAACCUCAUUGCAG | 17 | 2909 |
| myoC-133 | - | GCCCCAGGAGACCCAGG | 17 | 528 |
| myoC-143 | - | GGAAAGCAGCAGCCAGG | 17 | 538 |
| myoC-136 | - | GGGAGCUGGGCACCCUG | 17 | 531 |
| myoC-131 | - | GCCUGGUGUGGGAUGUG | 17 | 526 |
| myoC-135 | - | GGGCUGCAGAGGGAGCU | 17 | 530 |
| myoC-141 | - | GAAUCUGGCCAGGAGGU | 17 | 536 |
| myoC-120 | + | GGGCCUGGCAGCCUGGUCCA | 20 | 519 |
| myoC-99 | - | GACCCAGGAGGGGCUGCAGA | 20 | 504 |
| myoC-97 | - | GGACCAGGCUGCCAGGCCCC | 20 | 502 |
| myoC-92 | - | GCUGCUGCUUCUGGCCUGCC | 20 | 498 |
| myoC-118 | + | GCUCCCUCUGCAGCCCCUCC | 20 | 517 |
| myoC-119 | + | GCAGCCCCUCCUGGGUCUCC | 20 | 518 |
| myoC-128 | + | GGCAGGCCAGAAGCAGCAGC | 20 | 524 |
| myoC-100 | - | GGAGGGGCUGCAGAGGGAGC | 20 | 505 |
| myoC-103 | - | GGAGCUGGGCACCCUGAGGC | 20 | 508 |
| myoC-96 | - | GGGCCAGGACAGCUCAGCUC | 20 | 501 |
| myoC-116 | + | GUAGGCAGUCUCCAACUCUC | 20 | 483 |
| myoC-98 | - | GGCCCCAGGAGACCCAGGAG | 20 | 503 |
| myoC-108 | - | GUUGGAAAGCAGCAGCCAGG | 20 | 480 |
| myoC-102 | - | GGGAGCUGGGCACCCUGAGG | 20 | 507 |
| myoC-94 | - | GGCCUGCCUGGUGUGGGAUG | 20 | 499 |
| myoC-101 | - | GAGGGGCUGCAGAGGGAGCU | 20 | 506 |

Table 6D provides exemplary targeting domains for knocking out the MYOC gene selected according to the fourth tier parameters. The targeting domains bind within the first 500 bp of the coding sequence (e.g., within 500 bp downstream from the start codon). It is contemplated herein that in an embodiment the targeting domain hybridizes to the target domain through complementary base pairing. Any of the targeting domains in the Table 1 can be used with a *S. pyogenes* Cas9 molecule that generates a double stranded break (Cas9 nuclease) or a single-stranded break (Cas9 nickase).

TABLE 6D

| 4th Tier | | | | |
|---|---|---|---|---|
| gRNA Name | DNA Strand | Targeting Domain | Target Site Length | SEQ ID NO |
| myoC-293 | + | CCUGGCAGCCUGGUCCA | 17 | 679 |
| myoC-265 | - | CCAGGAGGGGCUGCAGA | 17 | 651 |
| myoC-262 | - | CCCCAGGAGACCCAGGA | 17 | 648 |
| myoC-299 | + | UGUCUCUCUGUAAGUUA | 17 | 685 |
| myoC-308 | + | CCCCCACAUCCCACACC | 17 | 694 |
| myoC-261 | - | CAGGCCCCAGGAGACCC | 17 | 647 |
| myoC-260 | - | CCAGGCUGCCAGGCCCC | 17 | 646 |
| myoC-292 | + | CCUGGGGCCUGGCAGCC | 17 | 678 |
| myoC-253 | - | CUGCCCAGAGCAGAGCC | 17 | 639 |
| myoC-249 | - | UGUGGGAUGUGGGGGCC | 17 | 635 |
| myoC-291 | + | CUGGGUCUCCUGGGGCC | 17 | 677 |
| myoC-272 | - | AAAAUGAGAAUCUGGCC | 17 | 658 |
| myoC-259 | - | CCUUGGACCAGGCUGCC | 17 | 645 |
| myoC-287 | + | CCCUCUGCAGCCCCUCC | 17 | 673 |
| myoC-307 | + | CCUGAGCUGAGCUGUCC | 17 | 693 |
| myoC-311 | + | AGCAGCAGCUGGACAGC | 17 | 697 |
| myoC-286 | + | UGGUUUGGGUUUCCAGC | 17 | 672 |
| myoC-310 | + | AGGCCAGAAGCAGCAGC | 17 | 696 |
| myoC-267 | - | CACCCUGAGGCGGGAGC | 17 | 653 |
| myoC-309 | + | CACAUCCCACACCAGGC | 17 | 695 |
| myoC-250 | - | CCAGGACAGCUCAGCUC | 17 | 636 |
| myoC-300 | + | AUGGCCUGGCUCUGCUC | 17 | 686 |
| myoC-312 | + | UGGACAGCUGGCAUCUC | 17 | 698 |
| myoC-243 | - | UGUCCAGCUGCUGCUUC | 17 | 629 |
| myoC-264 | - | CCCAGGAGGGGCUGCAG | 17 | 650 |
| myoC-251 | - | AAGGCCAAUGACCAGAG | 17 | 637 |
| myoC-263 | - | CCCAGGAGACCCAGGAG | 17 | 649 |
| myoC-273 | - | AUGAGAAUCUGGCCAGG | 17 | 659 |
| myoC-282 | + | CUGACUUGUCUCGGAGG | 17 | 668 |
| myoC-266 | - | AGCUGGGCACCCUGAGG | 17 | 652 |
| myoC-295 | + | CCAAGGUCAAUUGGUGG | 17 | 681 |
| myoC-248 | - | CCUGGUGUGGGAUGUGG | 17 | 634 |
| myoC-246 | - | CUGCCUGGUGUGGGAUG | 17 | 632 |
| myoC-290 | + | CCCUCCUGGGUCUCCUG | 17 | 676 |
| myoC-244 | - | UUCUGGCCUGCCUGGUG | 17 | 630 |
| myoC-3164 | + | AUUGCAGAGGCUUGGUG | 17 | 2910 |
| myoC-302 | + | UGGGCAGCUGGAUUCAU | 17 | 688 |

TABLE 6D-continued

4th Tier

| gRNA Name | DNA Strand | Targeting Domain | Target Site Length | SEQ ID NO |
|---|---|---|---|---|
| myoC-288 | + | CCUCUGCAGCCCCUCCU | 17 | 674 |
| myoC-289 | + | CCCCUCCUGGGUCUCCU | 17 | 675 |
| myoC-3165 | + | ACCUCAUUGCAGAGGCU | 17 | 2911 |
| myoC-301 | + | UGGCCUGGCUCUGCUCU | 17 | 687 |
| myoC-247 | - | UGCCUGGUGUGGGAUGU | 17 | 633 |
| myoC-283 | + | UCGGAGGAGGUUGCUGU | 17 | 669 |
| myoC-245 | - | UCUGGCCUGCCUGGUGU | 17 | 631 |
| myoC-284 | + | UCUCCAACUCUCUGGUU | 17 | 670 |
| myoC-242 | - | CACGUUGCUGCAGCUUU | 17 | 628 |
| myoC-285 | + | CUCCAACUCUCUGGUUU | 17 | 671 |
| myoC-223 | + | UUGGUGGAGGAGGCUCUCCA | 20 | 609 |
| myoC-187 | - | AGGCCCCAGGAGACCCAGGA | 20 | 573 |
| myoC-175 | - | CAGGACAGCUCAGCUCAGGA | 20 | 561 |
| myoC-193 | - | AGGAAGAGAAGAAGCGACUA | 20 | 579 |
| myoC-238 | + | UGGCCCCCACAUCCCACACC | 20 | 624 |
| myoC-185 | - | UGCCAGGCCCCAGGAGACCC | 20 | 571 |
| myoC-218 | + | UCUCCUGGGGCCUGGCAGCC | 20 | 604 |
| myoC-178 | - | CAGCUGCCCAGAGCAGAGCC | 20 | 564 |
| myoC-174 | - | UGGUGUGGGAUGUGGGGGCC | 20 | 560 |
| myoC-217 | + | CUCCUGGGUCUCCUGGGGCC | 20 | 603 |
| myoC-195 | - | AAGAAAAUGAGAAUCUGGCC | 20 | 581 |
| myoC-184 | - | UGACCUUGGACCAGGCUGCC | 20 | 570 |
| myoC-237 | + | CUUCCUGAGCUGAGCUGUCC | 20 | 623 |
| myoC-240 | + | AGAAGCAGCAGCUGGACAGC | 20 | 626 |
| myoC-230 | + | CUGGCUCUGCUCUGGGCAGC | 20 | 616 |
| myoC-194 | - | AAGGCAAGAAAAUGAGAAUC | 20 | 580 |
| myoC-188 | - | AGACCCAGGAGGGGCUGCAG | 20 | 574 |
| myoC-176 | - | AGGAAGGCCAAUGACCAGAG | 20 | 562 |
| myoC-186 | - | CAGGCCCCAGGAGACCCAGG | 20 | 572 |
| myoC-196 | - | AAAAUGAGAAUCUGGCCAGG | 20 | 582 |
| myoC-173 | - | CUGCCUGGUGUGGGAUGUGG | 20 | 559 |
| myoC-189 | - | AGAGGGAGCUGGGCACCCUG | 20 | 575 |
| myoC-216 | + | AGCCCCUCCUGGGUCUCCUG | 20 | 602 |
| myoC-171 | - | UGCUUCUGGCCUGCCUGGUG | 20 | 557 |
| myoC-172 | - | CCUGCCUGGUGUGGGAUGUG | 20 | 558 |
| myoC-231 | + | CUCUGGGCAGCUGGAUUCAU | 20 | 617 |
| myoC-214 | + | CUCCCUCUGCAGCCCCUCCU | 20 | 600 |
| myoC-215 | + | CAGCCCCUCCUGGGUCUCCU | 20 | 601 |
| myoC-229 | + | ACAUGGCCUGGCUCUGCUCU | 20 | 615 |
| myoC-211 | + | AGUCUCCAACUCUCUGGUUU | 20 | 597 |

Table 6E provides exemplary targeting domains for knocking out the MYOC gene selected according to the fifth tier parameters. The targeting domains fall in the coding sequence of the gene, downstream of the first 500 bp of coding sequence (e.g., anywhere from +500 (relative to the start codon) to the stop codon of the gene). It is contemplated herein that in an embodiment the targeting domain hybridizes to the target domain through complementary base pairing. Any of the targeting domains in the Table 1 can be used with a *S. pyogenes* Cas9 molecule that generates a double stranded break (Cas9 nuclease) or a single-stranded break (Cas9 nickase).

TABLE 6E

5th Tier

| gRNA Name | DNA Strand | Targeting Domain | Target Site Length | SEQ ID NO |
|---|---|---|---|---|
| myoC-663 | + | UUAUUUCACAAUGUAAA | 17 | 963 |
| myoC-610 | + | CAGUUUGGAGAGGACAA | 17 | 918 |
| myoC-43 | - | AGCACCGAUGAGGCCAA | 17 | 433 |
| myoC-668 | + | GUAACAUGCAAGAGCAA | 17 | 968 |
| myoC-567 | - | CCAAGCUGUACAGGCAA | 17 | 888 |
| myoC-145 | - | GGUAGCAAGGCUGAGAA | 17 | 540 |
| myoC-626 | + | GUAUGUGAACCUUAGAA | 17 | 926 |
| myoC-578 | - | GGGGGGAGCAGGCUGAA | 17 | 899 |
| myoC-85 | + | UUAUAGCGGUUCUUGAA | 17 | 473 |
| myoC-670 | + | AUGCUGACAGAAGAUAA | 17 | 970 |
| myoC-657 | - | AAAAGCAUAACUUCUAA | 17 | 957 |
| myoC-662 | + | UUUAUUUCACAAUGUAA | 17 | 962 |
| myoC-646 | - | AUCCAGAAGGAUGAACA | 17 | 946 |
| myoC-77 | - | CUGGGACAACUUGAACA | 17 | 466 |
| myoC-36 | - | UUCUUGGGGUGGCUACA | 17 | 429 |
| myoC-601 | + | GCUGCUGACGGUGUACA | 17 | 909 |
| myoC-656 | - | UGCUCUUGCAUGUUACA | 17 | 956 |
| myoC-31 | - | CCUGGAGCUGGCUACCA | 17 | 425 |
| myoC-580 | - | GGAGAGCCAGCCAGCCA | 17 | 901 |
| myoC-50 | + | CGUGGUAGCCAGCUCCA | 17 | 397 |
| myoC-81 | + | AAAGAGCUUCUUCUCCA | 17 | 469 |
| myoC-538 | - | GGGAGCCUCUAUUUCCA | 17 | 880 |

TABLE 6E-continued

| 5th Tier | | | | |
|---|---|---|---|---|
| gRNA Name | DNA Strand | Targeting Domain | Target Site Length | SEQ ID NO |
| myoC-531 | - | UAGGCCACUGGAAAGCA | 17 | 873 |
| myoC-144 | - | GCAGCCAGGAGGUAGCA | 17 | 539 |
| myoC-524 | - | AAUCGACACAGUUGGCA | 17 | 866 |
| myoC-527 | - | AUCAGCCAGUUUAUGCA | 17 | 869 |
| myoC-570 | - | GCAGAAGGAGAUGCUCA | 17 | 891 |
| myoC-89 | + | CUUGAAUGGGAUGGUCA | 17 | 476 |
| myoC-3166 | + | GAUUCCCACAAAGUUCA | 17 | 2912 |
| myoC-345 | + | CUCCUGAGAUAGCCAGA | 17 | 731 |
| myoC-645 | - | GUUUUCAUUAAUCCAGA | 17 | 945 |
| myoC-568 | - | GUACAGGCAAUGGCAGA | 17 | 889 |
| myoC-3167 | - | CCACCAGGCUCCAGAGA | 17 | 2913 |
| myoC-342 | - | UAUCUCAGGAGUGGAGA | 17 | 728 |
| myoC-274 | - | AGGUAGCAAGGCUGAGA | 17 | 660 |
| myoC-28 | - | GACAGUGAAGGCUGAGA | 17 | 401 |
| myoC-625 | + | AGUAUGUGAACCUUAGA | 17 | 925 |
| myoC-671 | + | AUUCCUGAAUAGUUAGA | 17 | 971 |
| myoC-87 | + | GCGGUUCUUGAAUGGGA | 17 | 446 |
| myoC-352 | + | GGACUUCAGUUCCUGGA | 17 | 738 |
| myoC-602 | + | GGUGCCACAGAUGAUGA | 17 | 910 |
| myoC-577 | - | UGGGGGGAGCAGGCUGA | 17 | 898 |
| myoC-600 | + | UGAGGUGUAGCUGCUGA | 17 | 908 |
| myoC-649 | - | CAGGAAUUGUAGUCUGA | 17 | 949 |
| myoC-27 | - | GAAUACCGAGACAGUGA | 17 | 392 |
| myoC-90 | + | GUCAUAAGCAAAGUUGA | 17 | 447 |
| myoC-337 | - | UGCUUCCCGAAUUUUGA | 17 | 723 |
| myoC-46 | + | UAGCCACCCCAAGAAUA | 17 | 395 |
| myoC-528 | - | GCAGGGCUACCCUUCUA | 17 | 870 |
| myoC-519 | - | ACAAUUACUGGCAAGUA | 17 | 861 |
| myoC-655 | - | UUGGGGCAAAAGCUGUA | 17 | 955 |
| myoC-635 | + | GUGGUCUCCUGGGUGUA | 17 | 935 |
| myoC-604 | + | UGGCGACUGACUGCUUA | 17 | 912 |
| myoC-650 | - | UCUUCUGUCAGCAUUUA | 17 | 950 |
| myoC-627 | + | GGUAGCCCUGCAUAAAC | 17 | 927 |
| myoC-343 | - | AGUGGAGAGGGAGACAC | 17 | 729 |
| myoC-279 | + | CUCGGGUCUGGGGACAC | 17 | 665 |
| myoC-72 | - | AACUUUGCUUAUGACAC | 17 | 464 |
| myoC-530 | - | CAUACUGCCUAGGCCAC | 17 | 872 |

TABLE 6E-continued

| 5th Tier | | | | |
|---|---|---|---|---|
| gRNA Name | DNA Strand | Targeting Domain | Target Site Length | SEQ ID NO |
| myoC-532 | - | AGGCCACUGGAAAGCAC | 17 | 874 |
| myoC-73 | - | GCUUAUGACACAGGCAC | 17 | 451 |
| myoC-47 | + | AGCCACCCCAAGAAUAC | 17 | 435 |
| myoC-344 | + | GAAACUUAACUUCAUAC | 17 | 730 |
| myoC-566 | - | AAGCCUCCAAGCUGUAC | 17 | 887 |
| myoC-518 | - | ACAGCAGAAACAAUUAC | 17 | 860 |
| myoC-629 | + | GGUCAUACUCAAAAACC | 17 | 929 |
| myoC-557 | - | UGGAACUCGAACAAACC | 17 | 883 |
| myoC-148 | - | GCUCGGGCUGUGCCACC | 17 | 490 |
| myoC-3168 | - | UCUUUUCUGAAUUUACC | 17 | 2914 |
| myoC-521 | - | CACCUACCCCUACACCC | 17 | 863 |
| myoC-562 | - | GAUUGACUACAACCCCC | 17 | 886 |
| myoC-583 | + | UUCAGCCUGCUCCCCCC | 17 | 904 |
| myoC-621 | + | UUCUGGACUCAGCGCCC | 17 | 921 |
| myoC-581 | - | CCAGCCAGCCAGGGCCC | 17 | 902 |
| myoC-1590 | + | CAAAGCUGCCUGGGCCC | 17 | 1805 |
| myoC-29 | - | GCUGAGAAGGAAAUCCC | 17 | 423 |
| myoC-605 | + | ACGGAUGUUUGUCUCCC | 17 | 913 |
| myoC-79 | + | CAUGUUCAAGUUGUCCC | 17 | 467 |
| myoC-579 | - | GGGAGAGCCAGCCAGCC | 17 | 900 |
| myoC-142 | - | GUUGGAAAGCAGCAGCC | 17 | 537 |
| myoC-3169 | + | UUACCUUCUCUGGAGCC | 17 | 2915 |
| myoC-525 | - | UGGCACGGAUGUCCGCC | 17 | 867 |
| myoC-674 | + | AAGCAGUCAAAGCUGCC | 17 | 974 |
| myoC-75 | - | AGAAGAAGCUCUUUGCC | 17 | 465 |
| myoC-644 | + | ACUAGUUCUCCACAUCC | 17 | 944 |
| myoC-280 | + | UCAGCCUUGCUACCUCC | 17 | 666 |
| myoC-49 | + | CCGUGGUAGCCAGCUCC | 17 | 436 |
| myoC-571 | - | GAGAUGCUCAGGGCUCC | 17 | 892 |
| myoC-632 | + | UUCUCCACGUGGUCUCC | 17 | 932 |
| myoC-80 | + | CAAAGAGCUUCUUCUCC | 17 | 468 |
| myoC-336 | - | GGACACUUUGGCCUUCC | 17 | 722 |
| myoC-351 | + | GCUCGGACUUCAGUUCC | 17 | 737 |
| myoC-537 | - | GGGGAGCCUCUAUUUCC | 17 | 879 |
| myoC-349 | + | UUCAAAAUUCGGGAAGC | 17 | 735 |
| myoC-39 | - | UUGGCUGUGGAUGAAGC | 17 | 430 |
| myoC-576 | - | GGGCUCCUGGGGGGAGC | 17 | 897 |

TABLE 6E-continued

5th Tier

| gRNA Name | DNA Strand | Targeting Domain | Target Site Length | SEQ ID NO |
|---|---|---|---|---|
| myoC-30 | - | AAGGAAAUCCCUGGAGC | 17 | 424 |
| myoC-1591 | + | GCUGCCUGGGCCCUGGC | 17 | 1801 |
| myoC-582 | + | CCUGGGCCCUGGCUGGC | 17 | 903 |
| myoC-664 | + | UUACUUAUAUUCGAUGC | 17 | 964 |
| myoC-526 | - | CAUCAGCCAGUUUAUGC | 17 | 868 |
| myoC-556 | - | ACUGAACCCAGAGAAUC | 17 | 882 |
| myoC-338 | - | UUGAAGGAGAGCCCAUC | 17 | 724 |
| myoC-535 | - | GGUGCUGUGGUGUACUC | 17 | 877 |
| myoC-40 | - | UGGAUGAAGCAGGCCUC | 17 | 431 |
| myoC-658 | - | AAGCAGAAUAGCUCCUC | 17 | 958 |
| myoC-569 | - | GGCAGAAGGAGAUGCUC | 17 | 890 |
| myoC-147 | - | GACCCGAGACACUGCUC | 17 | 489 |
| myoC-339 | - | GCCCAUCUGGCUAUCUC | 17 | 725 |
| myoC-277 | + | AGCCCGAGCAGUGUCUC | 17 | 663 |
| myoC-606 | + | UCGAGUUCCAGAUUCUC | 17 | 914 |
| myoC-3170 | + | UGCAUUCUUACCUUCUC | 17 | 2916 |
| myoC-149 | + | GAGCAGUGUCUCGGGUC | 17 | 491 |
| myoC-88 | + | UCUUGAAUGGGAUGGUC | 17 | 475 |
| myoC-348 | + | GCUCUCCUUCAAAAUUC | 17 | 734 |
| myoC-647 | - | UCACCAUCUAACUAUUC | 17 | 947 |
| myoC-672 | + | GACCAUGUUCAUCCUUC | 17 | 972 |
| myoC-52 | + | AUAUCUUAUGACAGUUC | 17 | 438 |
| myoC-669 | + | CAAGAGCAAUGGUUUUC | 17 | 969 |
| myoC-146 | - | GUAGCAAGGCUGAGAAG | 17 | 541 |
| myoC-45 | + | UGCUGUAAAUGACCCAG | 17 | 434 |
| myoC-665 | + | UAUUCGAUGCUGGCCAG | 17 | 965 |
| myoC-82 | + | AAGAGCUUCUUCUCCAG | 17 | 470 |
| myoC-623 | + | GCACCCGUGCUUUCCAG | 17 | 923 |
| myoC-3171 | - | AAGGUAAGAAUGCAGAG | 17 | 2917 |
| myoC-340 | - | UCUGGCUAUCUCAGGAG | 17 | 726 |
| myoC-341 | - | CUAUCUCAGGAGUGGAG | 17 | 727 |
| myoC-609 | + | CUGGGUUCAGUUUGGAG | 17 | 917 |
| myoC-643 | + | GCUGUUCUCAGCGUGAG | 17 | 943 |
| myoC-622 | + | CAGCGCCCUGGAAAUAG | 17 | 922 |
| myoC-84 | + | UGCUGCUGUACUUAUAG | 17 | 472 |
| myoC-636 | + | UGGUCUCCUGGGUGUAG | 17 | 936 |
| myoC-522 | - | ACACCCAGGAGACCACG | 17 | 864 |
| myoC-631 | + | UGUGUCGAUUCUCCACG | 17 | 931 |
| myoC-333 | - | UUAAUGCAGUUUCUACG | 17 | 719 |
| myoC-616 | + | AAUACGGGAACUGUCCG | 17 | 920 |
| myoC-536 | - | GUGCUGUGGUGUACUCG | 17 | 878 |
| myoC-143 | - | GGAAAGCAGCAGCCAGG | 17 | 538 |
| myoC-83 | + | AGAGCUUCUUCUCCAGG | 17 | 471 |
| myoC-638 | + | CUGGGUGUAGGGGUAGG | 17 | 938 |
| myoC-35 | - | UUCCCGUAUUCUUGGGG | 17 | 428 |
| myoC-575 | - | UGCUCAGGGCUCCUGGG | 17 | 896 |
| myoC-3172 | - | UAAGAAUGCAGAGUGGG | 17 | 2918 |
| myoC-630 | + | CAUACUCAAAAACCUGG | 17 | 930 |
| myoC-3173 | + | CCUUCUCUGGAGCCUGG | 17 | 2919 |
| myoC-574 | - | AUGCUCAGGGCUCCUGG | 17 | 895 |
| myoC-3174 | - | GUAAGAAUGCAGAGUGG | 17 | 2920 |
| myoC-585 | + | UUGCCUGUACAGCUUGG | 17 | 906 |
| myoC-42 | - | CAUUUACAGCACCGAUG | 17 | 432 |
| myoC-514 | - | CUGAAUUUACCAGGAUG | 17 | 856 |
| myoC-628 | + | GCAUAAACUGGCUGAUG | 17 | 928 |
| myoC-573 | - | GAUGCUCAGGGCUCCUG | 17 | 894 |
| myoC-38 | - | GGACAUUGACUUGGCUG | 17 | 402 |
| myoC-599 | + | GACGGUAGCAUCUGCUG | 17 | 907 |
| myoC-533 | - | GGAAAGCACGGGUGCUG | 17 | 875 |
| myoC-559 | - | AAUGCCUUCAUCAUCUG | 17 | 885 |
| myoC-648 | - | UCAGGAAUUGUAGUCUG | 17 | 948 |
| myoC-150 | + | GCAGUGUCUCGGGUCUG | 17 | 542 |
| myoC-3175 | - | GGUAAGAAUGCAGAGUG | 17 | 2921 |
| myoC-520 | - | CUGGCAAGUAUGGUGUG | 17 | 862 |
| myoC-666 | + | AGUUAUGCUUUUUAUUG | 17 | 966 |
| myoC-642 | + | AGGGGUAGGUGGGCUUG | 17 | 942 |
| myoC-667 | + | CUUUUUAUUGUGGCUUG | 17 | 967 |
| myoC-34 | - | CAGUUCCCGUAUUCUUG | 17 | 427 |
| myoC-654 | - | AGUUUUCUUGUGAUUUG | 17 | 954 |
| myoC-3176 | - | CUCUUCCUUGAACUUUG | 17 | 2922 |
| myoC-86 | + | UAUAGCGGUUCUUGAAU | 17 | 474 |
| myoC-603 | + | ACAGAUGAUGAAGGCAU | 17 | 911 |
| myoC-44 | + | GGCACCUUUGGCCUCAU | 17 | 404 |
| myoC-346 | + | UCCUGAGAUAGCCAGAU | 17 | 732 |

TABLE 6E-continued

5th Tier

| gRNA Name | DNA Strand | Targeting Domain | Target Site Length | SEQ ID NO |
|---|---|---|---|---|
| myoC-651 | − | CUUCUGUCAGCAUUUAU | 17 | 951 |
| myoC-673 | + | CUGGAUUAAUGAAAACU | 17 | 973 |
| myoC-37 | − | CUACACGGACAUUGACU | 17 | 394 |
| myoC-534 | − | GGGUGCUGUGGUGUACU | 17 | 876 |
| myoC-558 | − | GGAACUCGAACAAACCU | 17 | 884 |
| myoC-624 | + | GUGCUUUCCAGUGGCCU | 17 | 924 |
| myoC-529 | − | AGGUUCACAUACUGCCU | 17 | 871 |
| myoC-675 | + | AGCAGUCAAAGCUGCCU | 17 | 975 |
| myoC-76 | − | GAAGAAGCUCUUUGCCU | 17 | 452 |
| myoC-572 | − | AGAUGCUCAGGGCUCCU | 17 | 893 |
| myoC-633 | + | UCUCCACGUGGUCUCCU | 17 | 933 |
| myoC-584 | + | CCAUUGCCUGUACAGCU | 17 | 905 |
| myoC-350 | + | AGGAACUUCAGUUAGCU | 17 | 736 |
| myoC-640 | + | GUAGGGGUAGGUGGGCU | 17 | 940 |
| myoC-275 | − | AGACCCGAGACACUGCU | 17 | 661 |
| myoC-78 | + | GGAGGCUUUUCACAUCU | 17 | 445 |
| myoC-41 | − | GGAUGAAGCAGGCCUCU | 17 | 403 |
| myoC-607 | + | CGAGUUCCAGAUUCUCU | 17 | 915 |
| myoC-278 | + | AGCAGUGUCUCGGGUCU | 17 | 664 |
| myoC-51 | + | CUCAGCCUUCACUGUCU | 17 | 437 |
| myoC-276 | + | CAGCCCGAGCAGUGUCU | 17 | 662 |
| myoC-544 | − | GACAGUUCCCGUAUUCU | 17 | 881 |
| myoC-523 | − | UGGAGAAUCGACACAGU | 17 | 865 |
| myoC-660 | − | UUCAGAUAGAAUACAGU | 17 | 960 |
| myoC-659 | − | GAUGCAUUUACUACAGU | 17 | 959 |
| myoC-3177 | − | AGGUAAGAAUGCAGAGU | 17 | 2923 |
| myoC-3178 | + | UUCAAGGAAGAGAACGU | 17 | 2924 |
| myoC-639 | + | UGGGUGUAGGGGUAGGU | 17 | 939 |
| myoC-637 | + | CUCCUGGGUGUAGGGGU | 17 | 937 |
| myoC-517 | − | GGAGAACUAGUUUGGGU | 17 | 859 |
| myoC-634 | + | CGUGGUCUCCUGGGUGU | 17 | 934 |
| myoC-3179 | − | UCUUCCUUGAACUUUGU | 17 | 2925 |
| myoC-347 | + | GGCUCUCCUUCAAAAUU | 17 | 733 |
| myoC-334 | − | AGUUUCUACGUGGAAUU | 17 | 720 |
| myoC-652 | − | CAAGUUUUCUUGUGAUU | 17 | 952 |
| myoC-335 | − | GUGGAAUUUGGACACUU | 17 | 721 |
| myoC-611 | + | GAGGACAAUGGCACCUU | 17 | 919 |

TABLE 6E-continued

5th Tier

| gRNA Name | DNA Strand | Targeting Domain | Target Site Length | SEQ ID NO |
|---|---|---|---|---|
| myoC-641 | + | UAGGGGUAGGUGGGCUU | 17 | 941 |
| myoC-33 | − | ACAGUUCCCGUAUUCUU | 17 | 426 |
| myoC-661 | − | UCAGAUAGAAUACAGUU | 17 | 961 |
| myoC-608 | + | AUUCUCUGGGUUCAGUU | 17 | 916 |
| myoC-515 | − | GAUGUGGAGAACUAGUU | 17 | 857 |
| myoC-3180 | + | UCAAGGAAGAGAACGUU | 17 | 2926 |
| myoC-653 | − | AAGUUUUCUUGUGAUUU | 17 | 953 |
| myoC-516 | − | AUGUGGAGAACUAGUUU | 17 | 858 |
| myoC-501 | + | AUUUUAUUUCACAAUGUAAA | 20 | 843 |
| myoC-448 | + | GUUCAGUUUGGAGAGGACAA | 20 | 799 |
| myoC-17 | − | UACAGCACCGAUGAGGCCAA | 20 | 415 |
| myoC-506 | + | CAUGUAACAUGCAAGAGCAA | 20 | 848 |
| myoC-406 | − | CCUCCAAGCUGUACAGGCAA | 20 | 770 |
| myoC-110 | − | GGAGGUAGCAAGGCUGAGAA | 20 | 513 |
| myoC-464 | + | GCAGUAUGUGAACCUUAGAA | 20 | 806 |
| myoC-417 | − | CCUGGGGGGAGCAGGCUGAA | 20 | 781 |
| myoC-66 | + | UACUUAUAGCGGUUCUUGAA | 20 | 461 |
| myoC-508 | + | UAAAUGCUGACAGAAGAUAA | 20 | 850 |
| myoC-495 | − | AUAAAAAGCAUAACUUCUAA | 20 | 837 |
| myoC-500 | + | AAUUUUAUUUCACAAUGUAA | 20 | 842 |
| myoC-484 | − | UUAAUCCAGAAGGAUGAACA | 20 | 826 |
| myoC-58 | − | UGCCUGGGACAACUUGAACA | 20 | 456 |
| myoC-10 | − | GUAUUCUUGGGGUGGCUACA | 20 | 388 |
| myoC-439 | + | GUAGCUGCUGACGGUGUACA | 20 | 790 |
| myoC-494 | − | CAUUGCUCUUGCAUGUUACA | 20 | 836 |
| myoC-5 | − | AUCCCUGGAGCUGGCUACCA | 20 | 407 |
| myoC-419 | − | AAGGGAGAGCCAGCCAGCCA | 20 | 783 |
| myoC-24 | + | GUCCGUGGUAGCCAGCUCCA | 20 | 391 |
| myoC-62 | + | GGCAAAGAGCUUCUUCUCCA | 20 | 448 |
| myoC-377 | − | UCGGGGAGCCUCUAUUUCCA | 20 | 763 |
| myoC-370 | − | GCCUAGGCCACUGGAAAGCA | 20 | 756 |
| myoC-109 | − | GCAGCAGCCAGGAGGUAGCA | 20 | 512 |
| myoC-363 | − | GAGAAUCGACACAGUUGGCA | 20 | 749 |
| myoC-366 | − | CUCAUCAGCCAGUUUAUGCA | 20 | 752 |
| myoC-409 | − | AUGGCAGAAGGAGAUGCUCA | 20 | 773 |
| myoC-70 | + | GUUCUUGAAUGGGAUGGUCA | 20 | 450 |
| myoC-325 | + | CCACUCCUGAGAUAGCCAGA | 20 | 711 |

TABLE 6E-continued

| 5th Tier | | | | |
|---|---|---|---|---|
| gRNA Name | DNA Strand | Targeting Domain | Target Site Length | SEQ ID NO |
| myoC-483 | - | CAAGUUUUCAUUAAUCCAGA | 20 | 825 |
| myoC-407 | - | GCUGUACAGGCAAUGGCAGA | 20 | 771 |
| myoC-3181 | - | GUGCCACCAGGCUCCAGAGA | 20 | 2927 |
| myoC-322 | - | GGCUAUCUCAGGAGUGGAGA | 20 | 708 |
| myoC-198 | - | AGGAGGUAGCAAGGCUGAGA | 20 | 584 |
| myoC-2 | - | CGAGACAGUGAAGGCUGAGA | 20 | 405 |
| myoC-463 | + | GGCAGUAUGUGAACCUUAGA | 20 | 805 |
| myoC-509 | + | ACAAUUCCUGAAUAGUUAGA | 20 | 851 |
| myoC-68 | + | AUAGCGGUUCUUGAAUGGGA | 20 | 443 |
| myoC-332 | + | CUCGGACUUCAGUUCCUGGA | 20 | 718 |
| myoC-440 | + | CAAGGUGCCACAGAUGAUGA | 20 | 791 |
| myoC-416 | - | UCCUGGGGGGAGCAGGCUGA | 20 | 780 |
| myoC-438 | + | UGCUGAGGUGUAGCUGCUGA | 20 | 789 |
| myoC-487 | - | AUUCAGGAAUUGUAGUCUGA | 20 | 829 |
| myoC-1 | - | GCUGAAUACCGAGACAGUGA | 20 | 398 |
| myoC-71 | + | UGUGUCAUAAGCAAAGUUGA | 20 | 463 |
| myoC-317 | - | UCCUGCUUCCCGAAUUUUGA | 20 | 703 |
| myoC-20 | + | GUGUAGCCACCCCAAGAAUA | 20 | 390 |
| myoC-367 | - | UAUGCAGGGCUACCCUUCUA | 20 | 753 |
| myoC-358 | - | GAAACAAUUACUGGCAAGUA | 20 | 744 |
| myoC-493 | - | GAUUUGGGGCAAAAGCUGUA | 20 | 835 |
| myoC-473 | + | CACGUGGUCUCCUGGGUGUA | 20 | 815 |
| myoC-442 | + | CAUUGGCGACUGACUGCUUA | 20 | 793 |
| myoC-488 | - | UUAUCUUCUGUCAGCAUUUA | 20 | 830 |
| myoC-465 | + | AAGGGUAGCCCUGCAUAAAC | 20 | 807 |
| myoC-323 | - | AGGAGUGGAGAGGGAGACAC | 20 | 709 |
| myoC-206 | + | UGUCUCGGGUCUGGGGACAC | 20 | 592 |
| myoC-53 | - | GUCAACUUUGCUUAUGACAC | 20 | 439 |
| myoC-369 | - | UCACAUACUGCCUAGGCCAC | 20 | 755 |
| myoC-371 | - | CCUAGGCCACUGGAAAGCAC | 20 | 757 |
| myoC-54 | - | UUUGCUUAUGACACAGGCAC | 20 | 453 |
| myoC-21 | + | UGUAGCCACCCCAAGAAUAC | 20 | 418 |
| myoC-324 | + | GAAGAAACUUAACUUCAUAC | 20 | 710 |
| myoC-405 | - | GAAAAGCCUCCAAGCUGUAC | 20 | 769 |
| myoC-357 | - | AGAACAGCAGAAACAAUUAC | 20 | 743 |
| myoC-467 | + | UGAGGUCAUACUCAAAAACC | 20 | 809 |
| myoC-396 | - | AUCUGGAACUCGAACAAACC | 20 | 766 |

TABLE 6E-continued

| 5th Tier | | | | |
|---|---|---|---|---|
| gRNA Name | DNA Strand | Targeting Domain | Target Site Length | SEQ ID NO |
| myoC-201 | - | ACUGCUCGGGCUGUGCCACC | 20 | 587 |
| myoC-3182 | - | UUUUCUUUUCUGAAUUUACC | 20 | 2928 |
| myoC-360 | - | GCCCACCUACCCCUACACCC | 20 | 746 |
| myoC-55 | - | CAUGAUUGACUACAACCCCC | 20 | 454 |
| myoC-421 | + | CCCUUCAGCCUGCUCCCCCC | 20 | 785 |
| myoC-459 | + | CAGUUCUGGACUCAGCGCCC | 20 | 801 |
| myoC-420 | - | GAGCCAGCCAGCCAGGGCCC | 20 | 784 |
| myoC-1576 | + | AGUCAAAGCUGCCUGGGCCC | 20 | 1802 |
| myoC-3 | - | AAGGCUGAGAAGGAAAUCCC | 20 | 406 |
| myoC-443 | + | CUUACGGAUGUUUGUCUCCC | 20 | 794 |
| myoC-60 | + | GACCAUGUUCAAGUUGUCCC | 20 | 441 |
| myoC-418 | - | GAAGGGAGAGCCAGCCAGCC | 20 | 782 |
| myoC-107 | - | GAGGUUGGAAAGCAGCAGCC | 20 | 511 |
| myoC-3183 | + | UUCUUACCUUCUCUGGAGCC | 20 | 2929 |
| myoC-364 | - | AGUUGGCACGGAUGUCCGCC | 20 | 750 |
| myoC-512 | + | GGAAAGCAGUCAAAGCUGCC | 20 | 854 |
| myoC-56 | - | UGGAGAAGAAGCUCUUUGCC | 20 | 455 |
| myoC-482 | + | CAAACUAGUUCUCCACAUCC | 20 | 824 |
| myoC-207 | + | UUCUCAGCCUUGCUACCUCC | 20 | 593 |
| myoC-23 | + | UGUCCGUGGUAGCCAGCUCC | 20 | 420 |
| myoC-410 | - | AAGGAGAUGCUCAGGGCUCC | 20 | 774 |
| myoC-470 | + | CGAUUCUCCACGUGGUCUCC | 20 | 812 |
| myoC-61 | + | AGGCAAAGAGCUUCUUCUCC | 20 | 458 |
| myoC-316 | - | UUUGGACACUUUGGCCUUCC | 20 | 702 |
| myoC-331 | + | UUAGCUCGGACUUCAGUUCC | 20 | 717 |
| myoC-376 | - | CUCGGGGAGCCUCUAUUUCC | 20 | 762 |
| myoC-329 | + | UCCUUCAAAAUUCGGGAAGC | 20 | 715 |
| myoC-13 | - | GACUUGGCUGUGGAUGAAGC | 20 | 400 |
| myoC-415 | - | UCAGGGCUCCUGGGGGGAGC | 20 | 779 |
| myoC-4 | - | GAGAAGGAAAUCCCUGGAGC | 20 | 399 |
| myoC-1577 | + | AAAGCUGCCUGGGCCCUGGC | 20 | 1803 |
| myoC-1578 | + | CUGCCUGGGCCCUGGCUGGC | 20 | 1804 |
| myoC-502 | + | AUCUUACUUAUAUUCGAUGC | 20 | 844 |
| myoC-365 | - | CCUCAUCAGCCAGUUUAUGC | 20 | 751 |
| myoC-395 | - | CAAACUGAACCCAGAGAAUC | 20 | 765 |
| myoC-318 | - | AUUUUGAAGGAGAGCCCAUC | 20 | 704 |
| myoC-374 | - | ACGGGUGCUGUGGUGUACUC | 20 | 760 |

TABLE 6E-continued

| 5th Tier | | | | |
|---|---|---|---|---|
| gRNA Name | DNA Strand | Targeting Domain | Target Site Length | SEQ ID NO |
| myoC-14 | − | CUGUGGAUGAAGCAGGCCUC | 20 | 413 |
| myoC-496 | − | AGGAAGCAGAAUAGCUCCUC | 20 | 838 |
| myoC-408 | − | AAUGGCAGAAGGAGAUGCUC | 20 | 772 |
| myoC-200 | − | CCAGACCCGAGACACUGCUC | 20 | 586 |
| myoC-319 | − | AGAGCCCAUCUGGCUAUCUC | 20 | 705 |
| myoC-202 | + | CACAGCCCGAGCAGUGUCUC | 20 | 588 |
| myoC-444 | + | UGUUCGAGUUCCAGAUUCUC | 20 | 795 |
| myoC-3184 | + | CUCUGCAUUCUUACCUUCUC | 20 | 2930 |
| myoC-203 | + | CCCGAGCAGUGUCUCGGGUC | 20 | 589 |
| myoC-69 | + | GGUUCUUGAAUGGGAUGGUC | 20 | 449 |
| myoC-328 | + | UGGGCUCUCCUUCAAAAUUC | 20 | 714 |
| myoC-485 | − | UGGUCACCAUCUAACUAUUC | 20 | 827 |
| myoC-510 | + | GGUGACCAUGUUCAUCCUUC | 20 | 852 |
| myoC-26 | + | CUCAUAUCUUAUGACAGUUC | 20 | 422 |
| myoC-507 | + | AUGCAAGAGCAAUGGUUUUC | 20 | 849 |
| myoC-111 | − | GAGGUAGCAAGGCUGAGAAG | 20 | 514 |
| myoC-19 | + | CGGUGCUGUAAAUGACCCAG | 20 | 417 |
| myoC-503 | + | UUAUAUUCGAUGCUGGCCAG | 20 | 845 |
| myoC-63 | + | GCAAAGAGCUUCUUCUCCAG | 20 | 442 |
| myoC-461 | + | ACAGCACCCGUGCUUUCCAG | 20 | 803 |
| myoC-3185 | − | GAGAAGGUAAGAAUGCAGAG | 20 | 2931 |
| myoC-320 | − | CCAUCUGGCUAUCUCAGGAG | 20 | 706 |
| myoC-321 | − | UGGCUAUCUCAGGAGUGGAG | 20 | 707 |
| myoC-447 | + | UCUCUGGGUUCAGUUUGGAG | 20 | 798 |
| myoC-481 | + | UCUGCUGUUCUCAGCGUGAG | 20 | 823 |
| myoC-460 | + | ACUCAGCGCCCUGGAAAUAG | 20 | 802 |
| myoC-65 | + | UCAUGCUGCUGUACUUAUAG | 20 | 460 |
| myoC-474 | + | ACGUGGUCUCCUGGGUGUAG | 20 | 816 |
| myoC-361 | − | CCUACACCCAGGAGACCACG | 20 | 747 |
| myoC-469 | + | AACUGUGUCGAUUCUCCACG | 20 | 811 |
| myoC-313 | − | CUUUUAAUGCAGUUUCUACG | 20 | 699 |
| myoC-22 | + | AAGAAUACGGGAACUGUCCG | 20 | 419 |
| myoC-375 | − | CGGGUGCUGUGGUGUACUCG | 20 | 761 |
| myoC-108 | − | GUUGGAAAGCAGCAGCCAGG | 20 | 480 |
| myoC-64 | + | CAAAGAGCUUCUUCUCCAGG | 20 | 459 |
| myoC-476 | + | CUCCUGGGUGUAGGGGUAGG | 20 | 818 |
| myoC-9 | − | CAGUUCCCGUAUUCUUGGGG | 20 | 410 |

TABLE 6E-continued

| 5th Tier | | | | |
|---|---|---|---|---|
| gRNA Name | DNA Strand | Targeting Domain | Target Site Length | SEQ ID NO |
| myoC-414 | − | AGAUGCUCAGGGCUCCUGGG | 20 | 778 |
| myoC-3186 | − | AGGUAAGAAUGCAGAGUGGG | 20 | 2932 |
| myoC-468 | + | GGUCAUACUCAAAAACCUGG | 20 | 810 |
| myoC-3187 | + | UUACCUUCUCUGGAGCCUGG | 20 | 2933 |
| myoC-413 | − | GAGAUGCUCAGGGCUCCUGG | 20 | 777 |
| myoC-3188 | − | AAGGUAAGAAUGCAGAGUGG | 20 | 2934 |
| myoC-423 | + | CCAUUGCCUGUACAGCUUGG | 20 | 787 |
| myoC-16 | − | GGUCAUUUACAGCACCGAUG | 20 | 389 |
| myoC-353 | − | UUUCUGAAUUUACCAGGAUG | 20 | 739 |
| myoC-466 | + | CCUGCAUAAACUGGCUGAUG | 20 | 808 |
| myoC-412 | − | GGAGAUGCUCAGGGCUCCUG | 20 | 776 |
| myoC-12 | − | CACGGACAUUGACUUGGCUG | 20 | 412 |
| myoC-437 | + | GUUGACGGUAGCAUCUGCUG | 20 | 788 |
| myoC-372 | − | ACUGGAAAGCACGGGUGCUG | 20 | 758 |
| myoC-398 | − | GCCAAUGCCUUCAUCAUCUG | 20 | 768 |
| myoC-486 | − | UAUUCAGGAAUUGUAGUCUG | 20 | 828 |
| myoC-205 | + | CGAGCAGUGUCUCGGGUCUG | 20 | 591 |
| myoC-3189 | − | GAAGGUAAGAAUGCAGAGUG | 20 | 2935 |
| myoC-359 | − | UUACUGGCAAGUAUGGUGUG | 20 | 745 |
| myoC-504 | + | AGAAGUUAUGCUUUUUAUUG | 20 | 846 |
| myoC-480 | + | UGUAGGGGUAGGUGGGCUUG | 20 | 822 |
| myoC-505 | + | AUGCUUUUUAUUGUGGCUUG | 20 | 847 |
| myoC-385 | − | GGACAGUUCCCGUAUUCUUG | 20 | 764 |
| myoC-492 | − | UCAAGUUUUCUUGUGAUUUG | 20 | 834 |
| myoC-3190 | − | GUUCUCUUCCUUGAACUUUG | 20 | 2936 |
| myoC-67 | + | ACUUAUAGCGGUUCUUGAAU | 20 | 462 |
| myoC-441 | + | GCCACAGAUGAUGAAGGCAU | 20 | 792 |
| myoC-18 | + | AAUGGCACCUUUGGCCUCAU | 20 | 416 |
| myoC-326 | + | CACUCCUGAGAUAGCCAGAU | 20 | 712 |
| myoC-489 | − | UAUCUUCUGUCAGCAUUUAU | 20 | 831 |
| myoC-511 | + | CUUCUGGAUUAAUGAAAACU | 20 | 853 |
| myoC-11 | − | UGGCUACACGGACAUUGACU | 20 | 411 |
| myoC-373 | − | CACGGGUGCUGUGGUGUACU | 20 | 759 |
| myoC-397 | − | UCUGGAACUCGAACAAACCU | 20 | 767 |
| myoC-462 | + | CCCGUGCUUUCCAGUGGCCU | 20 | 804 |
| myoC-368 | − | CUAAGGUUCACAUACUGCCU | 20 | 754 |
| myoC-513 | + | GAAAGCAGUCAAAGCUGCCU | 20 | 855 |

TABLE 6E-continued

5th Tier

| gRNA Name | DNA Strand | Targeting Domain | Target Site Length | SEQ ID NO |
|---|---|---|---|---|
| myoC-57 | - | GGAGAAGAAGCUCUUUGCCU | 20 | 440 |
| myoC-411 | - | AGGAGAUGCUCAGGGCUCCU | 20 | 775 |
| myoC-471 | + | GAUUCUCCACGUGGUCUCCU | 20 | 813 |
| myoC-422 | + | CUGCCAUUGCCUGUACAGCU | 20 | 786 |
| myoC-330 | + | AGCAGGAACUUCAGUUAGCU | 20 | 716 |
| myoC-478 | + | GGUGUAGGGGUAGGUGGGCU | 20 | 820 |
| myoC-199 | - | CCCAGACCCGAGACACUGCU | 20 | 585 |
| myoC-59 | + | CUUGGAGGCUUUUCACAUCU | 20 | 457 |
| myoC-15 | - | UGUGGAUGAAGCAGGCCUCU | 20 | 414 |
| myoC-445 | + | GUUCGAGUUCCAGAUUCUCU | 20 | 796 |
| myoC-204 | + | CCGAGCAGUGUCUCGGGUCU | 20 | 590 |
| myoC-25 | + | CUUCUCAGCCUUCACUGUCU | 20 | 421 |
| myoC-112 | + | GCACAGCCCGAGCAGUGUCU | 20 | 481 |
| myoC-6 | - | ACGGACAGUUCCCGUAUUCU | 20 | 408 |
| myoC-362 | - | ACGUGGAGAAUCGACACAGU | 20 | 748 |
| myoC-498 | - | UGCUUCAGAUAGAAUACAGU | 20 | 840 |
| myoC-497 | - | UAAGAUGCAUUUACUACAGU | 20 | 839 |
| myoC-3191 | - | AGAAGGUAAGAAUGCAGAGU | 20 | 2937 |
| myoC-3192 | + | AAGUUCAAGGAAGAGAACGU | 20 | 2938 |
| myoC-477 | + | UCCUGGGUGUAGGGGUAGGU | 20 | 819 |
| myoC-475 | + | GGUCUCCUGGGUGUAGGGGU | 20 | 817 |
| myoC-356 | - | UGUGGAGAACUAGUUUGGGU | 20 | 742 |
| myoC-472 | + | CCACGUGGUCUCCUGGGUGU | 20 | 814 |
| myoC-3193 | - | UUCUCUUCCUUGAACUUUGU | 20 | 2939 |
| myoC-327 | + | AUGGGCUCUCCUUCAAAAUU | 20 | 713 |
| myoC-314 | - | UGCAGUUUCUACGUGGAAUU | 20 | 700 |
| myoC-490 | - | GUUCAAGUUUUCUUGUGAUU | 20 | 832 |
| myoC-315 | - | UACGUGGAAUUUGGACACUU | 20 | 701 |
| myoC-449 | + | GGAGAGGACAAUGGCACCUU | 20 | 800 |
| myoC-479 | + | GUGUAGGGGUAGGUGGGCUU | 20 | 821 |
| myoC-7 | - | CGGACAGUUCCCGUAUUCUU | 20 | 409 |
| myoC-499 | - | GCUUCAGAUAGAAUACAGUU | 20 | 841 |
| myoC-446 | + | CAGAUUCUCUGGGUUCAGUU | 20 | 797 |
| myoC-354 | - | CAGGAUGUGGAGAACUAGUU | 20 | 740 |
| myoC-3194 | + | AGUUCAAGGAAGAGAACGUU | 20 | 2940 |
| myoC-491 | - | UUCAAGUUUUCUUGUGAUUU | 20 | 833 |
| myoC-355 | - | AGGAUGUGGAGAACUAGUUU | 20 | 741 |

Table 7A provides exemplary targeting domains for knocking out the MYOC gene selected according to the first tier parameters. The targeting domains bind within the first 500 bp of the coding sequence (e.g., within 500 bp downstream from the start codon), have a high level of orthogonality, start with a 5'G, and PAM is NNGRRT. It is contemplated herein that in an embodiment the targeting domain hybridizes to the target domain through complementary base pairing. Any of the targeting domains in the Table 1 can be used with a *S. aureus* Cas9 molecule that generates a double stranded break (Cas9 nuclease) or a single-stranded break (Cas9 nickase).

TABLE 7A

1st Tier

| gRNA Name | DNA Strand | Targeting Domain | Target Site Length | SEQ ID NO |
|---|---|---|---|---|
| myoC-3195 | + | GGCCUCCAGGUCUAAGCG | 18 | 2941 |
| myoC-1677 | + | GUGGCCUCCAGGUCUAAGCG | 20 | 1938 |
| myoC-3196 | + | GGUGGCCUCCAGGUCUAAGCG | 21 | 2942 |
| myoC-3197 | + | GCUGGUCCCGCUCCCGCCU | 19 | 2943 |
| myoC-3198 | + | GGCAGUCUCCAACUCUCUGGU | 21 | 2944 |
| myoC-3199 | + | GUAGGCAGUCUCCAACUCUCUGGU | 24 | 2945 |
| myoC-3200 | + | GCUGUCUCUCUGUAAGUU | 18 | 2946 |
| myoC-3201 | + | GCUGCUGUCUCUCUGUAAGUU | 21 | 2947 |
| myoC-3202 | + | GUGCUGCUGUCUCUCUGUAAGUU | 23 | 2948 |
| myoC-3203 | + | GGUGCUGCUGUCUCUCUGUAAGUU | 24 | 2949 |
| myoC-3204 | - | GACCAGCUGGAAACCCAAACCA | 22 | 2950 |
| myoC-3205 | - | GGACCAGCUGGAAACCCAAACCA | 23 | 2951 |
| myoC-3206 | - | GGGACCAGCUGGAAACCCAAACCA | 24 | 2952 |
| myoC-3207 | - | GCUCAGGAAGGCCAAUGAC | 19 | 2953 |
| myoC-3208 | - | GCUCAGCUCAGGAAGGCCAAUGAC | 24 | 2954 |
| myoC-3209 | - | GCUUCUGGCCUGCCUGGUG | 19 | 2955 |
| myoC-3210 | - | GCGACUAAGGCAAGAAAAU | 19 | 2956 |
| myoC-3211 | - | GAAGCGACUAAGGCAAGAAAAU | 22 | 2957 |

Table 7B provides exemplary targeting domains for knocking out the MYOC gene selected according to the second tier parameters. The targeting domains bind within the first 500 bp of the coding sequence (e.g., within 500 bp downstream from the start codon), have a high level of orthogonality and PAM is NNGRRT. It is contemplated herein that in an embodiment the targeting domain hybridizes to the target domain through complementary base pairing. Any of the targeting domains in the Table 1 can be used with a *S. aureus* Cas9 molecule that generates a double stranded break (Cas9 nuclease) or a single-stranded break (Cas9 nickase).

TABLE 7B

2nd Tier

| gRNA Name | DNA Strand | Targeting Domain | Target Site Length | SEQ ID NO |
|---|---|---|---|---|
| myoC-3212 | + | UGGCCUCCAGGUCUAAGCG | 19 | 2958 |
| myoC-3213 | + | UGGUGGCCUCCAGGUCUAAGCG | 22 | 2959 |
| myoC-3214 | + | UUGGUGGCCUCCAGGUCUAAGCG | 23 | 2960 |
| myoC-3215 | + | UUUGGUGGCCUCCAGGUCUAAGCG | 24 | 2961 |
| myoC-3216 | + | CUGGUCCCGCUCCCGCCU | 18 | 2962 |
| myoC-1690 | + | AGCUGGUCCCGCUCCCGCCU | 20 | 1946 |
| myoC-3217 | + | CAGCUGGUCCCGCUCCCGCCU | 21 | 2963 |
| myoC-3218 | + | CCAGCUGGUCCCGCUCCCGCCU | 22 | 2964 |
| myoC-3219 | + | UCCAGCUGGUCCCGCUCCCGCCU | 23 | 2965 |
| myoC-3220 | + | UUCCAGCUGGUCCCGCUCCCGCCU | 24 | 2966 |
| myoC-3221 | + | AGGCAGUCUCCAACUCUCUGGU | 22 | 2967 |
| myoC-3222 | + | UAGGCAGUCUCCAACUCUCUGGU | 23 | 2968 |
| myoC-3223 | + | UGCUGUCUCUCUGUAAGUU | 19 | 2969 |
| myoC-1676 | + | CUGCUGUCUCUCUGUAAGUU | 20 | 1937 |
| myoC-3224 | + | UGCUGCUGUCUCUCUGUAAGUU | 22 | 2970 |
| myoC-3225 | - | AGCUGGAAACCCAAACCA | 18 | 2971 |
| myoC-3226 | - | CAGCUGGAAACCCAAACCA | 19 | 2972 |
| myoC-1635 | - | CCAGCUGGAAACCCAAACCA | 20 | 1904 |
| myoC-3227 | - | ACCAGCUGGAAACCCAAACCA | 21 | 2973 |
| myoC-3228 | - | UCAGUGUGGCCAGUCCCA | 18 | 2974 |
| myoC-3229 | - | UUCAGUGUGGCCAGUCCCA | 19 | 2975 |
| myoC-1604 | - | CUUCAGUGUGGCCAGUCCCA | 20 | 1884 |
| myoC-3230 | - | CCUUCAGUGUGGCCAGUCCCA | 21 | 2976 |
| myoC-3231 | - | ACCUUCAGUGUGGCCAGUCCCA | 22 | 2977 |
| myoC-3232 | - | UACCUUCAGUGUGGCCAGUCCCA | 23 | 2978 |
| myoC-3233 | - | AUACCUUCAGUGUGGCCAGUCCCA | 24 | 2979 |
| myoC-3234 | - | CUCAGGAAGGCCAAUGAC | 18 | 2980 |
| myoC-1603 | - | AGCUCAGGAAGGCCAAUGAC | 20 | 1883 |

TABLE 7B-continued

2nd Tier

| gRNA Name | DNA Strand | Targeting Domain | Target Site Length | SEQ ID NO |
|---|---|---|---|---|
| myoC-3235 | - | CAGCUCAGGAAGGCCAAUGAC | 21 | 2981 |
| myoC-3236 | - | UCAGCUCAGGAAGGCCAAUGAC | 22 | 2982 |
| myoC-3237 | - | CUCAGCUCAGGAAGGCCAAUGAC | 23 | 2983 |
| myoC-3238 | - | CUUCUGGCCUGCCUGGUG | 18 | 2984 |
| myoC-171 | - | UGCUUCUGGCCUGCCUGGUG | 20 | 557 |
| myoC-3239 | - | CGACUAAGGCAAGAAAAU | 18 | 2985 |
| myoC-1648 | - | AGCGACUAAGGCAAGAAAAU | 20 | 1914 |
| myoC-3240 | - | AAGCGACUAAGGCAAGAAAAU | 21 | 2986 |
| myoC-3241 | - | AGAAGCGACUAAGGCAAGAAAAU | 23 | 2987 |
| myoC-3242 | - | AAGAAGCGACUAAGGCAAGAAAAU | 24 | 2988 |

Table 7C provides exemplary targeting domains for knocking out the MYOC gene selected according to the third tier parameters. The targeting domains bind within the first 500 bp of the coding sequence (e.g., within 500 bp downstream from the start codon), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 7C

3rd Tier

| gRNA Name | DNA Strand | Targeting Domain | Target Site Length | SEQ ID NO |
|---|---|---|---|---|
| myoC-3243 | + | CUCCCUCUGCAGCCCCUC | 18 | 2989 |
| myoC-3244 | + | GCUCCCUCUGCAGCCCCUC | 19 | 2990 |
| myoC-1689 | + | AGCUCCCUCUGCAGCCCCUC | 20 | 1945 |
| myoC-3245 | + | CAGCUCCCUCUGCAGCCCCUC | 21 | 2991 |
| myoC-3246 | + | CCAGCUCCCUCUGCAGCCCCUC | 22 | 2992 |
| myoC-3247 | + | CCCAGCUCCCUCUGCAGCCCCUC | 23 | 2993 |
| myoC-3248 | + | GCCCAGCUCCCUCUGCAGCCCCUC | 24 | 2994 |
| myoC-3249 | + | UGGCUCUGCUCUGGGCAG | 18 | 2995 |
| myoC-3250 | + | CUGGCUCUGCUCUGGGCAG | 19 | 2996 |
| myoC-1674 | + | CCUGGCUCUGCUCUGGGCAG | 20 | 1935 |
| myoC-3251 | + | GCCUGGCUCUGCUCUGGGCAG | 21 | 2997 |
| myoC-3252 | + | GGCCUGGCUCUGCUCUGGGCAG | 22 | 2998 |
| myoC-3253 | + | UGGCCUGGCUCUGCUCUGGGCAG | 23 | 2999 |

TABLE 7C-continued

| 3rd Tier | | | | |
|---|---|---|---|---|
| gRNA Name | DNA Strand | Targeting Domain | Target Site Length | SEQ ID NO |
| myoC-3254 | + | AUGGCCUGGCUCUGCUCUGGGCAG | 24 | 3000 |
| myoC-3255 | + | AGGAGGCUCUCCAGGGAG | 18 | 3001 |
| myoC-3256 | + | GAGGAGGCUCUCCAGGGAG | 19 | 3002 |
| myoC-1679 | + | GGAGGAGGCUCUCCAGGGAG | 20 | 1940 |
| myoC-3257 | + | UGGAGGAGGCUCUCCAGGGAG | 21 | 3003 |
| myoC-3258 | + | GUGGAGGAGGCUCUCCAGGGAG | 22 | 3004 |
| myoC-3259 | + | GGUGGAGGAGGCUCUCCAGGGAG | 23 | 3005 |
| myoC-3260 | + | UGGUGGAGGAGGCUCUCCAGGGAG | 24 | 3006 |
| myoC-3261 | + | AGUCUCCAACUCUCUGGU | 18 | 3007 |
| myoC-3262 | + | CAGUCUCCAACUCUCUGGU | 19 | 3008 |
| myoC-1691 | + | GCAGUCUCCAACUCUCUGGU | 20 | 1947 |
| myoC-3263 | - | CUGCUUCUGGCCUGCCUGGUG | 21 | 3009 |
| myoC-3264 | - | GCUGCUUCUGGCCUGCCUGGUG | 22 | 3010 |
| myoC-3265 | - | UGCUGCUUCUGGCCUGCCUGGUG | 23 | 3011 |
| myoC-3266 | - | CUGCUGCUUCUGGCCUGCCUGGUG | 24 | 3012 |

Table 7D provides exemplary targeting domains for knocking out the MYOC gene selected according to the fourth tier parameters. The targeting domains bind within the first 500 bp of the coding sequence (e.g., within 500 bp downstream from the start codon), and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 7D

| 4th Tier | | | | |
|---|---|---|---|---|
| gRNA Name | DNA Strand | Targeting Domain | Target Site Length | SEQ ID NO |
| myoC-3267 | + | UCAUUGGGACUGGCCACA | 18 | 3013 |
| myoC-3268 | + | UUCAUUGGGACUGGCCACA | 19 | 3014 |
| myoC-1671 | + | AUUCAUUGGGACUGGCCACA | 20 | 1933 |
| myoC-3269 | + | GAUUCAUUGGGACUGGCCACA | 21 | 3015 |
| myoC-3270 | + | GGAUUCAUUGGGACUGGCCACA | 22 | 3016 |
| myoC-3271 | + | UGGAUUCAUUGGGACUGGCCACA | 23 | 3017 |
| myoC-3272 | + | CUGGAUUCAUUGGGACUGGCCACA | 24 | 3018 |
| myoC-3273 | + | GGUGGAGGAGGCUCUCCA | 18 | 3019 |
| myoC-3274 | + | UGGUGGAGGAGGCUCUCCA | 19 | 3020 |
| myoC-223 | + | UUGGUGGAGGAGGCUCUCCA | 20 | 609 |
| myoC-3275 | + | AUUGGUGGAGGAGGCUCUCCA | 21 | 3021 |
| myoC-3276 | + | AAUUGGUGGAGGAGGCUCUCCA | 22 | 3022 |
| myoC-3277 | + | CAAUUGGUGGAGGAGGCUCUCCA | 23 | 3023 |
| myoC-3278 | + | UCAAUUGGUGGAGGAGGCUCUCCA | 24 | 3024 |
| myoC-3279 | + | AAGCUGCAGCAACGUGCA | 18 | 3025 |
| myoC-3280 | + | AAAGCUGCAGCAACGUGCA | 19 | 3026 |
| myoC-1666 | + | CAAAGCUGCAGCAACGUGCA | 20 | 1928 |
| myoC-3281 | + | CCAAAGCUGCAGCAACGUGCA | 21 | 3027 |
| myoC-3282 | + | CCCAAAGCUGCAGCAACGUGCA | 22 | 3028 |
| myoC-3283 | + | GCCCAAAGCUGCAGCAACGUGCA | 23 | 3029 |

TABLE 7D-continued

| 4th Tier | | | | |
|---|---|---|---|---|
| gRNA Name | DNA Strand | Targeting Domain | Target Site Length | SEQ ID NO |
| myoC-3284 | + | GGCCCAAAGCUGCAGCAACGUGCA | 24 | 3030 |
| myoC-3285 | + | UCUGGGCAGCUGGAUUCA | 18 | 3031 |
| myoC-3286 | + | CUCUGGGCAGCUGGAUUCA | 19 | 3032 |
| myoC-1673 | + | GCUCUGGGCAGCUGGAUUCA | 20 | 1934 |
| myoC-3287 | + | UGCUCUGGGCAGCUGGAUUCA | 21 | 3033 |
| myoC-3288 | + | CUGCUCUGGGCAGCUGGAUUCA | 22 | 3034 |
| myoC-3289 | + | UCUGCUCUGGGCAGCUGGAUUCA | 23 | 3035 |
| myoC-3290 | + | CUCUGCUCUGGGCAGCUGGAUUCA | 24 | 3036 |
| myoC-3291 | + | UGGUGGAGGAGGCUCUCC | 18 | 3037 |
| myoC-3292 | + | UUGGUGGAGGAGGCUCUCC | 19 | 3038 |
| myoC-222 | + | AUUGGUGGAGGAGGCUCUCC | 20 | 608 |
| myoC-3293 | + | AAUUGGUGGAGGAGGCUCUCC | 21 | 3039 |
| myoC-3294 | + | CAAUUGGUGGAGGAGGCUCUCC | 22 | 3040 |
| myoC-3295 | + | UCAAUUGGUGGAGGAGGCUCUCC | 23 | 3041 |
| myoC-3296 | + | GUCAAUUGGUGGAGGAGGCUCUCC | 24 | 3042 |
| myoC-3297 | + | AGCCCCUCCUGGGUCUCC | 18 | 3043 |
| myoC-3298 | + | CAGCCCCUCCUGGGUCUCC | 19 | 3044 |
| myoC-119 | + | GCAGCCCCUCCUGGGUCUCC | 20 | 518 |
| myoC-3299 | + | UGCAGCCCCUCCUGGGUCUCC | 21 | 3045 |
| myoC-3300 | + | CUGCAGCCCCUCCUGGGUCUCC | 22 | 3046 |
| myoC-3301 | + | UCUGCAGCCCCUCCUGGGUCUCC | 23 | 3047 |
| myoC-3302 | + | CUCUGCAGCCCCUCCUGGGUCUCC | 24 | 3048 |
| myoC-3303 | + | AUCCCACACCAGGCAGGC | 18 | 3049 |
| myoC-3304 | + | CAUCCCACACCAGGCAGGC | 19 | 3050 |
| myoC-1668 | + | ACAUCCCACACCAGGCAGGC | 20 | 1930 |
| myoC-3305 | + | CACAUCCCACACCAGGCAGGC | 21 | 3051 |
| myoC-3306 | + | CCACAUCCCACACCAGGCAGGC | 22 | 3052 |
| myoC-3307 | + | CCCACAUCCCACACCAGGCAGGC | 23 | 3053 |
| myoC-3308 | + | CCCCACAUCCCACACCAGGCAGGC | 24 | 3054 |
| myoC-3309 | + | GCUUGGUGAGGCUUCCUC | 18 | 3055 |
| myoC-3310 | + | GGCUUGGUGAGGCUUCCUC | 19 | 3056 |
| myoC-2356 | + | AGGCUUGGUGAGGCUUCCUC | 20 | 2410 |
| myoC-3311 | + | GAGGCUUGGUGAGGCUUCCUC | 21 | 3057 |
| myoC-3312 | + | AGAGGCUUGGUGAGGCUUCCUC | 22 | 3058 |
| myoC-3313 | + | CAGAGGCUUGGUGAGGCUUCCUC | 23 | 3059 |
| myoC-3314 | + | GCAGAGGCUUGGUGAGGCUUCCUC | 24 | 3060 |
| myoC-3315 | + | UCGCUUCUUCUCUUCCUC | 18 | 3061 |

TABLE 7D-continued

| 4th Tier | | | | |
|---|---|---|---|---|
| gRNA Name | DNA Strand | Targeting Domain | Target Site Length | SEQ ID NO |
| myoC-3316 | + | GUCGCUUCUUCUCUUCCUC | 19 | 3062 |
| myoC-1696 | + | AGUCGCUUCUUCUCUUCCUC | 20 | 1950 |
| myoC-3317 | + | UAGUCGCUUCUUCUCUUCCUC | 21 | 3063 |
| myoC-3318 | + | UUAGUCGCUUCUUCUCUUCCUC | 22 | 3064 |
| myoC-3319 | + | CUUAGUCGCUUCUUCUCUUCCUC | 23 | 3065 |
| myoC-3320 | + | CCUUAGUCGCUUCUUCUCUUCCUC | 24 | 3066 |
| myoC-3321 | + | UUGGUGGAGGAGGCUCUC | 18 | 3067 |
| myoC-3322 | + | AUUGGUGGAGGAGGCUCUC | 19 | 3068 |
| myoC-1682 | + | AAUUGGUGGAGGAGGCUCUC | 20 | 1941 |
| myoC-3323 | + | CAAUUGGUGGAGGAGGCUCUC | 21 | 3069 |
| myoC-3324 | + | UCAAUUGGUGGAGGAGGCUCUC | 22 | 3070 |
| myoC-3325 | + | GUCAAUUGGUGGAGGAGGCUCUC | 23 | 3071 |
| myoC-3326 | + | GGUCAAUUGGUGGAGGAGGCUCUC | 24 | 3072 |
| myoC-3327 | + | CAGCCCCUCCUGGGUCUC | 18 | 3073 |
| myoC-3328 | + | GCAGCCCCUCCUGGGUCUC | 19 | 3074 |
| myoC-1688 | + | UGCAGCCCCUCCUGGGUCUC | 20 | 1944 |
| myoC-3329 | + | CUGCAGCCCCUCCUGGGUCUC | 21 | 3075 |
| myoC-3330 | + | UCUGCAGCCCCUCCUGGGUCUC | 22 | 3076 |
| myoC-3331 | + | CUCUGCAGCCCCUCCUGGGUCUC | 23 | 3077 |
| myoC-3332 | + | CCUCUGCAGCCCCUCCUGGGUCUC | 24 | 3078 |
| myoC-3333 | + | CUCCAGAACUGACUUGUC | 18 | 3079 |
| myoC-3334 | + | CCUCCAGAACUGACUUGUC | 19 | 3080 |
| myoC-1695 | + | UCCUCCAGAACUGACUUGUC | 20 | 1949 |
| myoC-3335 | + | UUCCUCCAGAACUGACUUGUC | 21 | 3081 |
| myoC-3336 | + | CUUCCUCCAGAACUGACUUGUC | 22 | 3082 |
| myoC-3337 | + | UCUUCCUCCAGAACUGACUUGUC | 23 | 3083 |
| myoC-3338 | + | CUCUUCCUCCAGAACUGACUUGUC | 24 | 3084 |
| myoC-3339 | + | CUCUGGUCAUUGGCCUUC | 18 | 3085 |
| myoC-3340 | + | ACUCUGGUCAUUGGCCUUC | 19 | 3086 |
| myoC-1670 | + | CACUCUGGUCAUUGGCCUUC | 20 | 1932 |
| myoC-3341 | + | CCACUCUGGUCAUUGGCCUUC | 21 | 3087 |
| myoC-3342 | + | GCCACUCUGGUCAUUGGCCUUC | 22 | 3088 |
| myoC-3343 | + | GGCCACUCUGGUCAUUGGCCUUC | 23 | 3089 |
| myoC-3344 | + | CGGCCACUCUGGUCAUUGGCCUUC | 24 | 3090 |
| myoC-3345 | + | CUGCAGCAACGUGCACAG | 18 | 3091 |
| myoC-3346 | + | GCUGCAGCAACGUGCACAG | 19 | 3092 |
| myoC-1665 | + | AGCUGCAGCAACGUGCACAG | 20 | 1927 |
| myoC-3347 | + | AAGCUGCAGCAACGUGCACAG | 21 | 3093 |

TABLE 7D-continued

| 4th Tier | | | | |
|---|---|---|---|---|
| gRNA Name | DNA Strand | Targeting Domain | Target Site Length | SEQ ID NO |
| myoC-3348 | + | AAAGCUGCAGCAACGUGCACAG | 22 | 3094 |
| myoC-3349 | + | CAAAGCUGCAGCAACGUGCACAG | 23 | 3095 |
| myoC-3350 | + | CCAAAGCUGCAGCAACGUGCACAG | 24 | 3096 |
| myoC-3351 | + | GCAGGCCAGAAGCAGCAG | 18 | 3097 |
| myoC-3352 | + | GGCAGGCCAGAAGCAGCAG | 19 | 3098 |
| myoC-1667 | + | AGGCAGGCCAGAAGCAGCAG | 20 | 1929 |
| myoC-3353 | + | CAGGCAGGCCAGAAGCAGCAG | 21 | 3099 |
| myoC-3354 | + | CCAGGCAGGCCAGAAGCAGCAG | 22 | 3100 |
| myoC-3355 | + | ACCAGGCAGGCCAGAAGCAGCAG | 23 | 3101 |
| myoC-3356 | + | CACCAGGCAGGCCAGAAGCAGCAG | 24 | 3102 |
| myoC-3357 | + | GUCAUUGGCCUUCCUGAG | 18 | 3103 |
| myoC-3358 | + | GGUCAUUGGCCUUCCUGAG | 19 | 3104 |
| myoC-1669 | + | UGGUCAUUGGCCUUCCUGAG | 20 | 1931 |
| myoC-3359 | + | CUGGUCAUUGGCCUUCCUGAG | 21 | 3105 |
| myoC-3360 | + | UCUGGUCAUUGGCCUUCCUGAG | 22 | 3106 |
| myoC-3361 | + | CUCUGGUCAUUGGCCUUCCUGAG | 23 | 3107 |
| myoC-3362 | + | ACUCUGGUCAUUGGCCUUCCUGAG | 24 | 3108 |
| myoC-3363 | + | GCUCUCCAGGGAGCUGAG | 18 | 3109 |
| myoC-3364 | + | GGCUCUCCAGGGAGCUGAG | 19 | 3110 |
| myoC-1678 | + | AGGCUCUCCAGGGAGCUGAG | 20 | 1939 |
| myoC-3365 | + | GAGGCUCUCCAGGGAGCUGAG | 21 | 3111 |
| myoC-3366 | + | GGAGGCUCUCCAGGGAGCUGAG | 22 | 3112 |
| myoC-3367 | + | AGGAGGCUCUCCAGGGAGCUGAG | 23 | 3113 |
| myoC-3368 | + | GAGGAGGCUCUCCAGGGAGCUGAG | 24 | 3114 |
| myoC-3369 | + | CAGAACUGACUUGUCUCG | 18 | 3115 |
| myoC-3370 | + | CCAGAACUGACUUGUCUCG | 19 | 3116 |
| myoC-1693 | + | UCCAGAACUGACUUGUCUCG | 20 | 1948 |
| myoC-3371 | + | CUCCAGAACUGACUUGUCUCG | 21 | 3117 |
| myoC-3372 | + | CCUCCAGAACUGACUUGUCUCG | 22 | 3118 |
| myoC-3373 | + | UCCUCCAGAACUGACUUGUCUCG | 23 | 3119 |
| myoC-3374 | + | UUCCUCCAGAACUGACUUGUCUCG | 24 | 3120 |
| myoC-3375 | + | AGAACUGACUUGUCUCGG | 18 | 3121 |
| myoC-3376 | + | CAGAACUGACUUGUCUCGG | 19 | 3122 |
| myoC-209 | + | CCAGAACUGACUUGUCUCGG | 20 | 595 |
| myoC-3377 | + | UCCAGAACUGACUUGUCUCGG | 21 | 3123 |
| myoC-3378 | + | CUCCAGAACUGACUUGUCUCGG | 22 | 3124 |
| myoC-3379 | + | CCUCCAGAACUGACUUGUCUCGG | 23 | 3125 |

TABLE 7D-continued

4th Tier

| gRNA Name | DNA Strand | Targeting Domain | Target Site Length | SEQ ID NO |
|---|---|---|---|---|
| myoC-3380 | + | UCCUCCAGAACUGACUUGUCUCGG | 24 | 3126 |
| myoC-3381 | + | UCCAAGGUCAAUUGGUGG | 18 | 3127 |
| myoC-3382 | + | GUCCAAGGUCAAUUGGUGG | 19 | 3128 |
| myoC-121 | + | GGUCCAAGGUCAAUUGGUGG | 20 | 520 |
| myoC-3383 | + | UGGUCCAAGGUCAAUUGGUGG | 21 | 3129 |
| myoC-3384 | + | CUGGUCCAAGGUCAAUUGGUGG | 22 | 3130 |
| myoC-3385 | + | CCUGGUCCAAGGUCAAUUGGUGG | 23 | 3131 |
| myoC-3386 | + | GCCUGGUCCAAGGUCAAUUGGUGG | 24 | 3132 |
| myoC-3387 | + | UGGUCCAAGGUCAAUUGG | 18 | 3133 |
| myoC-3388 | + | CUGGUCCAAGGUCAAUUGG | 19 | 3134 |
| myoC-220 | + | CCUGGUCCAAGGUCAAUUGG | 20 | 606 |
| myoC-3389 | + | GCCUGGUCCAAGGUCAAUUGG | 21 | 3135 |
| myoC-3390 | + | AGCCUGGUCCAAGGUCAAUUGG | 22 | 3136 |
| myoC-3391 | + | CAGCCUGGUCCAAGGUCAAUUGG | 23 | 3137 |
| myoC-3392 | + | GCAGCCUGGUCCAAGGUCAAUUGG | 24 | 3138 |
| myoC-3393 | + | GUCCAAGGUCAAUUGGUG | 18 | 3139 |
| myoC-3394 | + | GGUCCAAGGUCAAUUGGUG | 19 | 3140 |
| myoC-1684 | + | UGGUCCAAGGUCAAUUGGUG | 20 | 1942 |
| myoC-3395 | + | CUGGUCCAAGGUCAAUUGGUG | 21 | 3141 |
| myoC-3396 | + | CCUGGUCCAAGGUCAAUUGGUG | 22 | 3142 |
| myoC-3397 | + | GCCUGGUCCAAGGUCAAUUGGUG | 23 | 3143 |
| myoC-3398 | + | AGCCUGGUCCAAGGUCAAUUGGUG | 24 | 3144 |
| myoC-3399 | + | CUGGUCCAAGGUCAAUUG | 18 | 3145 |
| myoC-3400 | + | CCUGGUCCAAGGUCAAUUG | 19 | 3146 |
| myoC-1686 | + | GCCUGGUCCAAGGUCAAUUG | 20 | 1943 |
| myoC-3401 | + | AGCCUGGUCCAAGGUCAAUUG | 21 | 3147 |
| myoC-3402 | + | CAGCCUGGUCCAAGGUCAAUUG | 22 | 3148 |
| myoC-3403 | + | GCAGCCUGGUCCAAGGUCAAUUG | 23 | 3149 |
| myoC-3404 | + | GGCAGCCUGGUCCAAGGUCAAUUG | 24 | 3150 |
| myoC-3405 | + | CACAGAAGAACCUCAUUG | 18 | 3151 |
| myoC-3406 | + | GCACAGAAGAACCUCAUUG | 19 | 3152 |
| myoC-1664 | + | UGCACAGAAGAACCUCAUUG | 20 | 1926 |
| myoC-3407 | + | GUGCACAGAAGAACCUCAUUG | 21 | 3153 |
| myoC-3408 | + | CGUGCACAGAAGAACCUCAUUG | 22 | 3154 |
| myoC-3409 | + | ACGUGCACAGAAGAACCUCAUUG | 23 | 3155 |
| myoC-3410 | + | AACGUGCACAGAAGAACCUCAUUG | 24 | 3156 |
| myoC-3411 | + | CCUCAUUGCAGAGGCUUG | 18 | 3157 |
| myoC-3412 | + | ACCUCAUUGCAGAGGCUUG | 19 | 3158 |

TABLE 7D-continued

| 4th Tier | | | | |
|---|---|---|---|---|
| gRNA Name | DNA Strand | Targeting Domain | Target Site Length | SEQ ID NO |
| myoC-1663 | + | AACCUCAUUGCAGAGGCUUG | 20 | 1925 |
| myoC-3413 | + | GAACCUCAUUGCAGAGGCUUG | 21 | 3159 |
| myoC-3414 | + | AGAACCUCAUUGCAGAGGCUUG | 22 | 3160 |
| myoC-3415 | + | AAGAACCUCAUUGCAGAGGCUUG | 23 | 3161 |
| myoC-3416 | + | GAAGAACCUCAUUGCAGAGGCUUG | 24 | 3162 |
| myoC-3417 | + | CUGGGCAGCUGGAUUCAU | 18 | 3163 |
| myoC-3418 | + | UCUGGGCAGCUGGAUUCAU | 19 | 3164 |
| myoC-231 | + | CUCUGGGCAGCUGGAUUCAU | 20 | 617 |
| myoC-3419 | + | GCUCUGGGCAGCUGGAUUCAU | 21 | 3165 |
| myoC-3420 | + | UGCUCUGGGCAGCUGGAUUCAU | 22 | 3166 |
| myoC-3421 | + | CUGCUCUGGGCAGCUGGAUUCAU | 23 | 3167 |
| myoC-3422 | + | UCUGCUCUGGGCAGCUGGAUUCAU | 24 | 3168 |
| myoC-3423 | + | GGCUUGGUGAGGCUUCCU | 18 | 3169 |
| myoC-3424 | + | AGGCUUGGUGAGGCUUCCU | 19 | 3170 |
| myoC-2357 | + | GAGGCUUGGUGAGGCUUCCU | 20 | 2411 |
| myoC-3425 | + | AGAGGCUUGGUGAGGCUUCCU | 21 | 3171 |
| myoC-3426 | + | CAGAGGCUUGGUGAGGCUUCCU | 22 | 3172 |
| myoC-3427 | + | GCAGAGGCUUGGUGAGGCUUCCU | 23 | 3173 |
| myoC-3428 | + | UGCAGAGGCUUGGUGAGGCUUCCU | 24 | 3174 |
| myoC-3429 | + | ACAUGGCCUGGCUCUGCU | 18 | 3175 |
| myoC-3430 | + | GACAUGGCCUGGCUCUGCU | 19 | 3176 |
| myoC-1675 | + | UGACAUGGCCUGGCUCUGCU | 20 | 1936 |
| myoC-3431 | + | CUGACAUGGCCUGGCUCUGCU | 21 | 3177 |
| myoC-3432 | + | ACUGACAUGGCCUGGCUCUGCU | 22 | 3178 |
| myoC-3433 | + | GACUGACAUGGCCUGGCUCUGCU | 23 | 3179 |
| myoC-3434 | + | UGACUGACAUGGCCUGGCUCUGCU | 24 | 3180 |
| myoC-3435 | + | UCCAGAACUGACUUGUCU | 18 | 3181 |
| myoC-3436 | + | CUCCAGAACUGACUUGUCU | 19 | 3182 |
| myoC-208 | + | CCUCCAGAACUGACUUGUCU | 20 | 594 |
| myoC-3437 | + | UCCUCCAGAACUGACUUGUCU | 21 | 3183 |
| myoC-3438 | + | UUCCUCCAGAACUGACUUGUCU | 22 | 3184 |
| myoC-3439 | + | CUUCCUCCAGAACUGACUUGUCU | 23 | 3185 |
| myoC-3440 | + | UCUUCCUCCAGAACUGACUUGUCU | 24 | 3186 |
| myoC-3441 | - | AGCGACUAAGGCAAGAAA | 18 | 3187 |
| myoC-3442 | - | AAGCGACUAAGGCAAGAAA | 19 | 3188 |
| myoC-1647 | - | GAAGCGACUAAGGCAAGAAA | 20 | 1913 |
| myoC-3443 | - | AGAAGCGACUAAGGCAAGAAA | 21 | 3189 |

TABLE 7D-continued

| 4th Tier | | | | |
|---|---|---|---|---|
| gRNA Name | DNA Strand | Targeting Domain | Target Site Length | SEQ ID NO |
| myoC-3444 | - | AAGAAGCGACUAAGGCAAGAAA | 22 | 3190 |
| myoC-3445 | - | GAAGAAGCGACUAAGGCAAGAAA | 23 | 3191 |
| myoC-3446 | - | AGAAGAAGCGACUAAGGCAAGAAA | 24 | 3192 |
| myoC-3447 | - | AAGUCAGUUCUGGAGGAA | 18 | 3193 |
| myoC-3448 | - | CAAGUCAGUUCUGGAGGAA | 19 | 3194 |
| myoC-1644 | - | ACAAGUCAGUUCUGGAGGAA | 20 | 1910 |
| myoC-3449 | - | GACAAGUCAGUUCUGGAGGAA | 21 | 3195 |
| myoC-3450 | - | AGACAAGUCAGUUCUGGAGGAA | 22 | 3196 |
| myoC-3451 | - | GAGACAAGUCAGUUCUGGAGGAA | 23 | 3197 |
| myoC-3452 | - | CGAGACAAGUCAGUUCUGGAGGAA | 24 | 3198 |
| myoC-3453 | - | AGUCAUCCAUAACUUACA | 18 | 3199 |
| myoC-3454 | - | CAGUCAUCCAUAACUUACA | 19 | 3200 |
| myoC-1608 | - | UCAGUCAUCCAUAACUUACA | 20 | 1888 |
| myoC-3455 | - | GUCAGUCAUCCAUAACUUACA | 21 | 3201 |
| myoC-3456 | - | UGUCAGUCAUCCAUAACUUACA | 22 | 3202 |
| myoC-3457 | - | AUGUCAGUCAUCCAUAACUUACA | 23 | 3203 |
| myoC-3458 | - | CAUGUCAGUCAUCCAUAACUUACA | 24 | 3204 |
| myoC-3459 | - | GACCCAGGAGGGGCUGCA | 18 | 3205 |
| myoC-3460 | - | AGACCCAGGAGGGGCUGCA | 19 | 3206 |
| myoC-1622 | - | GAGACCCAGGAGGGGCUGCA | 20 | 1897 |
| myoC-3461 | - | GGAGACCCAGGAGGGGCUGCA | 21 | 3207 |
| myoC-3462 | - | AGGAGACCCAGGAGGGGCUGCA | 22 | 3208 |
| myoC-3463 | - | CAGGAGACCCAGGAGGGGCUGCA | 23 | 3209 |
| myoC-3464 | - | CCAGGAGACCCAGGAGGGGCUGCA | 24 | 3210 |
| myoC-3465 | - | CCUCACCAAGCCUCUGCA | 18 | 3211 |
| myoC-3466 | - | GCCUCACCAAGCCUCUGCA | 19 | 3212 |
| myoC-1592 | - | AGCCUCACCAAGCCUCUGCA | 20 | 1876 |
| myoC-3467 | - | AAGCCUCACCAAGCCUCUGCA | 21 | 3213 |
| myoC-3468 | - | GAAGCCUCACCAAGCCUCUGCA | 22 | 3214 |
| myoC-3469 | - | GGAAGCCUCACCAAGCCUCUGCA | 23 | 3215 |
| myoC-3470 | - | AGGAAGCCUCACCAAGCCUCUGCA | 24 | 3216 |
| myoC-3471 | - | CCCAGGAGGGGCUGCAGA | 18 | 3217 |
| myoC-3472 | - | ACCCAGGAGGGGCUGCAGA | 19 | 3218 |
| myoC-99 | - | GACCCAGGAGGGGCUGCAGA | 20 | 504 |
| myoC-3473 | - | AGACCCAGGAGGGGCUGCAGA | 21 | 3219 |
| myoC-3474 | - | GAGACCCAGGAGGGGCUGCAGA | 22 | 3220 |
| myoC-3475 | - | GGAGACCCAGGAGGGGCUGCAGA | 23 | 3221 |
| myoC-3476 | - | AGGAGACCCAGGAGGGGCUGCAGA | 24 | 3222 |

TABLE 7D-continued

| 4th Tier | | | | |
|---|---|---|---|---|
| gRNA Name | DNA Strand | Targeting Domain | Target Site Length | SEQ ID NO |
| myoC-3477 | - | GGGCACCCUGAGGCGGGA | 18 | 3223 |
| myoC-3478 | - | UGGGCACCCUGAGGCGGGA | 19 | 3224 |
| myoC-1630 | - | CUGGGCACCCUGAGGCGGGA | 20 | 1901 |
| myoC-3479 | - | GCUGGGCACCCUGAGGCGGGA | 21 | 3225 |
| myoC-3480 | - | AGCUGGGCACCCUGAGGCGGGA | 22 | 3226 |
| myoC-3481 | - | GAGCUGGGCACCCUGAGGCGGGA | 23 | 3227 |
| myoC-3482 | - | GGAGCUGGGCACCCUGAGGCGGGA | 24 | 3228 |
| myoC-3483 | - | UCAGUCAUCCAUAACUUA | 18 | 3229 |
| myoC-3484 | - | GUCAGUCAUCCAUAACUUA | 19 | 3230 |
| myoC-1607 | - | UGUCAGUCAUCCAUAACUUA | 20 | 1887 |
| myoC-3485 | - | AUGUCAGUCAUCCAUAACUUA | 21 | 3231 |
| myoC-3486 | - | CAUGUCAGUCAUCCAUAACUUA | 22 | 3232 |
| myoC-3487 | - | CCAUGUCAGUCAUCCAUAACUUA | 23 | 3233 |
| myoC-3488 | - | GCCAUGUCAGUCAUCCAUAACUUA | 24 | 3234 |
| myoC-3489 | - | CCAGCUGGAAACCCAAAC | 18 | 3235 |
| myoC-3490 | - | ACCAGCUGGAAACCCAAAC | 19 | 3236 |
| myoC-1634 | - | GACCAGCUGGAAACCCAAAC | 20 | 1903 |
| myoC-3491 | - | GGACCAGCUGGAAACCCAAAC | 21 | 3237 |
| myoC-3492 | - | GGGACCAGCUGGAAACCCAAAC | 22 | 3238 |
| myoC-3493 | - | CGGGACCAGCUGGAAACCCAAAC | 23 | 3239 |
| myoC-3494 | - | GCGGGACCAGCUGGAAACCCAAAC | 24 | 3240 |
| myoC-3495 | - | AGCACCCAACGCUUAGAC | 18 | 3241 |
| myoC-3496 | - | CAGCACCCAACGCUUAGAC | 19 | 3242 |
| myoC-1609 | - | GCAGCACCCAACGCUUAGAC | 20 | 1889 |
| myoC-3497 | - | AGCAGCACCCAACGCUUAGAC | 21 | 3243 |
| myoC-3498 | - | CAGCAGCACCCAACGCUUAGAC | 22 | 3244 |
| myoC-3499 | - | ACAGCAGCACCCAACGCUUAGAC | 23 | 3245 |
| myoC-3500 | - | GACAGCAGCACCCAACGCUUAGAC | 24 | 3246 |
| myoC-3501 | - | CAGAGGGAGCUGGGCACC | 18 | 3247 |
| myoC-3502 | - | GCAGAGGGAGCUGGGCACC | 19 | 3248 |
| myoC-1626 | - | UGCAGAGGGAGCUGGGCACC | 20 | 1899 |
| myoC-3503 | - | CUGCAGAGGGAGCUGGGCACC | 21 | 3249 |
| myoC-3504 | - | GCUGCAGAGGGAGCUGGGCACC | 22 | 3250 |
| myoC-3505 | - | GGCUGCAGAGGGAGCUGGGCACC | 23 | 3251 |
| myoC-3506 | - | GGGCUGCAGAGGGAGCUGGGCACC | 24 | 3252 |
| myoC-3507 | - | GCCAGGCCCCAGGAGACC | 18 | 3253 |
| myoC-3508 | - | UGCCAGGCCCCAGGAGACC | 19 | 3254 |

TABLE 7D-continued

| 4th Tier | | | | |
|---|---|---|---|---|
| gRNA Name | DNA Strand | Targeting Domain | Target Site Length | SEQ ID NO |
| myoC-1617 | - | CUGCCAGGCCCCAGGAGACC | 20 | 1894 |
| myoC-3509 | - | GCUGCCAGGCCCCAGGAGACC | 21 | 3255 |
| myoC-3510 | - | GGCUGCCAGGCCCCAGGAGACC | 22 | 3256 |
| myoC-3511 | - | AGGCUGCCAGGCCCCAGGAGACC | 23 | 3257 |
| myoC-3512 | - | CAGGCUGCCAGGCCCCAGGAGACC | 24 | 3258 |
| myoC-3513 | - | GCACCCAACGCUUAGACC | 18 | 3259 |
| myoC-3514 | - | AGCACCCAACGCUUAGACC | 19 | 3260 |
| myoC-179 | - | CAGCACCCAACGCUUAGACC | 20 | 565 |
| myoC-3515 | - | GCAGCACCCAACGCUUAGACC | 21 | 3261 |
| myoC-3516 | - | AGCAGCACCCAACGCUUAGACC | 22 | 3262 |
| myoC-3517 | - | CAGCAGCACCCAACGCUUAGACC | 23 | 3263 |
| myoC-3518 | - | ACAGCAGCACCCAACGCUUAGACC | 24 | 3264 |
| myoC-3519 | - | CUCCUCCACCAAUUGACC | 18 | 3265 |
| myoC-3520 | - | CCUCCUCCACCAAUUGACC | 19 | 3266 |
| myoC-1614 | - | GCCUCCUCCACCAAUUGACC | 20 | 1892 |
| myoC-3521 | - | AGCCUCCUCCACCAAUUGACC | 21 | 3267 |
| myoC-3522 | - | GAGCCUCCUCCACCAAUUGACC | 22 | 3268 |
| myoC-3523 | - | AGAGCCUCCUCCACCAAUUGACC | 23 | 3269 |
| myoC-3524 | - | GAGAGCCUCCUCCACCAAUUGACC | 24 | 3270 |
| myoC-3525 | - | CCAGGCCCCAGGAGACCC | 18 | 3271 |
| myoC-3526 | - | GCCAGGCCCCAGGAGACCC | 19 | 3272 |
| myoC-185 | - | UGCCAGGCCCCAGGAGACCC | 20 | 571 |
| myoC-3527 | - | CUGCCAGGCCCCAGGAGACCC | 21 | 3273 |
| myoC-3528 | - | GCUGCCAGGCCCCAGGAGACCC | 22 | 3274 |
| myoC-3529 | - | GGCUGCCAGGCCCCAGGAGACCC | 23 | 3275 |
| myoC-3530 | - | AGGCUGCCAGGCCCCAGGAGACCC | 24 | 3276 |
| myoC-3531 | - | ACCAGGCUGCCAGGCCCC | 18 | 3277 |
| myoC-3532 | - | GACCAGGCUGCCAGGCCCC | 19 | 3278 |
| myoC-97 | - | GGACCAGGCUGCCAGGCCCC | 20 | 502 |
| myoC-3533 | - | UGGACCAGGCUGCCAGGCCCC | 21 | 3279 |
| myoC-3534 | - | UUGGACCAGGCUGCCAGGCCCC | 22 | 3280 |
| myoC-3535 | - | CUUGGACCAGGCUGCCAGGCCCC | 23 | 3281 |
| myoC-3536 | - | CCUUGGACCAGGCUGCCAGGCCCC | 24 | 3282 |
| myoC-3537 | - | GACCAGGCUGCCAGGCCC | 18 | 3283 |
| myoC-3538 | - | GGACCAGGCUGCCAGGCCC | 19 | 3284 |
| myoC-1615 | - | UGGACCAGGCUGCCAGGCCC | 20 | 1893 |
| myoC-3539 | - | UUGGACCAGGCUGCCAGGCCC | 21 | 3285 |
| myoC-3540 | - | CUUGGACCAGGCUGCCAGGCCC | 22 | 3286 |

TABLE 7D-continued

| 4th Tier | | | | |
|---|---|---|---|---|
| gRNA Name | DNA Strand | Targeting Domain | Target Site Length | SEQ ID NO |
| myoC-3541 | - | CCUUGGACCAGGCUGCCAGGCCC | 23 | 3287 |
| myoC-3542 | - | ACCUUGGACCAGGCUGCCAGGCCC | 24 | 3288 |
| myoC-3543 | - | AAGCUCGACUCAGCUCCC | 18 | 3289 |
| myoC-3544 | - | AAAGCUCGACUCAGCUCCC | 19 | 3290 |
| myoC-181 | - | CAAAGCUCGACUCAGCUCCC | 20 | 567 |
| myoC-3545 | - | CCAAAGCUCGACUCAGCUCCC | 21 | 3291 |
| myoC-3546 | - | ACCAAAGCUCGACUCAGCUCCC | 22 | 3292 |
| myoC-3547 | - | CACCAAAGCUCGACUCAGCUCCC | 23 | 3293 |
| myoC-3548 | - | CCACCAAAGCUCGACUCAGCUCCC | 24 | 3294 |
| myoC-3549 | - | GGUUGGAAAGCAGCAGCC | 18 | 3295 |
| myoC-3550 | - | AGGUUGGAAAGCAGCAGCC | 19 | 3296 |
| myoC-107 | - | GAGGUUGGAAAGCAGCAGCC | 20 | 511 |
| myoC-3551 | - | GGAGGUUGGAAAGCAGCAGCC | 21 | 3297 |
| myoC-3552 | - | AGGAGGUUGGAAAGCAGCAGCC | 22 | 3298 |
| myoC-3553 | - | CAGGAGGUUGGAAAGCAGCAGCC | 23 | 3299 |
| myoC-3554 | - | CCAGGAGGUUGGAAAGCAGCAGCC | 24 | 3300 |
| myoC-3555 | - | GAAAAUGAGAAUCUGGCC | 18 | 3301 |
| myoC-3556 | - | AGAAAAUGAGAAUCUGGCC | 19 | 3302 |
| myoC-195 | - | AAGAAAAUGAGAAUCUGGCC | 20 | 581 |
| myoC-3557 | - | CAAGAAAAUGAGAAUCUGGCC | 21 | 3303 |
| myoC-3558 | - | GCAAGAAAAUGAGAAUCUGGCC | 22 | 3304 |
| myoC-3559 | - | GGCAAGAAAAUGAGAAUCUGGCC | 23 | 3305 |
| myoC-3560 | - | AGGCAAGAAAAUGAGAAUCUGGCC | 24 | 3306 |
| myoC-3561 | - | CCAAUGAAUCCAGCUGCC | 18 | 3307 |
| myoC-3562 | - | CCCAAUGAAUCCAGCUGCC | 19 | 3308 |
| myoC-1605 | - | UCCCAAUGAAUCCAGCUGCC | 20 | 1885 |
| myoC-3563 | - | GUCCCAAUGAAUCCAGCUGCC | 21 | 3309 |
| myoC-3564 | - | AGUCCCAAUGAAUCCAGCUGCC | 22 | 3310 |
| myoC-3565 | - | CAGUCCCAAUGAAUCCAGCUGCC | 23 | 3311 |
| myoC-3566 | - | CCAGUCCCAAUGAAUCCAGCUGCC | 24 | 3312 |
| myoC-3567 | - | AAAGCUCGACUCAGCUCC | 18 | 3313 |
| myoC-3568 | - | CAAAGCUCGACUCAGCUCC | 19 | 3314 |
| myoC-1611 | - | CCAAAGCUCGACUCAGCUCC | 20 | 1890 |
| myoC-3569 | - | ACCAAAGCUCGACUCAGCUCC | 21 | 3315 |
| myoC-3570 | - | CACCAAAGCUCGACUCAGCUCC | 22 | 3316 |
| myoC-3571 | - | CCACCAAAGCUCGACUCAGCUCC | 23 | 3317 |
| myoC-3572 | - | GCCACCAAAGCUCGACUCAGCUCC | 24 | 3318 |

TABLE 7D-continued

| 4th Tier | | | | |
|---|---|---|---|---|
| gRNA Name | DNA Strand | Targeting Domain | Target Site Length | SEQ ID NO |
| myoC-3573 | - | GGCGGGAGCGGGACCAGC | 18 | 3319 |
| myoC-3574 | - | AGGCGGGAGCGGGACCAGC | 19 | 3320 |
| myoC-105 | - | GAGGCGGGAGCGGGACCAGC | 20 | 510 |
| myoC-3575 | - | UGAGGCGGGAGCGGGACCAGC | 21 | 3321 |
| myoC-3576 | - | CUGAGGCGGGAGCGGGACCAGC | 22 | 3322 |
| myoC-3577 | - | CCUGAGGCGGGAGCGGGACCAGC | 23 | 3323 |
| myoC-3578 | - | CCCUGAGGCGGGAGCGGGACCAGC | 24 | 3324 |
| myoC-3579 | - | AGGUUGGAAAGCAGCAGC | 18 | 3325 |
| myoC-3580 | - | GAGGUUGGAAAGCAGCAGC | 19 | 3326 |
| myoC-1653 | - | GGAGGUUGGAAAGCAGCAGC | 20 | 1917 |
| myoC-3581 | - | AGGAGGUUGGAAAGCAGCAGC | 21 | 3327 |
| myoC-3582 | - | CAGGAGGUUGGAAAGCAGCAGC | 22 | 3328 |
| myoC-3583 | - | CCAGGAGGUUGGAAAGCAGCAGC | 23 | 3329 |
| myoC-3584 | - | GCCAGGAGGUUGGAAAGCAGCAGC | 24 | 3330 |
| myoC-3585 | - | AGAAGAAGCGACUAAGGC | 18 | 3331 |
| myoC-3586 | - | GAGAAGAAGCGACUAAGGC | 19 | 3332 |
| myoC-1646 | - | AGAGAAGAAGCGACUAAGGC | 20 | 1912 |
| myoC-3587 | - | AAGAGAAGAAGCGACUAAGGC | 21 | 3333 |
| myoC-3588 | - | GAAGAGAAGAAGCGACUAAGGC | 22 | 3334 |
| myoC-3589 | - | GGAAGAGAAGAAGCGACUAAGGC | 23 | 3335 |
| myoC-3590 | - | AGGAAGAGAAGAAGCGACUAAGGC | 24 | 3336 |
| myoC-3591 | - | AGCUGGGCACCCUGAGGC | 18 | 3337 |
| myoC-3592 | - | GAGCUGGGCACCCUGAGGC | 19 | 3338 |
| myoC-103 | - | GGAGCUGGGCACCCUGAGGC | 20 | 508 |
| myoC-3593 | - | GGGAGCUGGGCACCCUGAGGC | 21 | 3339 |
| myoC-3594 | - | AGGGAGCUGGGCACCCUGAGGC | 22 | 3340 |
| myoC-3595 | - | GAGGGAGCUGGGCACCCUGAGGC | 23 | 3341 |
| myoC-3596 | - | AGAGGGAGCUGGGCACCCUGAGGC | 24 | 3342 |
| myoC-3597 | - | GGUGUGGGAUGUGGGGGC | 18 | 3343 |
| myoC-3598 | - | UGGUGUGGGAUGUGGGGGC | 19 | 3344 |
| myoC-1600 | - | CUGGUGUGGGAUGUGGGGGC | 20 | 1881 |
| myoC-3599 | - | CCUGGUGUGGGAUGUGGGGGC | 21 | 3345 |
| myoC-3600 | - | GCCUGGUGUGGGAUGUGGGGGC | 22 | 3346 |
| myoC-3601 | - | UGCCUGGUGUGGGAUGUGGGGGC | 23 | 3347 |
| myoC-3602 | - | CUGCCUGGUGUGGGAUGUGGGGGC | 24 | 3348 |
| myoC-3603 | - | GUUGCUGCAGCUUUGGGC | 18 | 3349 |
| myoC-3604 | - | CGUUGCUGCAGCUUUGGGC | 19 | 3350 |
| myoC-1594 | - | ACGUUGCUGCAGCUUUGGGC | 20 | 1878 |

TABLE 7D-continued

| 4th Tier | | | | |
|---|---|---|---|---|
| gRNA Name | DNA Strand | Targeting Domain | Target Site Length | SEQ ID NO |
| myoC-3605 | - | CACGUUGCUGCAGCUUUGGGC | 21 | 3351 |
| myoC-3606 | - | GCACGUUGCUGCAGCUUUGGGC | 22 | 3352 |
| myoC-3607 | - | UGCACGUUGCUGCAGCUUUGGGC | 23 | 3353 |
| myoC-3608 | - | GUGCACGUUGCUGCAGCUUUGGGC | 24 | 3354 |
| myoC-3609 | - | AGAAAAUGAGAAUCUGGC | 18 | 3355 |
| myoC-3610 | - | AAGAAAAUGAGAAUCUGGC | 19 | 3356 |
| myoC-1649 | - | CAAGAAAAUGAGAAUCUGGC | 20 | 1915 |
| myoC-3611 | - | GCAAGAAAAUGAGAAUCUGGC | 21 | 3357 |
| myoC-3612 | - | GGCAAGAAAAUGAGAAUCUGGC | 22 | 3358 |
| myoC-3613 | - | AGGCAAGAAAAUGAGAAUCUGGC | 23 | 3359 |
| myoC-3614 | - | AAGGCAAGAAAAUGAGAAUCUGGC | 24 | 3360 |
| myoC-3615 | - | GCCAGGACAGCUCAGCUC | 18 | 3361 |
| myoC-3616 | - | GGCCAGGACAGCUCAGCUC | 19 | 3362 |
| myoC-96 | - | GGGCCAGGACAGCUCAGCUC | 20 | 501 |
| myoC-3617 | - | GGGGCCAGGACAGCUCAGCUC | 21 | 3363 |
| myoC-3618 | - | GGGGGCCAGGACAGCUCAGCUC | 22 | 3364 |
| myoC-3619 | - | UGGGGGCCAGGACAGCUCAGCUC | 23 | 3365 |
| myoC-3620 | - | GUGGGGGCCAGGACAGCUCAGCUC | 24 | 3366 |
| myoC-3621 | - | UCCGAGACAAGUCAGUUC | 18 | 3367 |
| myoC-3622 | - | CUCCGAGACAAGUCAGUUC | 19 | 3368 |
| myoC-191 | - | CCUCCGAGACAAGUCAGUUC | 20 | 577 |
| myoC-3623 | - | UCCUCCGAGACAAGUCAGUUC | 21 | 3369 |
| myoC-3624 | - | CUCCUCCGAGACAAGUCAGUUC | 22 | 3370 |
| myoC-3625 | - | CCUCCUCCGAGACAAGUCAGUUC | 23 | 3371 |
| myoC-3626 | - | ACCUCCUCCGAGACAAGUCAGUUC | 24 | 3372 |
| myoC-3627 | - | AGGCGGGAGCGGGACCAG | 18 | 3373 |
| myoC-3628 | - | GAGGCGGGAGCGGGACCAG | 19 | 3374 |
| myoC-1632 | - | UGAGGCGGGAGCGGGACCAG | 20 | 1902 |
| myoC-3629 | - | CUGAGGCGGGAGCGGGACCAG | 21 | 3375 |
| myoC-3630 | - | CCUGAGGCGGGAGCGGGACCAG | 22 | 3376 |
| myoC-3631 | - | CCCUGAGGCGGGAGCGGGACCAG | 23 | 3377 |
| myoC-3632 | - | ACCCUGAGGCGGGAGCGGGACCAG | 24 | 3378 |
| myoC-3633 | - | AGGCCCCAGGAGACCCAG | 18 | 3379 |
| myoC-3634 | - | CAGGCCCCAGGAGACCCAG | 19 | 3380 |
| myoC-1619 | - | CCAGGCCCCAGGAGACCCAG | 20 | 1895 |
| myoC-3635 | - | GCCAGGCCCCAGGAGACCCAG | 21 | 3381 |
| myoC-3636 | - | UGCCAGGCCCCAGGAGACCCAG | 22 | 3382 |

TABLE 7D-continued

| 4th Tier | | | | |
|---|---|---|---|---|
| gRNA Name | DNA Strand | Targeting Domain | Target Site Length | SEQ ID NO |
| myoC-3637 | - | CUGCCAGGCCCCAGGAGACCCAG | 23 | 3383 |
| myoC-3638 | - | GCUGCCAGGCCCCAGGAGACCCAG | 24 | 3384 |
| myoC-3639 | - | ACCCAGGAGGGGCUGCAG | 18 | 3385 |
| myoC-3640 | - | GACCCAGGAGGGGCUGCAG | 19 | 3386 |
| myoC-188 | - | AGACCCAGGAGGGGCUGCAG | 20 | 574 |
| myoC-3641 | - | GAGACCCAGGAGGGGCUGCAG | 21 | 3387 |
| myoC-3642 | - | GGAGACCCAGGAGGGGCUGCAG | 22 | 3388 |
| myoC-3643 | - | AGGAGACCCAGGAGGGGCUGCAG | 23 | 3389 |
| myoC-3644 | - | CAGGAGACCCAGGAGGGGCUGCAG | 24 | 3390 |
| myoC-3645 | - | UCAGUUCUGGAGGAAGAG | 18 | 3391 |
| myoC-3646 | - | GUCAGUUCUGGAGGAAGAG | 19 | 3392 |
| myoC-1645 | - | AGUCAGUUCUGGAGGAAGAG | 20 | 1911 |
| myoC-3647 | - | AAGUCAGUUCUGGAGGAAGAG | 21 | 3393 |
| myoC-3648 | - | CAAGUCAGUUCUGGAGGAAGAG | 22 | 3394 |
| myoC-3649 | - | ACAAGUCAGUUCUGGAGGAAGAG | 23 | 3395 |
| myoC-3650 | - | GACAAGUCAGUUCUGGAGGAAGAG | 24 | 3396 |
| myoC-3651 | - | GAAUCCAGCUGCCCAGAG | 18 | 3397 |
| myoC-3652 | - | UGAAUCCAGCUGCCCAGAG | 19 | 3398 |
| myoC-1606 | - | AUGAAUCCAGCUGCCCAGAG | 20 | 1886 |
| myoC-3653 | - | AAUGAAUCCAGCUGCCCAGAG | 21 | 3399 |
| myoC-3654 | - | CAAUGAAUCCAGCUGCCCAGAG | 22 | 3400 |
| myoC-3655 | - | CCAAUGAAUCCAGCUGCCCAGAG | 23 | 3401 |
| myoC-3656 | - | CCCAAUGAAUCCAGCUGCCCAGAG | 24 | 3402 |
| myoC-3657 | - | GAAACCCAAACCAGAGAG | 18 | 3403 |
| myoC-3658 | - | GGAAACCCAAACCAGAGAG | 19 | 3404 |
| myoC-1636 | - | UGGAAACCCAAACCAGAGAG | 20 | 1905 |
| myoC-3659 | - | CUGGAAACCCAAACCAGAGAG | 21 | 3405 |
| myoC-3660 | - | GCUGGAAACCCAAACCAGAGAG | 22 | 3406 |
| myoC-3661 | - | AGCUGGAAACCCAAACCAGAGAG | 23 | 3407 |
| myoC-3662 | - | CAGCUGGAAACCCAAACCAGAGAG | 24 | 3408 |
| myoC-3663 | - | GAGGGGCUGCAGAGGGAG | 18 | 3409 |
| myoC-3664 | - | GGAGGGGCUGCAGAGGGAG | 19 | 3410 |
| myoC-1625 | - | AGGAGGGGCUGCAGAGGGAG | 20 | 1898 |
| myoC-3665 | - | CAGGAGGGGCUGCAGAGGGAG | 21 | 3411 |
| myoC-3666 | - | CCAGGAGGGGCUGCAGAGGGAG | 22 | 3412 |
| myoC-3667 | - | CCCAGGAGGGGCUGCAGAGGGAG | 23 | 3413 |
| myoC-3668 | - | ACCCAGGAGGGGCUGCAGAGGGAG | 24 | 3414 |
| myoC-3669 | - | GGCACCCUGAGGCGGGAG | 18 | 3415 |

TABLE 7D-continued

| 4th Tier | | | | |
|---|---|---|---|---|
| gRNA Name | DNA Strand | Targeting Domain | Target Site Length | SEQ ID NO |
| myoC-3670 | – | GGGCACCCUGAGGCGGGAG | 19 | 3416 |
| myoC-190 | – | UGGGCACCCUGAGGCGGGAG | 20 | 576 |
| myoC-3671 | – | CUGGGCACCCUGAGGCGGGAG | 21 | 3417 |
| myoC-3672 | – | GCUGGGCACCCUGAGGCGGGAG | 22 | 3418 |
| myoC-3673 | – | AGCUGGGCACCCUGAGGCGGGAG | 23 | 3419 |
| myoC-3674 | – | GAGCUGGGCACCCUGAGGCGGGAG | 24 | 3420 |
| myoC-3675 | – | GGAGCUGGGCACCCUGAG | 18 | 3421 |
| myoC-3676 | – | GGGAGCUGGGCACCCUGAG | 19 | 3422 |
| myoC-1627 | – | AGGGAGCUGGGCACCCUGAG | 20 | 1900 |
| myoC-3677 | – | GAGGGAGCUGGGCACCCUGAG | 21 | 3423 |
| myoC-3678 | – | AGAGGGAGCUGGGCACCCUGAG | 22 | 3424 |
| myoC-3679 | – | CAGAGGGAGCUGGGCACCCUGAG | 23 | 3425 |
| myoC-3680 | – | GCAGAGGGAGCUGGGCACCCUGAG | 24 | 3426 |
| myoC-3681 | – | GGCCCCAGGAGACCCAGG | 18 | 3427 |
| myoC-3682 | – | AGGCCCCAGGAGACCCAGG | 19 | 3428 |
| myoC-186 | – | CAGGCCCCAGGAGACCCAGG | 20 | 572 |
| myoC-3683 | – | CCAGGCCCCAGGAGACCCAGG | 21 | 3429 |
| myoC-3684 | – | GCCAGGCCCCAGGAGACCCAGG | 22 | 3430 |
| myoC-3685 | – | UGCCAGGCCCCAGGAGACCCAGG | 23 | 3431 |
| myoC-3686 | – | CUGCCAGGCCCCAGGAGACCCAGG | 24 | 3432 |
| myoC-3687 | – | GAGAAUCUGGCCAGGAGG | 18 | 3433 |
| myoC-3688 | – | UGAGAAUCUGGCCAGGAGG | 19 | 3434 |
| myoC-1651 | – | AUGAGAAUCUGGCCAGGAGG | 20 | 1916 |
| myoC-3689 | – | AAUGAGAAUCUGGCCAGGAGG | 21 | 3435 |
| myoC-3690 | – | AAAUGAGAAUCUGGCCAGGAGG | 22 | 3436 |
| myoC-3691 | – | AAAAUGAGAAUCUGGCCAGGAGG | 23 | 3437 |
| myoC-3692 | – | GAAAAUGAGAAUCUGGCCAGGAGG | 24 | 3438 |
| myoC-3693 | – | ACAAGUCAGUUCUGGAGG | 18 | 3439 |
| myoC-3694 | – | GACAAGUCAGUUCUGGAGG | 19 | 3440 |
| myoC-1643 | – | AGACAAGUCAGUUCUGGAGG | 20 | 1909 |
| myoC-3695 | – | GAGACAAGUCAGUUCUGGAGG | 21 | 3441 |
| myoC-3696 | – | CGAGACAAGUCAGUUCUGGAGG | 22 | 3442 |
| myoC-3697 | – | CCGAGACAAGUCAGUUCUGGAGG | 23 | 3443 |
| myoC-3698 | – | UCCGAGACAAGUCAGUUCUGGAGG | 24 | 3444 |
| myoC-3699 | – | GAGCUGGGCACCCUGAGG | 18 | 3445 |
| myoC-3700 | – | GGAGCUGGGCACCCUGAGG | 19 | 3446 |
| myoC-102 | – | GGGAGCUGGGCACCCUGAGG | 20 | 507 |

TABLE 7D-continued

| 4th Tier | | | | |
|---|---|---|---|---|
| gRNA Name | DNA Strand | Targeting Domain | Target Site Length | SEQ ID NO |
| myoC-3701 | - | AGGGAGCUGGGCACCCUGAGG | 21 | 3447 |
| myoC-3702 | - | GAGGGAGCUGGGCACCCUGAGG | 22 | 3448 |
| myoC-3703 | - | AGAGGGAGCUGGGCACCCUGAGG | 23 | 3449 |
| myoC-3704 | - | CAGAGGGAGCUGGGCACCCUGAGG | 24 | 3450 |
| myoC-3705 | - | GAGACAAGUCAGUUCUGG | 18 | 3451 |
| myoC-3706 | - | CGAGACAAGUCAGUUCUGG | 19 | 3452 |
| myoC-192 | - | CCGAGACAAGUCAGUUCUGG | 20 | 578 |
| myoC-3707 | - | UCCGAGACAAGUCAGUUCUGG | 21 | 3453 |
| myoC-3708 | - | CUCCGAGACAAGUCAGUUCUGG | 22 | 3454 |
| myoC-3709 | - | CCUCCGAGACAAGUCAGUUCUGG | 23 | 3455 |
| myoC-3710 | - | UCCUCCGAGACAAGUCAGUUCUGG | 24 | 3456 |
| myoC-3711 | - | CCUGCCUGGUGUGGGAUG | 18 | 3457 |
| myoC-3712 | - | GCCUGCCUGGUGUGGGAUG | 19 | 3458 |
| myoC-94 | - | GGCCUGCCUGGUGUGGGAUG | 20 | 499 |
| myoC-3713 | - | UGGCCUGCCUGGUGUGGGAUG | 21 | 3459 |
| myoC-3714 | - | CUGGCCUGCCUGGUGUGGGAUG | 22 | 3460 |
| myoC-3715 | - | UCUGGCCUGCCUGGUGUGGGAUG | 23 | 3461 |
| myoC-3716 | - | UUCUGGCCUGCCUGGUGUGGGAUG | 24 | 3462 |
| myoC-3717 | - | GCUCGACUCAGCUCCCUG | 18 | 3463 |
| myoC-3718 | - | AGCUCGACUCAGCUCCCUG | 19 | 3464 |
| myoC-1613 | - | AAGCUCGACUCAGCUCCCUG | 20 | 1891 |
| myoC-3719 | - | AAAGCUCGACUCAGCUCCCUG | 21 | 3465 |
| myoC-3720 | - | CAAAGCUCGACUCAGCUCCCUG | 22 | 3466 |
| myoC-3721 | - | CCAAAGCUCGACUCAGCUCCCUG | 23 | 3467 |
| myoC-3722 | - | ACCAAAGCUCGACUCAGCUCCCUG | 24 | 3468 |
| myoC-3723 | - | GAGACCCAGGAGGGGCUG | 18 | 3469 |
| myoC-3724 | - | GGAGACCCAGGAGGGGCUG | 19 | 3470 |
| myoC-1621 | - | AGGAGACCCAGGAGGGGCUG | 20 | 1896 |
| myoC-3725 | - | CAGGAGACCCAGGAGGGGCUG | 21 | 3471 |
| myoC-3726 | - | CCAGGAGACCCAGGAGGGGCUG | 22 | 3472 |
| myoC-3727 | - | CCCAGGAGACCCAGGAGGGGCUG | 23 | 3473 |
| myoC-3728 | - | CCCCAGGAGACCCAGGAGGGGCUG | 24 | 3474 |
| myoC-3729 | - | CGAGACAAGUCAGUUCUG | 18 | 3475 |
| myoC-3730 | - | CCGAGACAAGUCAGUUCUG | 19 | 3476 |
| myoC-1641 | - | UCCGAGACAAGUCAGUUCUG | 20 | 1908 |
| myoC-3731 | - | CUCCGAGACAAGUCAGUUCUG | 21 | 3477 |
| myoC-3732 | - | CCUCCGAGACAAGUCAGUUCUG | 22 | 3478 |
| myoC-3733 | - | UCCUCCGAGACAAGUCAGUUCUG | 23 | 3479 |

TABLE 7D-continued

| 4th Tier | | | | |
|---|---|---|---|---|
| gRNA Name | DNA Strand | Targeting Domain | Target Site Length | SEQ ID NO |
| myoC-3734 | - | CUCCUCCGAGACAAGUCAGUUCUG | 24 | 3480 |
| myoC-3735 | - | GCCUGCCUGGUGUGGGAU | 18 | 3481 |
| myoC-3736 | - | GGCCUGCCUGGUGUGGGAU | 19 | 3482 |
| myoC-1597 | - | UGGCCUGCCUGGUGUGGGAU | 20 | 1880 |
| myoC-3737 | - | CUGGCCUGCCUGGUGUGGGAU | 21 | 3483 |
| myoC-3738 | - | UCUGGCCUGCCUGGUGUGGGAU | 22 | 3484 |
| myoC-3739 | - | UUCUGGCCUGCCUGGUGUGGGAU | 23 | 3485 |
| myoC-3740 | - | CUUCUGGCCUGCCUGGUGUGGGAU | 24 | 3486 |
| myoC-3741 | - | UGCCUACAGCAACCUCCU | 18 | 3487 |
| myoC-3742 | - | CUGCCUACAGCAACCUCCU | 19 | 3488 |
| myoC-1638 | - | ACUGCCUACAGCAACCUCCU | 20 | 1906 |
| myoC-3743 | - | GACUGCCUACAGCAACCUCCU | 21 | 3489 |
| myoC-3744 | - | AGACUGCCUACAGCAACCUCCU | 22 | 3490 |
| myoC-3745 | - | GAGACUGCCUACAGCAACCUCCU | 23 | 3491 |
| myoC-3746 | - | GGAGACUGCCUACAGCAACCUCCU | 24 | 3492 |
| myoC-3747 | - | GUGCACGUUGCUGCAGCU | 18 | 3493 |
| myoC-3748 | - | UGUGCACGUUGCUGCAGCU | 19 | 3494 |
| myoC-1593 | - | CUGUGCACGUUGCUGCAGCU | 20 | 1877 |
| myoC-3749 | - | UCUGUGCACGUUGCUGCAGCU | 21 | 3495 |
| myoC-3750 | - | UUCUGUGCACGUUGCUGCAGCU | 22 | 3496 |
| myoC-3751 | - | CUUCUGUGCACGUUGCUGCAGCU | 23 | 3497 |
| myoC-3752 | - | UCUUCUGUGCACGUUGCUGCAGCU | 24 | 3498 |
| myoC-3753 | - | GGCCAGGACAGCUCAGCU | 18 | 3499 |
| myoC-3754 | - | GGGCCAGGACAGCUCAGCU | 19 | 3500 |
| myoC-1601 | - | GGGGCCAGGACAGCUCAGCU | 20 | 1882 |
| myoC-3755 | - | GGGGGCCAGGACAGCUCAGCU | 21 | 3501 |
| myoC-3756 | - | UGGGGGCCAGGACAGCUCAGCU | 22 | 3502 |
| myoC-3757 | - | GUGGGGGCCAGGACAGCUCAGCU | 23 | 3503 |
| myoC-3758 | - | UGUGGGGGCCAGGACAGCUCAGCU | 24 | 3504 |
| myoC-3759 | - | AAACCCAAACCAGAGAGU | 18 | 3505 |
| myoC-3760 | - | GAAACCCAAACCAGAGAGU | 19 | 3506 |
| myoC-106 | - | GGAAACCCAAACCAGAGAGU | 20 | 479 |
| myoC-3761 | - | UGGAAACCCAAACCAGAGAGU | 21 | 3507 |
| myoC-3762 | - | CUGGAAACCCAAACCAGAGAGU | 22 | 3508 |
| myoC-3763 | - | GCUGGAAACCCAAACCAGAGAGU | 23 | 3509 |
| myoC-3764 | - | AGCUGGAAACCCAAACCAGAGAGU | 24 | 3510 |
| myoC-3765 | - | AGAAUCUGGCCAGGAGGU | 18 | 3511 |

TABLE 7D-continued

| 4th Tier | | | | |
|---|---|---|---|---|
| gRNA Name | DNA Strand | Targeting Domain | Target Site Length | SEQ ID NO |
| myoC-3766 | - | GAGAAUCUGGCCAGGAGGU | 19 | 3512 |
| myoC-197 | - | UGAGAAUCUGGCCAGGAGGU | 20 | 583 |
| myoC-3767 | - | AUGAGAAUCUGGCCAGGAGGU | 21 | 3513 |
| myoC-3768 | - | AAUGAGAAUCUGGCCAGGAGGU | 22 | 3514 |
| myoC-3769 | - | AAAUGAGAAUCUGGCCAGGAGGU | 23 | 3515 |
| myoC-3770 | - | AAAAUGAGAAUCUGGCCAGGAGGU | 24 | 3516 |
| myoC-3771 | - | GCUUCUGGCCUGCCUGGU | 18 | 3517 |
| myoC-3772 | - | UGCUUCUGGCCUGCCUGGU | 19 | 3518 |
| myoC-1595 | - | CUGCUUCUGGCCUGCCUGGU | 20 | 1879 |
| myoC-3773 | - | GCUGCUUCUGGCCUGCCUGGU | 21 | 3519 |
| myoC-3774 | - | UGCUGCUUCUGGCCUGCCUGGU | 22 | 3520 |
| myoC-3775 | - | CUGCUGCUUCUGGCCUGCCUGGU | 23 | 3521 |
| myoC-3776 | - | GCUGCUGCUUCUGGCCUGCCUGGU | 24 | 3522 |
| myoC-3777 | - | CUGCCUGGUGUGGGAUGU | 18 | 3523 |
| myoC-3778 | - | CCUGCCUGGUGUGGGAUGU | 19 | 3524 |
| myoC-95 | - | GCCUGCCUGGUGUGGGAUGU | 20 | 500 |
| myoC-3779 | - | GGCCUGCCUGGUGUGGGAUGU | 21 | 3525 |
| myoC-3780 | - | UGGCCUGCCUGGUGUGGGAUGU | 22 | 3526 |
| myoC-3781 | - | CUGGCCUGCCUGGUGUGGGAUGU | 23 | 3527 |
| myoC-3782 | - | UCUGGCCUGCCUGGUGUGGGAUGU | 24 | 3528 |
| myoC-3783 | - | CUCCGAGACAAGUCAGUU | 18 | 3529 |
| myoC-3784 | - | CCUCCGAGACAAGUCAGUU | 19 | 3530 |
| myoC-1639 | - | UCCUCCGAGACAAGUCAGUU | 20 | 1907 |
| myoC-3785 | - | CUCCUCCGAGACAAGUCAGUU | 21 | 3531 |
| myoC-3786 | - | CCUCCUCCGAGACAAGUCAGUU | 22 | 3532 |
| myoC-3787 | - | ACCUCCUCCGAGACAAGUCAGUU | 23 | 3533 |
| myoC-3788 | - | AACCUCCUCCGAGACAAGUCAGUU | 24 | 3534 |

Table 7E provides exemplary targeting domains for knocking out the MYOC gene selected according to the fifth tier parameters. The targeting domains fall in the coding sequence of the gene, downstream of the first 500 bp of coding sequence (e.g., anywhere from +500 (relative to the start codon) to the stop codon of the gene), start with a 5' G and PAM is NNGRRT. It is contemplated herein that in an embodiment the targeting domain hybridizes to the target domain through complementary base pairing. Any of the targeting domains in the Table 1 can be used with a *S. aureus* Cas9 molecule that generates a double stranded break (Cas9 nuclease) or a single-stranded break (Cas9 nickase).

TABLE 7E

| 5th Tier | | | | |
|---|---|---|---|---|
| gRNA Name | DNA Strand | Targeting Domain | Target Site Length | SEQ ID NO |
| myoC-3789 | + | GUACUUAUAGCGGUUCUUGAA | 21 | 3535 |
| myoC-3790 | + | GCUGUACUUAUAGCGGUUCUUGAA | 24 | 3536 |

TABLE 7E-continued

| 5th Tier | | | | |
|---|---|---|---|---|
| gRNA Name | DNA Strand | Targeting Domain | Target Site Length | SEQ ID NO |
| myoC-3791 | + | GCAAAGAGCUUCUUCUCCA | 19 | 3537 |
| myoC-62 | + | GGCAAAGAGCUUCUUCUCCA | 20 | 448 |
| myoC-3792 | + | GAAAAUUUUAUUUCACAAUGUA | 22 | 3538 |
| myoC-3793 | + | GUCAAUGUCCGUGUAGCCACCCC | 23 | 3539 |
| myoC-3794 | + | GUCCGUGGUAGCCAGCUCC | 19 | 3540 |
| myoC-3795 | + | GAACUGUCCGUGGUAGCCAGCUCC | 24 | 3541 |
| myoC-3796 | + | GCCCUGGAAAUAGAGGCUCC | 20 | 3542 |
| myoC-3797 | + | GCGCCCUGGAAAUAGAGGCUCC | 22 | 3543 |
| myoC-3798 | + | GAUUCUCCACGUGGUCUC | 18 | 3544 |
| myoC-3799 | + | GUCGAUUCUCCACGUGGUCUC | 21 | 3545 |
| myoC-3800 | + | GUGUCGAUUCUCCACGUGGUCUC | 23 | 3546 |
| myoC-3801 | + | GCACAGCCCGAGCAGUGUC | 19 | 3547 |
| myoC-1700 | + | GGCACAGCCCGAGCAGUGUC | 20 | 1952 |
| myoC-3802 | + | GUGGCACAGCCCGAGCAGUGUC | 22 | 3548 |
| myoC-3803 | + | GGUGGCACAGCCCGAGCAGUGUC | 23 | 3549 |
| myoC-3804 | + | GCCCUCAGACUACAAUUC | 18 | 3550 |
| myoC-3805 | + | GUCUACGCCCUCAGACUACAAUUC | 24 | 3551 |
| myoC-3806 | + | GCUGUACUUAUAGCGGUUC | 19 | 3552 |
| myoC-3807 | + | GCUGCUGUACUUAUAGCGGUUC | 22 | 3553 |
| myoC-3808 | + | GCAGUAUGUGAACCUUAG | 18 | 3554 |
| myoC-3809 | + | GGCAGUAUGUGAACCUUAG | 19 | 3555 |
| myoC-3810 | + | GCCUAGGCAGUAUGUGAACCUUAG | 24 | 3556 |
| myoC-3811 | + | GUGUAGGGGUAGGUGGGCU | 19 | 3557 |
| myoC-478 | + | GGUGUAGGGGUAGGUGGGCU | 20 | 820 |
| myoC-3812 | + | GGGUGUAGGGGUAGGUGGGCU | 21 | 3558 |
| myoC-3813 | + | GUUCGAGUUCCAGAUUCU | 18 | 3559 |
| myoC-3814 | + | GUUUGUUCGAGUUCCAGAUUCU | 22 | 3560 |
| myoC-3815 | + | GGUUUGUUCGAGUUCCAGAUUCU | 23 | 3561 |
| myoC-3816 | + | GUUCUUGAAUGGGAUGGU | 18 | 3562 |
| myoC-3817 | + | GGUUCUUGAAUGGGAUGGU | 19 | 3563 |
| myoC-3818 | + | GCGGUUCUUGAAUGGGAUGGU | 21 | 3564 |
| myoC-3819 | + | GUUUGUCUCCCAGGUUUGU | 19 | 3565 |
| myoC-3820 | + | GAUGUUUGUCUCCCAGGUUUGU | 22 | 3566 |
| myoC-3821 | + | GGAUGUUUGUCUCCCAGGUUUGU | 23 | 3567 |
| myoC-3822 | + | GUGACCAUGUUCAUCCUU | 18 | 3568 |
| myoC-3823 | + | GGUGACCAUGUUCAUCCUU | 19 | 3569 |
| myoC-3824 | + | GAUGGUGACCAUGUUCAUCCUU | 22 | 3570 |

TABLE 7E-continued

| 5th Tier | | | | |
|---|---|---|---|---|
| gRNA Name | DNA Strand | Targeting Domain | Target Site Length | SEQ ID NO |
| myoC-3000 | + | GCAUUGGCGACUGACUGCUU | 20 | 2793 |
| myoC-3825 | + | GGCAUUGGCGACUGACUGCUU | 21 | 3571 |
| myoC-3826 | + | GAAGGCAUUGGCGACUGACUGCUU | 24 | 3572 |
| myoC-3827 | - | GUCCUCUCCAAACUGAACCCA | 21 | 3573 |
| myoC-3828 | - | GAAUAGCUCCUCUGGCCAGCA | 21 | 3574 |
| myoC-3829 | - | GCAGAAUAGCUCCUCUGGCCAGCA | 24 | 3575 |
| myoC-3830 | - | GGCUUCUAAUGCUUCAGA | 18 | 3576 |
| myoC-3831 | - | GUUGGCUUCUAAUGCUUCAGA | 21 | 3577 |
| myoC-3832 | - | GUUUUCUUUUCUGAAUUUAC | 20 | 3578 |
| myoC-3833 | - | GCCUAGGCCACUGGAAAGC | 19 | 3579 |
| myoC-3834 | - | GAGAAUCGACACAGUUGGC | 19 | 3580 |
| myoC-3835 | - | GGAGAAUCGACACAGUUGGC | 20 | 3581 |
| myoC-3836 | - | GUGGAGAAUCGACACAGUUGGC | 22 | 3582 |
| myoC-3837 | - | GAGCCCAUCUGGCUAUCUC | 19 | 3583 |
| myoC-3838 | - | GAGAGCCCAUCUGGCUAUCUC | 21 | 3584 |
| myoC-3839 | - | GGAGAGCCCAUCUGGCUAUCUC | 22 | 3585 |
| myoC-3840 | - | GUCACCAUCUAACUAUUC | 18 | 3586 |
| myoC-3841 | - | GGUCACCAUCUAACUAUUC | 19 | 3587 |
| myoC-3842 | - | GCUAACUGAAGUUCCUGCUUC | 21 | 3588 |
| myoC-3843 | - | GAGCUAACUGAAGUUCCUGCUUC | 23 | 3589 |
| myoC-3844 | - | GCAUAACUUCUAAAGGAAG | 19 | 3590 |
| myoC-3845 | - | GCUUCAGAUAGAAUACAG | 18 | 3591 |
| myoC-2905 | - | GAACUGUCAUAAGAUAUGAG | 20 | 1807 |
| myoC-3846 | - | GCCUCUAUUUCCAGGGCG | 18 | 3592 |
| myoC-3847 | - | GAGCCUCUAUUUCCAGGGCG | 20 | 3593 |
| myoC-3848 | - | GGAGCCUCUAUUUCCAGGGCG | 21 | 3594 |
| myoC-3849 | - | GGGAGCCUCUAUUUCCAGGGCG | 22 | 3595 |
| myoC-3850 | - | GGGGAGCCUCUAUUUCCAGGGCG | 23 | 3596 |
| myoC-3851 | - | GCUCCAGAGAAGGUAAGAAUG | 21 | 3597 |
| myoC-3852 | - | GGCUCCAGAGAAGGUAAGAAUG | 22 | 3598 |
| myoC-3853 | - | GAAUGCAGAGUGGGGGACU | 20 | 3599 |
| myoC-3854 | - | GUAAGAAUGCAGAGUGGGGGACU | 24 | 3600 |
| myoC-2920 | - | GCUGUGGAUGAAGCAGGCCU | 20 | 1819 |
| myoC-3855 | - | GGCUGUGGAUGAAGCAGGCCU | 21 | 3601 |
| myoC-3856 | - | GCUACACGGACAUUGACUUGGCU | 23 | 3602 |
| myoC-3857 | - | GGCUACACGGACAUUGACUUGGCU | 24 | 3603 |
| myoC-3858 | - | GGACAGUUCCCGUAUUCU | 18 | 3604 |
| myoC-3859 | - | GCCACCAGGCUCCAGAGAAGGU | 22 | 3605 |

TABLE 7E-continued

| 5th Tier | | | | |
|---|---|---|---|---|
| gRNA Name | DNA Strand | Targeting Domain | Target Site Length | SEQ ID NO |
| myoC-3860 | - | GUGCCACCAGGCUCCAGAGAAGGU | 24 | 3606 |
| myoC-3861 | - | GUUCUCUUCCUUGAACUUUGU | 21 | 3607 |
| myoC-3862 | - | GCACGGAUGUCCGCCAGGUUU | 21 | 3608 |
| myoC-3863 | - | GGCACGGAUGUCCGCCAGGUUU | 22 | 3609 |

Table 7F provides exemplary targeting domains for knocking out the MYOC gene selected according to the six tier parameters. The targeting domains fall in the coding sequence of the gene, downstream of the first 500 bp of coding sequence (e.g., anywhere from +500 (relative to the start codon) to the stop codon of the gene) and PAM is NNGRRT. It is contemplated herein that in an embodiment the targeting domain hybridizes to the target domain through complementary base pairing. Any of the targeting domains in the Table 1 can be used with a *S. aureus* Cas9 molecule that generates a double stranded break (Cas9 nuclease) or a single-stranded break (Cas9 nickase).

TABLE 7F

| 6th Tier | | | | |
|---|---|---|---|---|
| gRNA Name | DNA Strand | Targeting Domain | Target Site Length | SEQ ID NO |
| myoC-3864 | + | CUUAUAGCGGUUCUUGAA | 18 | 3610 |
| myoC-3865 | + | ACUUAUAGCGGUUCUUGAA | 19 | 3611 |
| myoC-66 | + | UACUUAUAGCGGUUCUUGAA | 20 | 461 |
| myoC-3866 | + | UGUACUUAUAGCGGUUCUUGAA | 22 | 3612 |
| myoC-3867 | + | CUGUACUUAUAGCGGUUCUUGAA | 23 | 3613 |
| myoC-3868 | + | CAAAGAGCUUCUUCUCCA | 18 | 3614 |
| myoC-3869 | + | AGGCAAAGAGCUUCUUCUCCA | 21 | 3615 |
| myoC-3870 | + | CAGGCAAAGAGCUUCUUCUCCA | 22 | 3616 |
| myoC-3871 | + | CCAGGCAAAGAGCUUCUUCUCCA | 23 | 3617 |
| myoC-3872 | + | CCCAGGCAAAGAGCUUCUUCUCCA | 24 | 3618 |
| myoC-3873 | + | AAAUGCUGACAGAAGAUA | 18 | 3619 |
| myoC-3874 | + | UAAAUGCUGACAGAAGAUA | 19 | 3620 |
| myoC-3875 | + | AUAAAUGCUGACAGAAGAUA | 20 | 3621 |
| myoC-3876 | + | CAUAAAUGCUGACAGAAGAUA | 21 | 3622 |
| myoC-3877 | + | CCAUAAAUGCUGACAGAAGAUA | 22 | 3623 |
| myoC-3878 | + | CCCAUAAAUGCUGACAGAAGAUA | 23 | 3624 |
| myoC-3879 | + | UCCCAUAAAUGCUGACAGAAGAUA | 24 | 3625 |
| myoC-3880 | + | AUUUUAUUUCACAAUGUA | 18 | 3626 |
| myoC-3881 | + | AAUUUUAUUUCACAAUGUA | 19 | 3627 |
| myoC-3882 | + | AAAUUUUAUUUCACAAUGUA | 20 | 3628 |
| myoC-3883 | + | AAAAUUUUAUUUCACAAUGUA | 21 | 3629 |
| myoC-3884 | + | AGAAAAUUUUAUUUCACAAUGUA | 23 | 3630 |
| myoC-3885 | + | AAGAAAAUUUUAUUUCACAAUGUA | 24 | 3631 |
| myoC-3886 | + | UGUCCGUGUAGCCACCCC | 18 | 3632 |

TABLE 7F-continued

| 6th Tier | | | | |
|---|---|---|---|---|
| gRNA Name | DNA Strand | Targeting Domain | Target Site Length | SEQ ID NO |
| myoC-3887 | + | AUGUCCGUGUAGCCACCCC | 19 | 3633 |
| myoC-2928 | + | AAUGUCCGUGUAGCCACCCC | 20 | 1824 |
| myoC-3888 | + | CAAUGUCCGUGUAGCCACCCC | 21 | 3634 |
| myoC-3889 | + | UCAAUGUCCGUGUAGCCACCCC | 22 | 3635 |
| myoC-3890 | + | AGUCAAUGUCCGUGUAGCCACCCC | 24 | 3636 |
| myoC-3891 | + | UCCGUGGUAGCCAGCUCC | 18 | 3637 |
| myoC-23 | + | UGUCCGUGGUAGCCAGCUCC | 20 | 420 |
| myoC-3892 | + | CUGUCCGUGGUAGCCAGCUCC | 21 | 3638 |
| myoC-3893 | + | ACUGUCCGUGGUAGCCAGCUCC | 22 | 3639 |
| myoC-3894 | + | AACUGUCCGUGGUAGCCAGCUCC | 23 | 3640 |
| myoC-3895 | + | CCUGGAAAUAGAGGCUCC | 18 | 3641 |
| myoC-3896 | + | CCCUGGAAAUAGAGGCUCC | 19 | 3642 |
| myoC-3897 | + | CGCCCUGGAAAUAGAGGCUCC | 21 | 3643 |
| myoC-3898 | + | AGCGCCCUGGAAAUAGAGGCUCC | 23 | 3644 |
| myoC-3899 | + | CAGCGCCCUGGAAAUAGAGGCUCC | 24 | 3645 |
| myoC-3900 | + | CGAUUCUCCACGUGGUCUC | 19 | 3646 |
| myoC-3901 | + | UCGAUUCUCCACGUGGUCUC | 20 | 3647 |
| myoC-3902 | + | UGUCGAUUCUCCACGUGGUCUC | 22 | 3648 |
| myoC-3903 | + | UGUGUCGAUUCUCCACGUGGUCUC | 24 | 3649 |
| myoC-3904 | + | CACAGCCCGAGCAGUGUC | 18 | 3650 |
| myoC-3905 | + | UGGCACAGCCCGAGCAGUGUC | 21 | 3651 |
| myoC-3906 | + | UGGUGGCACAGCCCGAGCAGUGUC | 24 | 3652 |
| myoC-3907 | + | CGCCCUCAGACUACAAUUC | 19 | 3653 |
| myoC-3039 | + | ACGCCCUCAGACUACAAUUC | 20 | 2816 |
| myoC-3908 | + | UACGCCCUCAGACUACAAUUC | 21 | 3654 |
| myoC-3909 | + | CUACGCCCUCAGACUACAAUUC | 22 | 3655 |
| myoC-3910 | + | UCUACGCCCUCAGACUACAAUUC | 23 | 3656 |
| myoC-3911 | + | CUGUACUUAUAGCGGUUC | 18 | 3657 |
| myoC-2969 | + | UGCUGUACUUAUAGCGGUUC | 20 | 1856 |
| myoC-3912 | + | CUGCUGUACUUAUAGCGGUUC | 21 | 3658 |
| myoC-3913 | + | UGCUGCUGUACUUAUAGCGGUUC | 23 | 3659 |
| myoC-3914 | + | AUGCUGCUGUACUUAUAGCGGUUC | 24 | 3660 |
| myoC-3915 | + | AGGCAGUAUGUGAACCUUAG | 20 | 3661 |
| myoC-3916 | + | UAGGCAGUAUGUGAACCUUAG | 21 | 3662 |
| myoC-3917 | + | CUAGGCAGUAUGUGAACCUUAG | 22 | 3663 |
| myoC-3918 | + | CCUAGGCAGUAUGUGAACCUUAG | 23 | 3664 |
| myoC-3919 | + | AGUUCAAGGAAGAGAACG | 18 | 3665 |
| myoC-3920 | + | AAGUUCAAGGAAGAGAACG | 19 | 3666 |

TABLE 7F-continued

| 6th Tier | | | | |
|---|---|---|---|---|
| gRNA Name | DNA Strand | Targeting Domain | Target Site Length | SEQ ID NO |
| myoC-3921 | + | AAAGUUCAAGGAAGAGAACG | 20 | 3667 |
| myoC-3922 | + | CAAAGUUCAAGGAAGAGAACG | 21 | 3668 |
| myoC-3923 | + | ACAAAGUUCAAGGAAGAGAACG | 22 | 3669 |
| myoC-3924 | + | CACAAAGUUCAAGGAAGAGAACG | 23 | 3670 |
| myoC-3925 | + | CCACAAAGUUCAAGGAAGAGAACG | 24 | 3671 |
| myoC-3926 | + | UGUAGGGGUAGGUGGGCU | 18 | 3672 |
| myoC-3927 | + | UGGGUGUAGGGGUAGGUGGGCU | 22 | 3673 |
| myoC-3928 | + | CUGGGUGUAGGGGUAGGUGGGCU | 23 | 3674 |
| myoC-3929 | + | CCUGGGUGUAGGGGUAGGUGGGCU | 24 | 3675 |
| myoC-3930 | + | UGUUCGAGUUCCAGAUUCU | 19 | 3676 |
| myoC-3931 | + | UUGUUCGAGUUCCAGAUUCU | 20 | 3677 |
| myoC-3932 | + | UUUGUUCGAGUUCCAGAUUCU | 21 | 3678 |
| myoC-3933 | + | AGGUUUGUUCGAGUUCCAGAUUCU | 24 | 3679 |
| myoC-2966 | + | CGGUUCUUGAAUGGGAUGGU | 20 | 1854 |
| myoC-3934 | + | AGCGGUUCUUGAAUGGGAUGGU | 22 | 3680 |
| myoC-3935 | + | UAGCGGUUCUUGAAUGGGAUGGU | 23 | 3681 |
| myoC-3936 | + | AUAGCGGUUCUUGAAUGGGAUGGU | 24 | 3682 |
| myoC-3937 | + | ACGUGGUCUCCUGGGUGU | 18 | 3683 |
| myoC-3938 | + | CACGUGGUCUCCUGGGUGU | 19 | 3684 |
| myoC-472 | + | CCACGUGGUCUCCUGGGUGU | 20 | 814 |
| myoC-3939 | + | UCCACGUGGUCUCCUGGGUGU | 21 | 3685 |
| myoC-3940 | + | CUCCACGUGGUCUCCUGGGUGU | 22 | 3686 |
| myoC-3941 | + | UCUCCACGUGGUCUCCUGGGUGU | 23 | 3687 |
| myoC-3942 | + | UUCUCCACGUGGUCUCCUGGGUGU | 24 | 3688 |
| myoC-3943 | + | UUUGUCUCCCAGGUUUGU | 18 | 3689 |
| myoC-2999 | + | UGUUUGUCUCCCAGGUUUGU | 20 | 2792 |
| myoC-3944 | + | AUGUUUGUCUCCCAGGUUUGU | 21 | 3690 |
| myoC-3945 | + | CGGAUGUUUGUCUCCCAGGUUUGU | 24 | 3691 |
| myoC-3038 | + | UGGUGACCAUGUUCAUCCUU | 20 | 2815 |
| myoC-3946 | + | AUGGUGACCAUGUUCAUCCUU | 21 | 3692 |
| myoC-3947 | + | AGAUGGUGACCAUGUUCAUCCUU | 23 | 3693 |
| myoC-3948 | + | UAGAUGGUGACCAUGUUCAUCCUU | 24 | 3694 |
| myoC-3949 | + | AUUGGCGACUGACUGCUU | 18 | 3695 |
| myoC-3950 | + | CAUUGGCGACUGACUGCUU | 19 | 3696 |
| myoC-3951 | + | AGGCAUUGGCGACUGACUGCUU | 22 | 3697 |
| myoC-3952 | + | AAGGCAUUGGCGACUGACUGCUU | 23 | 3698 |
| myoC-3953 | - | CUCUCCAAACUGAACCCA | 18 | 3699 |

TABLE 7F-continued

| 6th Tier | | | | |
|---|---|---|---|---|
| gRNA Name | DNA Strand | Targeting Domain | Target Site Length | SEQ ID NO |
| myoC-3954 | - | CCUCUCCAAACUGAACCCA | 19 | 3700 |
| myoC-3955 | - | UCCUCUCCAAACUGAACCCA | 20 | 3701 |
| myoC-3956 | - | UGUCCUCUCCAAACUGAACCCA | 22 | 3702 |
| myoC-3957 | - | UUGUCCUCUCCAAACUGAACCCA | 23 | 3703 |
| myoC-3958 | - | AUUGUCCUCUCCAAACUGAACCCA | 24 | 3704 |
| myoC-3959 | - | UAGCUCCUCUGGCCAGCA | 18 | 3705 |
| myoC-3960 | - | AUAGCUCCUCUGGCCAGCA | 19 | 3706 |
| myoC-3961 | - | AAUAGCUCCUCUGGCCAGCA | 20 | 3707 |
| myoC-3962 | - | AGAAUAGCUCCUCUGGCCAGCA | 22 | 3708 |
| myoC-3963 | - | CAGAAUAGCUCCUCUGGCCAGCA | 23 | 3709 |
| myoC-3964 | - | UGGCUUCUAAUGCUUCAGA | 19 | 3710 |
| myoC-3965 | - | UUGGCUUCUAAUGCUUCAGA | 20 | 3711 |
| myoC-3966 | - | AGUUGGCUUCUAAUGCUUCAGA | 22 | 3712 |
| myoC-3967 | - | CAGUUGGCUUCUAAUGCUUCAGA | 23 | 3713 |
| myoC-3968 | - | ACAGUUGGCUUCUAAUGCUUCAGA | 24 | 3714 |
| myoC-3969 | - | AUCUUCUGUCAGCAUUUA | 18 | 3715 |
| myoC-3970 | - | UAUCUUCUGUCAGCAUUUA | 19 | 3716 |
| myoC-488 | - | UUAUCUUCUGUCAGCAUUUA | 20 | 830 |
| myoC-3971 | - | UUUAUCUUCUGUCAGCAUUUA | 21 | 3717 |
| myoC-3972 | - | CUUUAUCUUCUGUCAGCAUUUA | 22 | 3718 |
| myoC-3973 | - | CCUUUAUCUUCUGUCAGCAUUUA | 23 | 3719 |
| myoC-3974 | - | UCCUUUAUCUUCUGUCAGCAUUUA | 24 | 3720 |
| myoC-3975 | - | UUUCUUUUCUGAAUUUAC | 18 | 3721 |
| myoC-3976 | - | UUUUCUUUUCUGAAUUUAC | 19 | 3722 |
| myoC-3977 | - | CGUUUUCUUUUCUGAAUUUAC | 21 | 3723 |
| myoC-3978 | - | UCGUUUUCUUUUCUGAAUUUAC | 22 | 3724 |
| myoC-3979 | - | UUCGUUUUCUUUUCUGAAUUUAC | 23 | 3725 |
| myoC-3980 | - | CUUCGUUUUCUUUUCUGAAUUUAC | 24 | 3726 |
| myoC-3981 | - | CCUAGGCCACUGGAAAGC | 18 | 3727 |
| myoC-3982 | - | UGCCUAGGCCACUGGAAAGC | 20 | 3728 |
| myoC-3983 | - | CUGCCUAGGCCACUGGAAAGC | 21 | 3729 |
| myoC-3984 | - | ACUGCCUAGGCCACUGGAAAGC | 22 | 3730 |
| myoC-3985 | - | UACUGCCUAGGCCACUGGAAAGC | 23 | 3731 |
| myoC-3986 | - | AUACUGCCUAGGCCACUGGAAAGC | 24 | 3732 |
| myoC-3987 | - | AGAAUCGACACAGUUGGC | 18 | 3733 |
| myoC-3988 | - | UGGAGAAUCGACACAGUUGGC | 21 | 3734 |
| myoC-3989 | - | CGUGGAGAAUCGACACAGUUGGC | 23 | 3735 |
| myoC-3990 | - | ACGUGGAGAAUCGACACAGUUGGC | 24 | 3736 |

TABLE 7F-continued

| 6th Tier | | | | |
|---|---|---|---|---|
| gRNA Name | DNA Strand | Targeting Domain | Target Site Length | SEQ ID NO |
| myoC-3991 | - | AGCCCAUCUGGCUAUCUC | 18 | 3737 |
| myoC-319 | - | AGAGCCCAUCUGGCUAUCUC | 20 | 705 |
| myoC-3992 | - | AGGAGAGCCCAUCUGGCUAUCUC | 23 | 3738 |
| myoC-3993 | - | AAGGAGAGCCCAUCUGGCUAUCUC | 24 | 3739 |
| myoC-485 | - | UGGUCACCAUCUAACUAUUC | 20 | 827 |
| myoC-3994 | - | AUGGUCACCAUCUAACUAUUC | 21 | 3740 |
| myoC-3995 | - | CAUGGUCACCAUCUAACUAUUC | 22 | 3741 |
| myoC-3996 | - | ACAUGGUCACCAUCUAACUAUUC | 23 | 3742 |
| myoC-3997 | - | AACAUGGUCACCAUCUAACUAUUC | 24 | 3743 |
| myoC-3998 | - | AACUGAAGUUCCUGCUUC | 18 | 3744 |
| myoC-3999 | - | UAACUGAAGUUCCUGCUUC | 19 | 3745 |
| myoC-4000 | - | CUAACUGAAGUUCCUGCUUC | 20 | 3746 |
| myoC-4001 | - | AGCUAACUGAAGUUCCUGCUUC | 22 | 3747 |
| myoC-4002 | - | CGAGCUAACUGAAGUUCCUGCUUC | 24 | 3748 |
| myoC-4003 | - | CAUAACUUCUAAAGGAAG | 18 | 3749 |
| myoC-4004 | - | AGCAUAACUUCUAAAGGAAG | 20 | 3750 |
| myoC-4005 | - | AAGCAUAACUUCUAAAGGAAG | 21 | 3751 |
| myoC-4006 | - | AAAGCAUAACUUCUAAAGGAAG | 22 | 3752 |
| myoC-4007 | - | AAAAGCAUAACUUCUAAAGGAAG | 23 | 3753 |
| myoC-4008 | - | AAAAAGCAUAACUUCUAAAGGAAG | 24 | 3754 |
| myoC-4009 | - | UGCUUCAGAUAGAAUACAG | 19 | 3755 |
| myoC-4010 | - | AUGCUUCAGAUAGAAUACAG | 20 | 3756 |
| myoC-4011 | - | AAUGCUUCAGAUAGAAUACAG | 21 | 3757 |
| myoC-4012 | - | UAAUGCUUCAGAUAGAAUACAG | 22 | 3758 |
| myoC-4013 | - | CUAAUGCUUCAGAUAGAAUACAG | 23 | 3759 |
| myoC-4014 | - | UCUAAUGCUUCAGAUAGAAUACAG | 24 | 3760 |
| myoC-4015 | - | AAGUUUUCAUUAAUCCAG | 18 | 3761 |
| myoC-4016 | - | CAAGUUUUCAUUAAUCCAG | 19 | 3762 |
| myoC-3020 | - | CCAAGUUUUCAUUAAUCCAG | 20 | 2804 |
| myoC-4017 | - | UCCAAGUUUUCAUUAAUCCAG | 21 | 3763 |
| myoC-4018 | - | UUCCAAGUUUUCAUUAAUCCAG | 22 | 3764 |
| myoC-4019 | - | UUUCCAAGUUUUCAUUAAUCCAG | 23 | 3765 |
| myoC-4020 | - | CUUUCCAAGUUUUCAUUAAUCCAG | 24 | 3766 |
| myoC-4021 | - | ACUGUCAUAAGAUAUGAG | 18 | 3767 |
| myoC-4022 | - | AACUGUCAUAAGAUAUGAG | 19 | 3768 |
| myoC-4023 | - | AGAACUGUCAUAAGAUAUGAG | 21 | 3769 |
| myoC-4024 | - | CAGAACUGUCAUAAGAUAUGAG | 22 | 3770 |

TABLE 7F-continued

| 6th Tier | | | | |
|---|---|---|---|---|
| gRNA Name | DNA Strand | Targeting Domain | Target Site Length | SEQ ID NO |
| myoC-4025 | - | CCAGAACUGUCAUAAGAUAUGAG | 23 | 3771 |
| myoC-4026 | - | UCCAGAACUGUCAUAAGAUAUGAG | 24 | 3772 |
| myoC-4027 | - | UUUAAUGCAGUUUCUACG | 18 | 3773 |
| myoC-4028 | - | UUUUAAUGCAGUUUCUACG | 19 | 3774 |
| myoC-313 | - | CUUUUAAUGCAGUUUCUACG | 20 | 699 |
| myoC-4029 | - | UCUUUUAAUGCAGUUUCUACG | 21 | 3775 |
| myoC-4030 | - | UUCUUUUAAUGCAGUUUCUACG | 22 | 3776 |
| myoC-4031 | - | UUUCUUUUAAUGCAGUUUCUACG | 23 | 3777 |
| myoC-4032 | - | CUUUCUUUUAAUGCAGUUUCUACG | 24 | 3778 |
| myoC-4033 | - | AGCCUCUAUUUCCAGGGCG | 19 | 3779 |
| myoC-4034 | - | CGGGGAGCCUCUAUUUCCAGGGCG | 24 | 3780 |
| myoC-4035 | - | CCAGAGAAGGUAAGAAUG | 18 | 3781 |
| myoC-4036 | - | UCCAGAGAAGGUAAGAAUG | 19 | 3782 |
| myoC-4037 | - | CUCCAGAGAAGGUAAGAAUG | 20 | 3783 |
| myoC-4038 | - | AGGCUCCAGAGAAGGUAAGAAUG | 23 | 3784 |
| myoC-4039 | - | CAGGCUCCAGAGAAGGUAAGAAUG | 24 | 3785 |
| myoC-4040 | - | CACCCAGGAGACCACGUG | 18 | 3786 |
| myoC-4041 | - | ACACCCAGGAGACCACGUG | 19 | 3787 |
| myoC-4042 | - | UACACCCAGGAGACCACGUG | 20 | 3788 |
| myoC-4043 | - | CUACACCCAGGAGACCACGUG | 21 | 3789 |
| myoC-4044 | - | CCUACACCCAGGAGACCACGUG | 22 | 3790 |
| myoC-4045 | - | CCCUACACCCAGGAGACCACGUG | 23 | 3791 |
| myoC-4046 | - | CCCCUACACCCAGGAGACCACGUG | 24 | 3792 |
| myoC-4047 | - | AUGCAGAGUGGGGGGACU | 18 | 3793 |
| myoC-4048 | - | AAUGCAGAGUGGGGGGACU | 19 | 3794 |
| myoC-4049 | - | AGAAUGCAGAGUGGGGGGACU | 21 | 3795 |
| myoC-4050 | - | AAGAAUGCAGAGUGGGGGGACU | 22 | 3796 |
| myoC-4051 | - | UAAGAAUGCAGAGUGGGGGGACU | 23 | 3797 |
| myoC-4052 | - | UGUGGAUGAAGCAGGCCU | 18 | 3798 |
| myoC-4053 | - | CUGUGGAUGAAGCAGGCCU | 19 | 3799 |
| myoC-4054 | - | UGGCUGUGGAUGAAGCAGGCCU | 22 | 3800 |
| myoC-4055 | - | UUGGCUGUGGAUGAAGCAGGCCU | 23 | 3801 |
| myoC-4056 | - | CUUGGCUGUGGAUGAAGCAGGCCU | 24 | 3802 |
| myoC-4057 | - | ACGGACAUUGACUUGGCU | 18 | 3803 |
| myoC-4058 | - | CACGGACAUUGACUUGGCU | 19 | 3804 |
| myoC-2918 | - | ACACGGACAUUGACUUGGCU | 20 | 1817 |
| myoC-4059 | - | UACACGGACAUUGACUUGGCU | 21 | 3805 |
| myoC-4060 | - | CUACACGGACAUUGACUUGGCU | 22 | 3806 |

TABLE 7F-continued

| 6th Tier | | | | |
|---|---|---|---|---|
| gRNA Name | DNA Strand | Targeting Domain | Target Site Length | SEQ ID NO |
| myoC-4061 | - | CGGACAGUUCCCGUAUUCU | 19 | 3807 |
| myoC-6 | - | ACGGACAGUUCCCGUAUUCU | 20 | 408 |
| myoC-4062 | - | CACGGACAGUUCCCGUAUUCU | 21 | 3808 |
| myoC-4063 | - | CCACGGACAGUUCCCGUAUUCU | 22 | 3809 |
| myoC-4064 | - | ACCACGGACAGUUCCCGUAUUCU | 23 | 3810 |
| myoC-4065 | - | UACCACGGACAGUUCCCGUAUUCU | 24 | 3811 |
| myoC-4066 | - | AGGAUGUGGAGAACUAGU | 18 | 3812 |
| myoC-4067 | - | CAGGAUGUGGAGAACUAGU | 19 | 3813 |
| myoC-4068 | - | CCAGGAUGUGGAGAACUAGU | 20 | 3814 |
| myoC-4069 | - | ACCAGGAUGUGGAGAACUAGU | 21 | 3815 |
| myoC-4070 | - | UACCAGGAUGUGGAGAACUAGU | 22 | 3816 |
| myoC-4071 | - | UUACCAGGAUGUGGAGAACUAGU | 23 | 3817 |
| myoC-4072 | - | UUUACCAGGAUGUGGAGAACUAGU | 24 | 3818 |
| myoC-4073 | - | CCAGGCUCCAGAGAAGGU | 18 | 3819 |
| myoC-4074 | - | ACCAGGCUCCAGAGAAGGU | 19 | 3820 |
| myoC-4075 | - | CACCAGGCUCCAGAGAAGGU | 20 | 3821 |
| myoC-4076 | - | CCACCAGGCUCCAGAGAAGGU | 21 | 3822 |
| myoC-4077 | - | UGCCACCAGGCUCCAGAGAAGGU | 23 | 3823 |
| myoC-4078 | - | UACUGGCAAGUAUGGUGU | 18 | 3824 |
| myoC-4079 | - | UUACUGGCAAGUAUGGUGU | 19 | 3825 |
| myoC-4080 | - | AUUACUGGCAAGUAUGGUGU | 20 | 3826 |
| myoC-4081 | - | AAUUACUGGCAAGUAUGGUGU | 21 | 3827 |
| myoC-4082 | - | CAAUUACUGGCAAGUAUGGUGU | 22 | 3828 |
| myoC-4083 | - | ACAAUUACUGGCAAGUAUGGUGU | 23 | 3829 |
| myoC-4084 | - | AACAAUUACUGGCAAGUAUGGUGU | 24 | 3830 |
| myoC-4085 | - | CUCUUCCUUGAACUUUGU | 18 | 3831 |
| myoC-4086 | - | UCUCUUCCUUGAACUUUGU | 19 | 3832 |
| myoC-3193 | - | UUCUCUUCCUUGAACUUUGU | 20 | 2939 |
| myoC-4087 | - | CGUUCUCUUCCUUGAACUUUGU | 22 | 3833 |
| myoC-4088 | - | ACGUUCUCUUCCUUGAACUUUGU | 23 | 3834 |
| myoC-4089 | - | AACGUUCUCUUCCUUGAACUUUGU | 24 | 3835 |
| myoC-4090 | - | CGGAUGUCCGCCAGGUUU | 18 | 3836 |
| myoC-4091 | - | ACGGAUGUCCGCCAGGUUU | 19 | 3837 |
| myoC-4092 | - | CACGGAUGUCCGCCAGGUUU | 20 | 3838 |
| myoC-4093 | - | UGGCACGGAUGUCCGCCAGGUUU | 23 | 3839 |
| myoC-4094 | - | UUGGCACGGAUGUCCGCCAGGUUU | 24 | 3840 |

Table 7G provides exemplary targeting domains for knocking out the MYOC gene selected according to the seven tier parameters. The targeting domains fall in the coding sequence of the gene, downstream of the first 500 bp of coding sequence (e.g., anywhere from +500 (relative to the start codon) to the stop codon of the gene) and PAM is NNGRRV. It is contemplated herein that in an embodiment the targeting domain hybridizes to the target domain through complementary base pairing. Any of the targeting domains in the Table 1 can be used with a *S. aureus* Cas9 molecule that generates a double stranded break (Cas9 nuclease) or a single-stranded break (Cas9 nickase).

TABLE 7G

| 7th Tier | | | | |
|---|---|---|---|---|
| gRNA Name | DNA Strand | Targeting Domain | Target Site Length | SEQ ID NO |
| myoC-4095 | + | GUAAAUUCAGAAAAGAAA | 18 | 3841 |
| myoC-4096 | + | GGUAAAUUCAGAAAAGAAA | 19 | 3842 |
| myoC-4097 | + | UGGUAAAUUCAGAAAAGAAA | 20 | 3843 |
| myoC-4098 | + | CUGGUAAAUUCAGAAAAGAAA | 21 | 3844 |
| myoC-4099 | + | CCUGGUAAAUUCAGAAAAGAAA | 22 | 3845 |
| myoC-4100 | + | UCCUGGUAAAUUCAGAAAAGAAA | 23 | 3846 |
| myoC-4101 | + | AUCCUGGUAAAUUCAGAAAAGAAA | 24 | 3847 |
| myoC-4102 | + | GACUCAGCGCCCUGGAAA | 18 | 3848 |
| myoC-4103 | + | GGACUCAGCGCCCUGGAAA | 19 | 3849 |
| myoC-4104 | + | UGGACUCAGCGCCCUGGAAA | 20 | 3850 |
| myoC-4105 | + | CUGGACUCAGCGCCCUGGAAA | 21 | 3851 |
| myoC-4106 | + | UCUGGACUCAGCGCCCUGGAAA | 22 | 3852 |
| myoC-4107 | + | UUCUGGACUCAGCGCCCUGGAAA | 23 | 3853 |
| myoC-4108 | + | GUUCUGGACUCAGCGCCCUGGAAA | 24 | 3854 |
| myoC-4109 | + | AUCCUGGUAAAUUCAGAA | 18 | 3855 |
| myoC-4110 | + | CAUCCUGGUAAAUUCAGAA | 19 | 3856 |
| myoC-4111 | + | ACAUCCUGGUAAAUUCAGAA | 20 | 3857 |
| myoC-4112 | + | CACAUCCUGGUAAAUUCAGAA | 21 | 3858 |
| myoC-4113 | + | CCACAUCCUGGUAAAUUCAGAA | 22 | 3859 |
| myoC-4114 | + | UCCACAUCCUGGUAAAUUCAGAA | 23 | 3860 |
| myoC-4115 | + | CUCCACAUCCUGGUAAAUUCAGAA | 24 | 3861 |
| myoC-4116 | + | CCCACAAAGUUCAAGGAA | 18 | 3862 |
| myoC-4117 | + | UCCCACAAAGUUCAAGGAA | 19 | 3863 |
| myoC-4118 | + | UUCCCACAAAGUUCAAGGAA | 20 | 3864 |
| myoC-4119 | + | ACGUAGAAACUGCAUUAA | 18 | 3865 |
| myoC-4120 | + | CACGUAGAAACUGCAUUAA | 19 | 3866 |
| myoC-4121 | + | CCACGUAGAAACUGCAUUAA | 20 | 3867 |
| myoC-4122 | + | UCCACGUAGAAACUGCAUUAA | 21 | 3868 |
| myoC-4123 | + | UUCCACGUAGAAACUGCAUUAA | 22 | 3869 |
| myoC-4124 | + | AUUCCACGUAGAAACUGCAUUAA | 23 | 3870 |
| myoC-4125 | + | AAUUCCACGUAGAAACUGCAUUAA | 24 | 3871 |
| myoC-4126 | + | UAUAUUCGAUGCUGGCCA | 18 | 3872 |
| myoC-4127 | + | UUAUAUUCGAUGCUGGCCA | 19 | 3873 |
| myoC-4128 | + | CUUAUAUUCGAUGCUGGCCA | 20 | 3874 |

TABLE 7G-continued

| 7th Tier | | | | |
|---|---|---|---|---|
| gRNA Name | DNA Strand | Targeting Domain | Target Site Length | SEQ ID NO |
| myoC-4129 | + | ACUUAUAUUCGAUGCUGGCCA | 21 | 3875 |
| myoC-4130 | + | UACUUAUAUUCGAUGCUGGCCA | 22 | 3876 |
| myoC-4131 | + | UUACUUAUAUUCGAUGCUGGCCA | 23 | 3877 |
| myoC-4132 | + | CUUACUUAUAUUCGAUGCUGGCCA | 24 | 3878 |
| myoC-4133 | + | UUCAAGUUGUCCCAGGCA | 18 | 3879 |
| myoC-4134 | + | GUUCAAGUUGUCCCAGGCA | 19 | 3880 |
| myoC-2973 | + | UGUUCAAGUUGUCCCAGGCA | 20 | 1858 |
| myoC-4135 | + | AUGUUCAAGUUGUCCCAGGCA | 21 | 3881 |
| myoC-4136 | + | CAUGUUCAAGUUGUCCCAGGCA | 22 | 3882 |
| myoC-4137 | + | CCAUGUUCAAGUUGUCCCAGGCA | 23 | 3883 |
| myoC-4138 | + | ACCAUGUUCAAGUUGUCCCAGGCA | 24 | 3884 |
| myoC-4139 | + | AGAAACUGCAUUAAAAGA | 18 | 3885 |
| myoC-4140 | + | UAGAAACUGCAUUAAAAGA | 19 | 3886 |
| myoC-4141 | + | GUAGAAACUGCAUUAAAAGA | 20 | 3887 |
| myoC-4142 | + | CGUAGAAACUGCAUUAAAAGA | 21 | 3888 |
| myoC-4143 | + | ACGUAGAAACUGCAUUAAAAGA | 22 | 3889 |
| myoC-4144 | + | CACGUAGAAACUGCAUUAAAAGA | 23 | 3890 |
| myoC-4145 | + | CCACGUAGAAACUGCAUUAAAAGA | 24 | 3891 |
| myoC-4146 | + | CUCUGGGUUCAGUUUGGA | 18 | 3892 |
| myoC-4147 | + | UCUCUGGGUUCAGUUUGGA | 19 | 3893 |
| myoC-4148 | + | UUCUCUGGGUUCAGUUUGGA | 20 | 3894 |
| myoC-4149 | + | AUUCUCUGGGUUCAGUUUGGA | 21 | 3895 |
| myoC-4150 | + | GAUUCUCUGGGUUCAGUUUGGA | 22 | 3896 |
| myoC-4151 | + | AGAUUCUCUGGGUUCAGUUUGGA | 23 | 3897 |
| myoC-4152 | + | CAGAUUCUCUGGGUUCAGUUUGGA | 24 | 3898 |
| myoC-4153 | + | ACAUCCCAUAAAUGCUGA | 18 | 3899 |
| myoC-4154 | + | AACAUCCCAUAAAUGCUGA | 19 | 3900 |
| myoC-4155 | + | AAACAUCCCAUAAAUGCUGA | 20 | 3901 |
| myoC-4156 | + | UAAACAUCCCAUAAAUGCUGA | 21 | 3902 |
| myoC-4157 | + | UUAAACAUCCCAUAAAUGCUGA | 22 | 3903 |
| myoC-4158 | + | AUUAAACAUCCCAUAAAUGCUGA | 23 | 3904 |
| myoC-4159 | + | CAUUAAACAUCCCAUAAAUGCUGA | 24 | 3905 |
| myoC-4160 | + | ACUUAUAGCGGUUCUUGA | 18 | 3906 |
| myoC-4161 | + | UACUUAUAGCGGUUCUUGA | 19 | 3907 |
| myoC-2968 | + | GUACUUAUAGCGGUUCUUGA | 20 | 1855 |
| myoC-4162 | + | UGUACUUAUAGCGGUUCUUGA | 21 | 3908 |
| myoC-4163 | + | CUGUACUUAUAGCGGUUCUUGA | 22 | 3909 |

TABLE 7G-continued

| 7th Tier | | | | |
|---|---|---|---|---|
| gRNA Name | DNA Strand | Targeting Domain | Target Site Length | SEQ ID NO |
| myoC-4164 | + | GCUGUACUUAUAGCGGUUCUUGA | 23 | 3910 |
| myoC-4165 | + | UGCUGUACUUAUAGCGGUUCUUGA | 24 | 3911 |
| myoC-4166 | + | GUAGCCACCCCAAGAAUA | 18 | 3912 |
| myoC-4167 | + | UGUAGCCACCCCAAGAAUA | 19 | 3913 |
| myoC-20 | + | GUGUAGCCACCCCAAGAAUA | 20 | 390 |
| myoC-4168 | + | CGUGUAGCCACCCCAAGAAUA | 21 | 3914 |
| myoC-4169 | + | CCGUGUAGCCACCCCAAGAAUA | 22 | 3915 |
| myoC-4170 | + | UCCGUGUAGCCACCCCAAGAAUA | 23 | 3916 |
| myoC-4171 | + | GUCCGUGUAGCCACCCCAAGAAUA | 24 | 3917 |
| myoC-4172 | + | GUUCAUCCUUCUGGAUUA | 18 | 3918 |
| myoC-4173 | + | UGUUCAUCCUUCUGGAUUA | 19 | 3919 |
| myoC-3037 | + | AUGUUCAUCCUUCUGGAUUA | 20 | 2814 |
| myoC-4174 | + | CAUGUUCAUCCUUCUGGAUUA | 21 | 3920 |
| myoC-4175 | + | CCAUGUUCAUCCUUCUGGAUUA | 22 | 3921 |
| myoC-4176 | + | ACCAUGUUCAUCCUUCUGGAUUA | 23 | 3922 |
| myoC-4177 | + | GACCAUGUUCAUCCUUCUGGAUUA | 24 | 3923 |
| myoC-4178 | + | CCCAAAUCACAAGAAAAC | 18 | 3924 |
| myoC-4179 | + | CCCCAAAUCACAAGAAAAC | 19 | 3925 |
| myoC-4180 | + | GCCCCAAAUCACAAGAAAAC | 20 | 3926 |
| myoC-4181 | + | UGCCCCAAAUCACAAGAAAAC | 21 | 3927 |
| myoC-4182 | + | UUGCCCCAAAUCACAAGAAAAC | 22 | 3928 |
| myoC-4183 | + | UUUGCCCCAAAUCACAAGAAAAC | 23 | 3929 |
| myoC-4184 | + | UUUUGCCCCAAAUCACAAGAAAAC | 24 | 3930 |
| myoC-4185 | + | UUCUGGAUUAAUGAAAAC | 18 | 3931 |
| myoC-4186 | + | CUUCUGGAUUAAUGAAAAC | 19 | 3932 |
| myoC-3036 | + | CCUUCUGGAUUAAUGAAAAC | 20 | 2813 |
| myoC-4187 | + | UCCUUCUGGAUUAAUGAAAAC | 21 | 3933 |
| myoC-4188 | + | AUCCUUCUGGAUUAAUGAAAAC | 22 | 3934 |
| myoC-4189 | + | CAUCCUUCUGGAUUAAUGAAAAC | 23 | 3935 |
| myoC-4190 | + | UCAUCCUUCUGGAUUAAUGAAAAC | 24 | 3936 |
| myoC-4191 | + | GCUUUUGCCCCAAAUCAC | 18 | 3937 |
| myoC-4192 | + | AGCUUUUGCCCCAAAUCAC | 19 | 3938 |
| myoC-4193 | + | CAGCUUUUGCCCCAAAUCAC | 20 | 3939 |
| myoC-4194 | + | ACAGCUUUUGCCCCAAAUCAC | 21 | 3940 |
| myoC-4195 | + | UACAGCUUUUGCCCCAAAUCAC | 22 | 3941 |
| myoC-4196 | + | UUACAGCUUUUGCCCCAAAUCAC | 23 | 3942 |
| myoC-4197 | + | CUUACAGCUUUUGCCCCAAAUCAC | 24 | 3943 |
| myoC-4198 | + | UAGCCACCCCAAGAAUAC | 18 | 3944 |

TABLE 7G-continued

| 7th Tier | | | | |
|---|---|---|---|---|
| gRNA Name | DNA Strand | Targeting Domain | Target Site Length | SEQ ID NO |
| myoC-4199 | + | GUAGCCACCCCAAGAAUAC | 19 | 3945 |
| myoC-21 | + | UGUAGCCACCCCAAGAAUAC | 20 | 418 |
| myoC-4200 | + | GUGUAGCCACCCCAAGAAUAC | 21 | 3946 |
| myoC-4201 | + | CGUGUAGCCACCCCAAGAAUAC | 22 | 3947 |
| myoC-4202 | + | CCGUGUAGCCACCCCAAGAAUAC | 23 | 3948 |
| myoC-4203 | + | UCCGUGUAGCCACCCCAAGAAUAC | 24 | 3949 |
| myoC-4204 | + | UCGGUGCUGUAAAUGACC | 18 | 3950 |
| myoC-4205 | + | AUCGGUGCUGUAAAUGACC | 19 | 3951 |
| myoC-2929 | + | CAUCGGUGCUGUAAAUGACC | 20 | 1825 |
| myoC-4206 | + | UCAUCGGUGCUGUAAAUGACC | 21 | 3952 |
| myoC-4207 | + | CUCAUCGGUGCUGUAAAUGACC | 22 | 3953 |
| myoC-4208 | + | CCUCAUCGGUGCUGUAAAUGACC | 23 | 3954 |
| myoC-4209 | + | GCCUCAUCGGUGCUGUAAAUGACC | 24 | 3955 |
| myoC-4210 | + | CUUCAGCCUGCUCCCCCC | 18 | 3956 |
| myoC-4211 | + | CCUUCAGCCUGCUCCCCCC | 19 | 3957 |
| myoC-421 | + | CCCUUCAGCCUGCUCCCCCC | 20 | 785 |
| myoC-4212 | + | UCCCUUCAGCCUGCUCCCCCC | 21 | 3958 |
| myoC-4213 | + | CUCCCUUCAGCCUGCUCCCCCC | 22 | 3959 |
| myoC-4214 | + | UCUCCCUUCAGCCUGCUCCCCCC | 23 | 3960 |
| myoC-4215 | + | CUCUCCCUUCAGCCUGCUCCCCCC | 24 | 3961 |
| myoC-4216 | + | CCUUCAGCCUGCUCCCCC | 18 | 3962 |
| myoC-4217 | + | CCCUUCAGCCUGCUCCCCC | 19 | 3963 |
| myoC-3033 | + | UCCCUUCAGCCUGCUCCCCC | 20 | 2811 |
| myoC-4218 | + | CUCCCUUCAGCCUGCUCCCCC | 21 | 3964 |
| myoC-4219 | + | UCUCCCUUCAGCCUGCUCCCCC | 22 | 3965 |
| myoC-4220 | + | CUCUCCCUUCAGCCUGCUCCCCC | 23 | 3966 |
| myoC-4221 | + | GCUCUCCCUUCAGCCUGCUCCCCC | 24 | 3967 |
| myoC-4222 | + | GUUCUGGACUCAGCGCCC | 18 | 3968 |
| myoC-4223 | + | AGUUCUGGACUCAGCGCCC | 19 | 3969 |
| myoC-459 | + | CAGUUCUGGACUCAGCGCCC | 20 | 801 |
| myoC-4224 | + | ACAGUUCUGGACUCAGCGCCC | 21 | 3970 |
| myoC-4225 | + | GACAGUUCUGGACUCAGCGCCC | 22 | 3971 |
| myoC-4226 | + | UGACAGUUCUGGACUCAGCGCCC | 23 | 3972 |
| myoC-4227 | + | AUGACAGUUCUGGACUCAGCGCCC | 24 | 3973 |
| myoC-4228 | + | CUGCUCCCCCCAGGAGCC | 18 | 3974 |
| myoC-4229 | + | CCUGCUCCCCCCAGGAGCC | 19 | 3975 |
| myoC-3031 | + | GCCUGCUCCCCCCAGGAGCC | 20 | 2810 |

TABLE 7G-continued

| 7th Tier | | | | |
|---|---|---|---|---|
| gRNA Name | DNA Strand | Targeting Domain | Target Site Length | SEQ ID NO |
| myoC-4230 | + | AGCCUGCUCCCCCCAGGAGCC | 21 | 3976 |
| myoC-4231 | + | CAGCCUGCUCCCCCCAGGAGCC | 22 | 3977 |
| myoC-4232 | + | UCAGCCUGCUCCCCCCAGGAGCC | 23 | 3978 |
| myoC-4233 | + | UUCAGCCUGCUCCCCCCAGGAGCC | 24 | 3979 |
| myoC-4234 | + | AGUUCUGGACUCAGCGCC | 18 | 3980 |
| myoC-4235 | + | CAGUUCUGGACUCAGCGCC | 19 | 3981 |
| myoC-4236 | + | ACAGUUCUGGACUCAGCGCC | 20 | 3982 |
| myoC-4237 | + | GACAGUUCUGGACUCAGCGCC | 21 | 3983 |
| myoC-4238 | + | UGACAGUUCUGGACUCAGCGCC | 22 | 3984 |
| myoC-4239 | + | AUGACAGUUCUGGACUCAGCGCC | 23 | 3985 |
| myoC-4240 | + | UAUGACAGUUCUGGACUCAGCGCC | 24 | 3986 |
| myoC-4241 | + | GCAAAGAGCUUCUUCUCC | 18 | 3987 |
| myoC-4242 | + | GGCAAAGAGCUUCUUCUCC | 19 | 3988 |
| myoC-61 | + | AGGCAAAGAGCUUCUUCUCC | 20 | 458 |
| myoC-4243 | + | CAGGCAAAGAGCUUCUUCUCC | 21 | 3989 |
| myoC-4244 | + | CCAGGCAAAGAGCUUCUUCUCC | 22 | 3990 |
| myoC-4245 | + | CCCAGGCAAAGAGCUUCUUCUCC | 23 | 3991 |
| myoC-4246 | + | UCCCAGGCAAAGAGCUUCUUCUCC | 24 | 3992 |
| myoC-4247 | + | AGCUCGGACUUCAGUUCC | 18 | 3993 |
| myoC-4248 | + | UAGCUCGGACUUCAGUUCC | 19 | 3994 |
| myoC-331 | + | UUAGCUCGGACUUCAGUUCC | 20 | 717 |
| myoC-4249 | + | GUUAGCUCGGACUUCAGUUCC | 21 | 3995 |
| myoC-4250 | + | AGUUAGCUCGGACUUCAGUUCC | 22 | 3996 |
| myoC-4251 | + | CAGUUAGCUCGGACUUCAGUUCC | 23 | 3997 |
| myoC-4252 | + | UCAGUUAGCUCGGACUUCAGUUCC | 24 | 3998 |
| myoC-4253 | + | CUUCAAAAUUCGGGAAGC | 18 | 3999 |
| myoC-4254 | + | CCUUCAAAAUUCGGGAAGC | 19 | 4000 |
| myoC-329 | + | UCCUUCAAAAUUCGGGAAGC | 20 | 715 |
| myoC-4255 | + | CUCCUUCAAAAUUCGGGAAGC | 21 | 4001 |
| myoC-4256 | + | UCUCCUUCAAAAUUCGGGAAGC | 22 | 4002 |
| myoC-4257 | + | CUCUCCUUCAAAAUUCGGGAAGC | 23 | 4003 |
| myoC-4258 | + | GCUCUCCUUCAAAAUUCGGGAAGC | 24 | 4004 |
| myoC-4259 | + | GGAGCCUGGUGGCACAGC | 18 | 4005 |
| myoC-4260 | + | UGGAGCCUGGUGGCACAGC | 19 | 4006 |
| myoC-1701 | + | CUGGAGCCUGGUGGCACAGC | 20 | 1953 |
| myoC-4261 | + | UCUGGAGCCUGGUGGCACAGC | 21 | 4007 |
| myoC-4262 | + | CUCUGGAGCCUGGUGGCACAGC | 22 | 4008 |
| myoC-4263 | + | UCUCUGGAGCCUGGUGGCACAGC | 23 | 4009 |

TABLE 7G-continued

| 7th Tier | | | | |
|---|---|---|---|---|
| gRNA Name | DNA Strand | Targeting Domain | Target Site Length | SEQ ID NO |
| myoC-4264 | + | UUCUCUGGAGCCUGGUGGCACAGC | 24 | 4010 |
| myoC-4265 | + | UGCCAUUGCCUGUACAGC | 18 | 4011 |
| myoC-4266 | + | CUGCCAUUGCCUGUACAGC | 19 | 4012 |
| myoC-3030 | + | UCUGCCAUUGCCUGUACAGC | 20 | 2809 |
| myoC-4267 | + | UUCUGCCAUUGCCUGUACAGC | 21 | 4013 |
| myoC-4268 | + | CUUCUGCCAUUGCCUGUACAGC | 22 | 4014 |
| myoC-4269 | + | CCUUCUGCCAUUGCCUGUACAGC | 23 | 4015 |
| myoC-4270 | + | UCCUUCUGCCAUUGCCUGUACAGC | 24 | 4016 |
| myoC-4271 | + | GUUUCUGCUGUUCUCAGC | 18 | 4017 |
| myoC-4272 | + | UGUUUCUGCUGUUCUCAGC | 19 | 4018 |
| myoC-4273 | + | UUGUUUCUGCUGUUCUCAGC | 20 | 4019 |
| myoC-4274 | + | AUUGUUUCUGCUGUUCUCAGC | 21 | 4020 |
| myoC-4275 | + | AAUUGUUUCUGCUGUUCUCAGC | 22 | 4021 |
| myoC-4276 | + | UAAUUGUUUCUGCUGUUCUCAGC | 23 | 4022 |
| myoC-4277 | + | GUAAUUGUUUCUGCUGUUCUCAGC | 24 | 4023 |
| myoC-4278 | + | GCAGGAACUUCAGUUAGC | 18 | 4024 |
| myoC-4279 | + | AGCAGGAACUUCAGUUAGC | 19 | 4025 |
| myoC-4280 | + | AAGCAGGAACUUCAGUUAGC | 20 | 4026 |
| myoC-4281 | + | GAAGCAGGAACUUCAGUUAGC | 21 | 4027 |
| myoC-4282 | + | GGAAGCAGGAACUUCAGUUAGC | 22 | 4028 |
| myoC-4283 | + | GGGAAGCAGGAACUUCAGUUAGC | 23 | 4029 |
| myoC-4284 | + | CGGGAAGCAGGAACUUCAGUUAGC | 24 | 4030 |
| myoC-4285 | + | GUGUAGGGGUAGGUGGGC | 18 | 4031 |
| myoC-4286 | + | GGUGUAGGGGUAGGUGGGC | 19 | 4032 |
| myoC-4287 | + | GGGUGUAGGGGUAGGUGGGC | 20 | 4033 |
| myoC-4288 | + | UGGGUGUAGGGGUAGGUGGGC | 21 | 4034 |
| myoC-4289 | + | CUGGGUGUAGGGGUAGGUGGGC | 22 | 4035 |
| myoC-4290 | + | CCUGGGUGUAGGGGUAGGUGGGC | 23 | 4036 |
| myoC-4291 | + | UCCUGGGUGUAGGGGUAGGUGGGC | 24 | 4037 |
| myoC-4292 | + | CUUAUAUUCGAUGCUGGC | 18 | 4038 |
| myoC-4293 | + | ACUUAUAUUCGAUGCUGGC | 19 | 4039 |
| myoC-4294 | + | UACUUAUAUUCGAUGCUGGC | 20 | 4040 |
| myoC-4295 | + | UUACUUAUAUUCGAUGCUGGC | 21 | 4041 |
| myoC-4296 | + | CUUACUUAUAUUCGAUGCUGGC | 22 | 4042 |
| myoC-4297 | + | UCUUACUUAUAUUCGAUGCUGGC | 23 | 4043 |
| myoC-4298 | + | AUCUUACUUAUAUUCGAUGCUGGC | 24 | 4044 |
| myoC-4299 | + | GGUAACCAUGUAACAUGC | 18 | 4045 |

TABLE 7G-continued

| 7th Tier | | | | |
|---|---|---|---|---|
| gRNA Name | DNA Strand | Targeting Domain | Target Site Length | SEQ ID NO |
| myoC-4300 | + | UGGUAACCAUGUAACAUGC | 19 | 4046 |
| myoC-4301 | + | GUGGUAACCAUGUAACAUGC | 20 | 4047 |
| myoC-4302 | + | UGUGGUAACCAUGUAACAUGC | 21 | 4048 |
| myoC-4303 | + | UUGUGGUAACCAUGUAACAUGC | 22 | 4049 |
| myoC-4304 | + | CUUGUGGUAACCAUGUAACAUGC | 23 | 4050 |
| myoC-4305 | + | GCUUGUGGUAACCAUGUAACAUGC | 24 | 4051 |
| myoC-4306 | + | GAAAGCAGUCAAAGCUGC | 18 | 4052 |
| myoC-4307 | + | GGAAAGCAGUCAAAGCUGC | 19 | 4053 |
| myoC-3034 | + | UGGAAAGCAGUCAAAGCUGC | 20 | 2812 |
| myoC-4308 | + | UUGGAAAGCAGUCAAAGCUGC | 21 | 4054 |
| myoC-4309 | + | CUUGGAAAGCAGUCAAAGCUGC | 22 | 4055 |
| myoC-4310 | + | ACUUGGAAAGCAGUCAAAGCUGC | 23 | 4056 |
| myoC-4311 | + | AACUUGGAAAGCAGUCAAAGCUGC | 24 | 4057 |
| myoC-4312 | + | UUGGAGGCUUUUCACAUC | 18 | 4058 |
| myoC-4313 | + | CUUGGAGGCUUUUCACAUC | 19 | 4059 |
| myoC-2976 | + | GCUUGGAGGCUUUUCACAUC | 20 | 1860 |
| myoC-4314 | + | AGCUUGGAGGCUUUUCACAUC | 21 | 4060 |
| myoC-4315 | + | CAGCUUGGAGGCUUUUCACAUC | 22 | 4061 |
| myoC-4316 | + | ACAGCUUGGAGGCUUUUCACAUC | 23 | 4062 |
| myoC-4317 | + | UACAGCUUGGAGGCUUUUCACAUC | 24 | 4063 |
| myoC-4318 | + | GUGUCUCCCUCUCCACUC | 18 | 4064 |
| myoC-4319 | + | GGUGUCUCCCUCUCCACUC | 19 | 4065 |
| myoC-4320 | + | CGGUGUCUCCCUCUCCACUC | 20 | 4066 |
| myoC-4321 | + | CCGGUGUCUCCCUCUCCACUC | 21 | 4067 |
| myoC-4322 | + | ACCGGUGUCUCCCUCUCCACUC | 22 | 4068 |
| myoC-4323 | + | UACCGGUGUCUCCCUCUCCACUC | 23 | 4069 |
| myoC-4324 | + | AUACCGGUGUCUCCCUCUCCACUC | 24 | 4070 |
| myoC-4325 | + | GUCCGUGGUAGCCAGCUC | 18 | 4071 |
| myoC-4326 | + | UGUCCGUGGUAGCCAGCUC | 19 | 4072 |
| myoC-2924 | + | CUGUCCGUGGUAGCCAGCUC | 20 | 1822 |
| myoC-4327 | + | ACUGUCCGUGGUAGCCAGCUC | 21 | 4073 |
| myoC-4328 | + | AACUGUCCGUGGUAGCCAGCUC | 22 | 4074 |
| myoC-4329 | + | GAACUGUCCGUGGUAGCCAGCUC | 23 | 4075 |
| myoC-4330 | + | GGAACUGUCCGUGGUAGCCAGCUC | 24 | 4076 |
| myoC-4331 | + | CUGCAUUCUUACCUUCUC | 18 | 4077 |
| myoC-4332 | + | UCUGCAUUCUUACCUUCUC | 19 | 4078 |
| myoC-3184 | + | CUCUGCAUUCUUACCUUCUC | 20 | 2930 |
| myoC-4333 | + | ACUCUGCAUUCUUACCUUCUC | 21 | 4079 |

TABLE 7G-continued

| 7th Tier | | | | |
|---|---|---|---|---|
| gRNA Name | DNA Strand | Targeting Domain | Target Site Length | SEQ ID NO |
| myoC-4334 | + | CACUCUGCAUUCUUACCUUCUC | 22 | 4080 |
| myoC-4335 | + | CCACUCUGCAUUCUUACCUUCUC | 23 | 4081 |
| myoC-4336 | + | CCCACUCUGCAUUCUUACCUUCUC | 24 | 4082 |
| myoC-4337 | + | GGCAAAGAGCUUCUUCUC | 18 | 4083 |
| myoC-4338 | + | AGGCAAAGAGCUUCUUCUC | 19 | 4084 |
| myoC-2972 | + | CAGGCAAAGAGCUUCUUCUC | 20 | 1857 |
| myoC-4339 | + | CCAGGCAAAGAGCUUCUUCUC | 21 | 4085 |
| myoC-4340 | + | CCCAGGCAAAGAGCUUCUUCUC | 22 | 4086 |
| myoC-4341 | + | UCCCAGGCAAAGAGCUUCUUCUC | 23 | 4087 |
| myoC-4342 | + | GUCCCAGGCAAAGAGCUUCUUCUC | 24 | 4088 |
| myoC-4343 | + | CGAGCAGUGUCUCGGGUC | 18 | 4089 |
| myoC-4344 | + | CCGAGCAGUGUCUCGGGUC | 19 | 4090 |
| myoC-203 | + | CCCGAGCAGUGUCUCGGGUC | 20 | 589 |
| myoC-4345 | + | GCCCGAGCAGUGUCUCGGGUC | 21 | 4091 |
| myoC-4346 | + | AGCCCGAGCAGUGUCUCGGGUC | 22 | 4092 |
| myoC-4347 | + | CAGCCCGAGCAGUGUCUCGGGUC | 23 | 4093 |
| myoC-4348 | + | ACAGCCCGAGCAGUGUCUCGGGUC | 24 | 4094 |
| myoC-4349 | + | GGCUCUCCUUCAAAAUUC | 18 | 4095 |
| myoC-4350 | + | GGGCUCUCCUUCAAAAUUC | 19 | 4096 |
| myoC-328 | + | UGGGCUCUCCUUCAAAAUUC | 20 | 714 |
| myoC-4351 | + | AUGGGCUCUCCUUCAAAAUUC | 21 | 4097 |
| myoC-4352 | + | GAUGGGCUCUCCUUCAAAAUUC | 22 | 4098 |
| myoC-4353 | + | AGAUGGGCUCUCCUUCAAAAUUC | 23 | 4099 |
| myoC-4354 | + | CAGAUGGGCUCUCCUUCAAAAUUC | 24 | 4100 |
| myoC-4355 | + | UAGCUCGGACUUCAGUUC | 18 | 4101 |
| myoC-4356 | + | UUAGCUCGGACUUCAGUUC | 19 | 4102 |
| myoC-4357 | + | GUUAGCUCGGACUUCAGUUC | 20 | 4103 |
| myoC-4358 | + | AGUUAGCUCGGACUUCAGUUC | 21 | 4104 |
| myoC-4359 | + | CAGUUAGCUCGGACUUCAGUUC | 22 | 4105 |
| myoC-4360 | + | UCAGUUAGCUCGGACUUCAGUUC | 23 | 4106 |
| myoC-4361 | + | UUCAGUUAGCUCGGACUUCAGUUC | 24 | 4107 |
| myoC-4362 | + | GCAAGAGCAAUGGUUUUC | 18 | 4108 |
| myoC-4363 | + | UGCAAGAGCAAUGGUUUUC | 19 | 4109 |
| myoC-507 | + | AUGCAAGAGCAAUGGUUUUC | 20 | 849 |
| myoC-4364 | + | CAUGCAAGAGCAAUGGUUUUC | 21 | 4110 |
| myoC-4365 | + | ACAUGCAAGAGCAAUGGUUUUC | 22 | 4111 |
| myoC-4366 | + | AACAUGCAAGAGCAAUGGUUUUC | 23 | 4112 |

TABLE 7G-continued

| 7th Tier | | | | |
|---|---|---|---|---|
| gRNA Name | DNA Strand | Targeting Domain | Target Site Length | SEQ ID NO |
| myoC-4367 | + | UAACAUGCAAGAGCAAUGGUUUUC | 24 | 4113 |
| myoC-4368 | + | CCUUCAAAAUUCGGGAAG | 18 | 4114 |
| myoC-4369 | + | UCCUUCAAAAUUCGGGAAG | 19 | 4115 |
| myoC-4370 | + | CUCCUUCAAAAUUCGGGAAG | 20 | 4116 |
| myoC-4371 | + | UCUCCUUCAAAAUUCGGGAAG | 21 | 4117 |
| myoC-4372 | + | CUCUCCUUCAAAAUUCGGGAAG | 22 | 4118 |
| myoC-4373 | + | GCUCUCCUUCAAAAUUCGGGAAG | 23 | 4119 |
| myoC-4374 | + | GGCUCUCCUUCAAAAUUCGGGAAG | 24 | 4120 |
| myoC-4375 | + | CACUCCUGAGAUAGCCAG | 18 | 4121 |
| myoC-4376 | + | CCACUCCUGAGAUAGCCAG | 19 | 4122 |
| myoC-4377 | + | UCCACUCCUGAGAUAGCCAG | 20 | 4123 |
| myoC-4378 | + | CUCCACUCCUGAGAUAGCCAG | 21 | 4124 |
| myoC-4379 | + | UCUCCACUCCUGAGAUAGCCAG | 22 | 4125 |
| myoC-4380 | + | CUCUCCACUCCUGAGAUAGCCAG | 23 | 4126 |
| myoC-4381 | + | CCUCUCCACUCCUGAGAUAGCCAG | 24 | 4127 |
| myoC-4382 | + | AUAUUCGAUGCUGGCCAG | 18 | 4128 |
| myoC-4383 | + | UAUAUUCGAUGCUGGCCAG | 19 | 4129 |
| myoC-503 | + | UUAUAUUCGAUGCUGGCCAG | 20 | 845 |
| myoC-4384 | + | CUUAUAUUCGAUGCUGGCCAG | 21 | 4130 |
| myoC-4385 | + | ACUUAUAUUCGAUGCUGGCCAG | 22 | 4131 |
| myoC-4386 | + | UACUUAUAUUCGAUGCUGGCCAG | 23 | 4132 |
| myoC-4387 | + | UUACUUAUAUUCGAUGCUGGCCAG | 24 | 4133 |
| myoC-4388 | + | UCCUGGGUGUAGGGGUAG | 18 | 4134 |
| myoC-4389 | + | CUCCUGGGUGUAGGGGUAG | 19 | 4135 |
| myoC-4390 | + | UCUCCUGGGUGUAGGGGUAG | 20 | 4136 |
| myoC-4391 | + | GUCUCCUGGGUGUAGGGGUAG | 21 | 4137 |
| myoC-4392 | + | GGUCUCCUGGGUGUAGGGGUAG | 22 | 4138 |
| myoC-4393 | + | UGGUCUCCUGGGUGUAGGGGUAG | 23 | 4139 |
| myoC-4394 | + | GUGGUCUCCUGGGUGUAGGGGUAG | 24 | 4140 |
| myoC-4395 | + | AAGUGUCCAAAUUCCACG | 18 | 4141 |
| myoC-4396 | + | AAAGUGUCCAAAUUCCACG | 19 | 4142 |
| myoC-4397 | + | CAAAGUGUCCAAAUUCCACG | 20 | 4143 |
| myoC-4398 | + | CCAAAGUGUCCAAAUUCCACG | 21 | 4144 |
| myoC-4399 | + | GCCAAAGUGUCCAAAUUCCACG | 22 | 4145 |
| myoC-4400 | + | GGCCAAAGUGUCCAAAUUCCACG | 23 | 4146 |
| myoC-4401 | + | AGGCCAAAGUGUCCAAAUUCCACG | 24 | 4147 |
| myoC-4402 | + | UUCCCACAAAGUUCAAGG | 18 | 4148 |
| myoC-4403 | + | AUUCCCACAAAGUUCAAGG | 19 | 4149 |

TABLE 7G-continued

| 7th Tier | | | | |
|---|---|---|---|---|
| gRNA Name | DNA Strand | Targeting Domain | Target Site Length | SEQ ID NO |
| myoC-4404 | + | GAUUCCCACAAAGUUCAAGG | 20 | 4150 |
| myoC-4405 | + | AGAGCAAUGGUUUUCAGG | 18 | 4151 |
| myoC-4406 | + | AAGAGCAAUGGUUUUCAGG | 19 | 4152 |
| myoC-4407 | + | CAAGAGCAAUGGUUUUCAGG | 20 | 4153 |
| myoC-4408 | + | GCAAGAGCAAUGGUUUUCAGG | 21 | 4154 |
| myoC-4409 | + | UGCAAGAGCAAUGGUUUUCAGG | 22 | 4155 |
| myoC-4410 | + | AUGCAAGAGCAAUGGUUUUCAGG | 23 | 4156 |
| myoC-4411 | + | CAUGCAAGAGCAAUGGUUUUCAGG | 24 | 4157 |
| myoC-4412 | + | UACAAGGUGCCACAGAUG | 18 | 4158 |
| myoC-4413 | + | GUACAAGGUGCCACAGAUG | 19 | 4159 |
| myoC-3001 | + | UGUACAAGGUGCCACAGAUG | 20 | 2794 |
| myoC-4414 | + | GUGUACAAGGUGCCACAGAUG | 21 | 4160 |
| myoC-4415 | + | GGUGUACAAGGUGCCACAGAUG | 22 | 4161 |
| myoC-4416 | + | CGGUGUACAAGGUGCCACAGAUG | 23 | 4162 |
| myoC-4417 | + | ACGGUGUACAAGGUGCCACAGAUG | 24 | 4163 |
| myoC-4418 | + | GUCAUACUCAAAAACCUG | 18 | 4164 |
| myoC-4419 | + | GGUCAUACUCAAAAACCUG | 19 | 4165 |
| myoC-4420 | + | AGGUCAUACUCAAAAACCUG | 20 | 4166 |
| myoC-4421 | + | GAGGUCAUACUCAAAAACCUG | 21 | 4167 |
| myoC-4422 | + | UGAGGUCAUACUCAAAAACCUG | 22 | 4168 |
| myoC-4423 | + | AUGAGGUCAUACUCAAAAACCUG | 23 | 4169 |
| myoC-4424 | + | GAUGAGGUCAUACUCAAAAACCUG | 24 | 4170 |
| myoC-4425 | + | CCCUGCAUAAACUGGCUG | 18 | 4171 |
| myoC-4426 | + | GCCCUGCAUAAACUGGCUG | 19 | 4172 |
| myoC-4427 | + | AGCCCUGCAUAAACUGGCUG | 20 | 4173 |
| myoC-4428 | + | UAGCCCUGCAUAAACUGGCUG | 21 | 4174 |
| myoC-4429 | + | GUAGCCCUGCAUAAACUGGCUG | 22 | 4175 |
| myoC-4430 | + | GGUAGCCCUGCAUAAACUGGCUG | 23 | 4176 |
| myoC-4431 | + | GGGUAGCCCUGCAUAAACUGGCUG | 24 | 4177 |
| myoC-4432 | + | AGUUGACGGUAGCAUCUG | 18 | 4178 |
| myoC-4433 | + | AAGUUGACGGUAGCAUCUG | 19 | 4179 |
| myoC-2965 | + | AAAGUUGACGGUAGCAUCUG | 20 | 1853 |
| myoC-4434 | + | CAAAGUUGACGGUAGCAUCUG | 21 | 4180 |
| myoC-4435 | + | GCAAAGUUGACGGUAGCAUCUG | 22 | 4181 |
| myoC-4436 | + | AGCAAAGUUGACGGUAGCAUCUG | 23 | 4182 |
| myoC-4437 | + | AAGCAAAGUUGACGGUAGCAUCUG | 24 | 4183 |
| myoC-4438 | + | CACGUGGUCUCCUGGGUG | 18 | 4184 |

TABLE 7G-continued

| 7th Tier | | | | |
|---|---|---|---|---|
| gRNA Name | DNA Strand | Targeting Domain | Target Site Length | SEQ ID NO |
| myoC-4439 | + | CCACGUGGUCUCCUGGGUG | 19 | 4185 |
| myoC-4440 | + | UCCACGUGGUCUCCUGGGUG | 20 | 4186 |
| myoC-4441 | + | CUCCACGUGGUCUCCUGGGUG | 21 | 4187 |
| myoC-4442 | + | UCUCCACGUGGUCUCCUGGGUG | 22 | 4188 |
| myoC-4443 | + | UUCUCCACGUGGUCUCCUGGGUG | 23 | 4189 |
| myoC-4444 | + | AUUCUCCACGUGGUCUCCUGGGUG | 24 | 4190 |
| myoC-4445 | + | GAGGCUUUUCACAUCUUG | 18 | 4191 |
| myoC-4446 | + | GGAGGCUUUUCACAUCUUG | 19 | 4192 |
| myoC-2974 | + | UGGAGGCUUUUCACAUCUUG | 20 | 1859 |
| myoC-4447 | + | UUGGAGGCUUUUCACAUCUUG | 21 | 4193 |
| myoC-4448 | + | CUUGGAGGCUUUUCACAUCUUG | 22 | 4194 |
| myoC-4449 | + | GCUUGGAGGCUUUUCACAUCUUG | 23 | 4195 |
| myoC-4450 | + | AGCUUGGAGGCUUUUCACAUCUUG | 24 | 4196 |
| myoC-4451 | + | UUCUCUGGGUUCAGUUUG | 18 | 4197 |
| myoC-4452 | + | AUUCUCUGGGUUCAGUUUG | 19 | 4198 |
| myoC-4453 | + | GAUUCUCUGGGUUCAGUUUG | 20 | 4199 |
| myoC-4454 | + | AGAUUCUCUGGGUUCAGUUUG | 21 | 4200 |
| myoC-4455 | + | CAGAUUCUCUGGGUUCAGUUUG | 22 | 4201 |
| myoC-4456 | + | CCAGAUUCUCUGGGUUCAGUUUG | 23 | 4202 |
| myoC-4457 | + | UCCAGAUUCUCUGGGUUCAGUUUG | 24 | 4203 |
| myoC-4458 | + | UGGGCUCUCCUUCAAAAU | 18 | 4204 |
| myoC-4459 | + | AUGGGCUCUCCUUCAAAAU | 19 | 4205 |
| myoC-4460 | + | GAUGGGCUCUCCUUCAAAAU | 20 | 4206 |
| myoC-4461 | + | AGAUGGGCUCUCCUUCAAAAU | 21 | 4207 |
| myoC-4462 | + | CAGAUGGGCUCUCCUUCAAAAU | 22 | 4208 |
| myoC-4463 | + | CCAGAUGGGCUCUCCUUCAAAAU | 23 | 4209 |
| myoC-4464 | + | GCCAGAUGGGCUCUCCUUCAAAAU | 24 | 4210 |
| myoC-4465 | + | UGUAGCCACCCCAAGAAU | 18 | 4211 |
| myoC-4466 | + | GUGUAGCCACCCCAAGAAU | 19 | 4212 |
| myoC-2927 | + | CGUGUAGCCACCCCAAGAAU | 20 | 1823 |
| myoC-4467 | + | CCGUGUAGCCACCCCAAGAAU | 21 | 4213 |
| myoC-4468 | + | UCCGUGUAGCCACCCCAAGAAU | 22 | 4214 |
| myoC-4469 | + | GUCCGUGUAGCCACCCCAAGAAU | 23 | 4215 |
| myoC-4470 | + | UGUCCGUGUAGCCACCCCAAGAAU | 24 | 4216 |
| myoC-4471 | + | GUAUUCUAUCUGAAGCAU | 18 | 4217 |
| myoC-4472 | + | UGUAUUCUAUCUGAAGCAU | 19 | 4218 |
| myoC-4473 | + | CUGUAUUCUAUCUGAAGCAU | 20 | 4219 |
| myoC-4474 | + | ACUGUAUUCUAUCUGAAGCAU | 21 | 4220 |

TABLE 7G-continued

| 7th Tier | | | | |
|---|---|---|---|---|
| gRNA Name | DNA Strand | Targeting Domain | Target Site Length | SEQ ID NO |
| myoC-4475 | + | AACUGUAUUCUAUCUGAAGCAU | 22 | 4221 |
| myoC-4476 | + | CAACUGUAUUCUAUCUGAAGCAU | 23 | 4222 |
| myoC-4477 | + | CCAACUGUAUUCUAUCUGAAGCAU | 24 | 4223 |
| myoC-4478 | + | GACCCAACUGUAUUCUAU | 18 | 4224 |
| myoC-4479 | + | AGACCCAACUGUAUUCUAU | 19 | 4225 |
| myoC-4480 | + | GAGACCCAACUGUAUUCUAU | 20 | 4226 |
| myoC-4481 | + | UGAGACCCAACUGUAUUCUAU | 21 | 4227 |
| myoC-4482 | + | GUGAGACCCAACUGUAUUCUAU | 22 | 4228 |
| myoC-4483 | + | UGUGAGACCCAACUGUAUUCUAU | 23 | 4229 |
| myoC-4484 | + | AUGUGAGACCCAACUGUAUUCUAU | 24 | 4230 |
| myoC-4485 | + | CAGUGGCCUAGGCAGUAU | 18 | 4231 |
| myoC-4486 | + | CCAGUGGCCUAGGCAGUAU | 19 | 4232 |
| myoC-4487 | + | UCCAGUGGCCUAGGCAGUAU | 20 | 4233 |
| myoC-4488 | + | UUCCAGUGGCCUAGGCAGUAU | 21 | 4234 |
| myoC-4489 | + | UUUCCAGUGGCCUAGGCAGUAU | 22 | 4235 |
| myoC-4490 | + | CUUUCCAGUGGCCUAGGCAGUAU | 23 | 4236 |
| myoC-4491 | + | GCUUUCCAGUGGCCUAGGCAGUAU | 24 | 4237 |
| myoC-4492 | + | AUAAAGGAUAUUUAUUAU | 18 | 4238 |
| myoC-4493 | + | GAUAAAGGAUAUUUAUUAU | 19 | 4239 |
| myoC-4494 | + | AGAUAAAGGAUAUUUAUUAU | 20 | 4240 |
| myoC-4495 | + | AAGAUAAAGGAUAUUUAUUAU | 21 | 4241 |
| myoC-4496 | + | GAAGAUAAAGGAUAUUUAUUAU | 22 | 4242 |
| myoC-4497 | + | AGAAGAUAAAGGAUAUUUAUUAU | 23 | 4243 |
| myoC-4498 | + | CAGAAGAUAAAGGAUAUUUAUUAU | 24 | 4244 |
| myoC-4499 | + | CACAAUGUAAAGGGUUAU | 18 | 4245 |
| myoC-4500 | + | UCACAAUGUAAAGGGUUAU | 19 | 4246 |
| myoC-4501 | + | UUCACAAUGUAAAGGGUUAU | 20 | 4247 |
| myoC-4502 | + | UUUCACAAUGUAAAGGGUUAU | 21 | 4248 |
| myoC-4503 | + | AUUUCACAAUGUAAAGGGUUAU | 22 | 4249 |
| myoC-4504 | + | UAUUUCACAAUGUAAAGGGUUAU | 23 | 4250 |
| myoC-4505 | + | UUAUUUCACAAUGUAAAGGGUUAU | 24 | 4251 |
| myoC-4506 | + | UCUGGAUUAAUGAAAACU | 18 | 4252 |
| myoC-4507 | + | UUCUGGAUUAAUGAAAACU | 19 | 4253 |
| myoC-511 | + | CUUCUGGAUUAAUGAAAACU | 20 | 853 |
| myoC-4508 | + | CCUUCUGGAUUAAUGAAAACU | 21 | 4254 |
| myoC-4509 | + | UCCUUCUGGAUUAAUGAAAACU | 22 | 4255 |
| myoC-4510 | + | AUCCUUCUGGAUUAAUGAAAACU | 23 | 4256 |

TABLE 7G-continued

| 7th Tier | | | | |
|---|---|---|---|---|
| gRNA Name | DNA Strand | Targeting Domain | Target Site Length | SEQ ID NO |
| myoC-4511 | + | CAUCCUUCUGGAUUAAUGAAAACU | 24 | 4257 |
| myoC-4512 | + | UAGGCAGUAUGUGAACCU | 18 | 4258 |
| myoC-4513 | + | CUAGGCAGUAUGUGAACCU | 19 | 4259 |
| myoC-4514 | + | CCUAGGCAGUAUGUGAACCU | 20 | 4260 |
| myoC-4515 | + | GCCUAGGCAGUAUGUGAACCU | 21 | 4261 |
| myoC-4516 | + | GGCCUAGGCAGUAUGUGAACCU | 22 | 4262 |
| myoC-4517 | + | UGGCCUAGGCAGUAUGUGAACCU | 23 | 4263 |
| myoC-4518 | + | GUGGCCUAGGCAGUAUGUGAACCU | 24 | 4264 |
| myoC-4519 | + | GCCAUUGCCUGUACAGCU | 18 | 4265 |
| myoC-4520 | + | UGCCAUUGCCUGUACAGCU | 19 | 4266 |
| myoC-422 | + | CUGCCAUUGCCUGUACAGCU | 20 | 786 |
| myoC-4521 | + | UCUGCCAUUGCCUGUACAGCU | 21 | 4267 |
| myoC-4522 | + | UUCUGCCAUUGCCUGUACAGCU | 22 | 4268 |
| myoC-4523 | + | CUUCUGCCAUUGCCUGUACAGCU | 23 | 4269 |
| myoC-4524 | + | CCUUCUGCCAUUGCCUGUACAGCU | 24 | 4270 |
| myoC-4525 | + | UGGAGGCUUUUCACAUCU | 18 | 4271 |
| myoC-4526 | + | UUGGAGGCUUUUCACAUCU | 19 | 4272 |
| myoC-59 | + | CUUGGAGGCUUUUCACAUCU | 20 | 457 |
| myoC-4527 | + | GCUUGGAGGCUUUUCACAUCU | 21 | 4273 |
| myoC-4528 | + | AGCUUGGAGGCUUUUCACAUCU | 22 | 4274 |
| myoC-4529 | + | CAGCUUGGAGGCUUUUCACAUCU | 23 | 4275 |
| myoC-4530 | + | ACAGCUUGGAGGCUUUUCACAUCU | 24 | 4276 |
| myoC-4531 | + | GAGCAGUGUCUCGGGUCU | 18 | 4277 |
| myoC-4532 | + | CGAGCAGUGUCUCGGGUCU | 19 | 4278 |
| myoC-204 | + | CCGAGCAGUGUCUCGGGUCU | 20 | 590 |
| myoC-4533 | + | CCCGAGCAGUGUCUCGGGUCU | 21 | 4279 |
| myoC-4534 | + | GCCCGAGCAGUGUCUCGGGUCU | 22 | 4280 |
| myoC-4535 | + | AGCCCGAGCAGUGUCUCGGGUCU | 23 | 4281 |
| myoC-4536 | + | CAGCCCGAGCAGUGUCUCGGGUCU | 24 | 4282 |
| myoC-4537 | + | UCUGCAUUCUUACCUUCU | 18 | 4283 |
| myoC-4538 | + | CUCUGCAUUCUUACCUUCU | 19 | 4284 |
| myoC-4539 | + | ACUCUGCAUUCUUACCUUCU | 20 | 4285 |
| myoC-4540 | + | CACUCUGCAUUCUUACCUUCU | 21 | 4286 |
| myoC-4541 | + | CCACUCUGCAUUCUUACCUUCU | 22 | 4287 |
| myoC-4542 | + | CCCACUCUGCAUUCUUACCUUCU | 23 | 4288 |
| myoC-4543 | + | CCCCACUCUGCAUUCUUACCUUCU | 24 | 4289 |
| myoC-4544 | + | AGAUUCUCUGGGUUCAGU | 18 | 4290 |
| myoC-4545 | + | CAGAUUCUCUGGGUUCAGU | 19 | 4291 |

TABLE 7G-continued

| gRNA Name | DNA Strand | Targeting Domain | Target Site Length | SEQ ID NO |
|---|---|---|---|---|
| 7th Tier | | | | |
| myoC-4546 | + | CCAGAUUCUCUGGGUUCAGU | 20 | 4292 |
| myoC-4547 | + | UCCAGAUUCUCUGGGUUCAGU | 21 | 4293 |
| myoC-4548 | + | UUCCAGAUUCUCUGGGUUCAGU | 22 | 4294 |
| myoC-4549 | + | GUUCCAGAUUCUCUGGGUUCAGU | 23 | 4295 |
| myoC-4550 | + | AGUUCCAGAUUCUCUGGGUUCAGU | 24 | 4296 |
| myoC-4551 | + | UUCUGCUGUUCUCAGCGU | 18 | 4297 |
| myoC-4552 | + | UUUCUGCUGUUCUCAGCGU | 19 | 4298 |
| myoC-4553 | + | GUUUCUGCUGUUCUCAGCGU | 20 | 4299 |
| myoC-4554 | + | UGUUUCUGCUGUUCUCAGCGU | 21 | 4300 |
| myoC-4555 | + | UUGUUUCUGCUGUUCUCAGCGU | 22 | 4301 |
| myoC-4556 | + | AUUGUUUCUGCUGUUCUCAGCGU | 23 | 4302 |
| myoC-4557 | + | AAUUGUUUCUGCUGUUCUCAGCGU | 24 | 4303 |
| myoC-4558 | + | CCGAGCAGUGUCUCGGGU | 18 | 4304 |
| myoC-4559 | + | CCCGAGCAGUGUCUCGGGU | 19 | 4305 |
| myoC-1699 | + | GCCCGAGCAGUGUCUCGGGU | 20 | 1951 |
| myoC-4560 | + | AGCCCGAGCAGUGUCUCGGGU | 21 | 4306 |
| myoC-4561 | + | CAGCCCGAGCAGUGUCUCGGGU | 22 | 4307 |
| myoC-4562 | + | ACAGCCCGAGCAGUGUCUCGGGU | 23 | 4308 |
| myoC-4563 | + | CACAGCCCGAGCAGUGUCUCGGGU | 24 | 4309 |
| myoC-4564 | + | AGGAAGAGAACGUUGGGU | 18 | 4310 |
| myoC-4565 | + | AAGGAAGAGAACGUUGGGU | 19 | 4311 |
| myoC-4566 | + | CAAGGAAGAGAACGUUGGGU | 20 | 4312 |
| myoC-4567 | + | UCAAGGAAGAGAACGUUGGGU | 21 | 4313 |
| myoC-4568 | + | UUCAAGGAAGAGAACGUUGGGU | 22 | 4314 |
| myoC-4569 | + | GUUCAAGGAAGAGAACGUUGGGU | 23 | 4315 |
| myoC-4570 | + | AGUUCAAGGAAGAGAACGUUGGGU | 24 | 4316 |
| myoC-4571 | + | GGGCUCUCCUUCAAAAUU | 18 | 4317 |
| myoC-4572 | + | UGGGCUCUCCUUCAAAAUU | 19 | 4318 |
| myoC-327 | + | AUGGGCUCUCCUUCAAAAUU | 20 | 713 |
| myoC-4573 | + | GAUGGGCUCUCCUUCAAAAUU | 21 | 4319 |
| myoC-4574 | + | AGAUGGGCUCUCCUUCAAAAUU | 22 | 4320 |
| myoC-4575 | + | CAGAUGGGCUCUCCUUCAAAAUU | 23 | 4321 |
| myoC-4576 | + | CCAGAUGGGCUCUCCUUCAAAAUU | 24 | 4322 |
| myoC-4577 | + | UCCACAUCCUGGUAAAUU | 18 | 4323 |
| myoC-4578 | + | CUCCACAUCCUGGUAAAUU | 19 | 4324 |
| myoC-4579 | + | UCUCCACAUCCUGGUAAAUU | 20 | 4325 |
| myoC-4580 | + | UUCUCCACAUCCUGGUAAAUU | 21 | 4326 |

TABLE 7G-continued

| 7th Tier | | | | |
|---|---|---|---|---|
| gRNA Name | DNA Strand | Targeting Domain | Target Site Length | SEQ ID NO |
| myoC-4581 | + | GUUCUCCACAUCCUGGUAAAUU | 22 | 4327 |
| myoC-4582 | + | AGUUCUCCACAUCCUGGUAAAUU | 23 | 4328 |
| myoC-4583 | + | UAGUUCUCCACAUCCUGGUAAAUU | 24 | 4329 |
| myoC-4584 | + | GAGCUAUUCUGCUUCCUU | 18 | 4330 |
| myoC-4585 | + | GGAGCUAUUCUGCUUCCUU | 19 | 4331 |
| myoC-4586 | + | AGGAGCUAUUCUGCUUCCUU | 20 | 4332 |
| myoC-4587 | + | GAGGAGCUAUUCUGCUUCCUU | 21 | 4333 |
| myoC-4588 | + | AGAGGAGCUAUUCUGCUUCCUU | 22 | 4334 |
| myoC-4589 | + | CAGAGGAGCUAUUCUGCUUCCUU | 23 | 4335 |
| myoC-4590 | + | CCAGAGGAGCUAUUCUGCUUCCUU | 24 | 4336 |
| myoC-4591 | + | UCAUAUCUUAUGACAGUU | 18 | 4337 |
| myoC-4592 | + | CUCAUAUCUUAUGACAGUU | 19 | 4338 |
| myoC-2922 | + | GCUCAUAUCUUAUGACAGUU | 20 | 1821 |
| myoC-4593 | + | AGCUCAUAUCUUAUGACAGUU | 21 | 4339 |
| myoC-4594 | + | CAGCUCAUAUCUUAUGACAGUU | 22 | 4340 |
| myoC-4595 | + | UCAGCUCAUAUCUUAUGACAGUU | 23 | 4341 |
| myoC-4596 | + | UUCAGCUCAUAUCUUAUGACAGUU | 24 | 4342 |
| myoC-4597 | + | GAUUCUCUGGGUUCAGUU | 18 | 4343 |
| myoC-4598 | + | AGAUUCUCUGGGUUCAGUU | 19 | 4344 |
| myoC-446 | + | CAGAUUCUCUGGGUUCAGUU | 20 | 797 |
| myoC-4599 | + | CCAGAUUCUCUGGGUUCAGUU | 21 | 4345 |
| myoC-4600 | + | UCCAGAUUCUCUGGGUUCAGUU | 22 | 4346 |
| myoC-4601 | + | UUCCAGAUUCUCUGGGUUCAGUU | 23 | 4347 |
| myoC-4602 | + | GUUCCAGAUUCUCUGGGUUCAGUU | 24 | 4348 |
| myoC-4603 | + | UGCAAGAGCAAUGGUUUU | 18 | 4349 |
| myoC-4604 | + | AUGCAAGAGCAAUGGUUUU | 19 | 4350 |
| myoC-4605 | + | CAUGCAAGAGCAAUGGUUUU | 20 | 4351 |
| myoC-4606 | + | ACAUGCAAGAGCAAUGGUUUU | 21 | 4352 |
| myoC-4607 | + | AACAUGCAAGAGCAAUGGUUUU | 22 | 4353 |
| myoC-4608 | + | UAACAUGCAAGAGCAAUGGUUUU | 23 | 4354 |
| myoC-4609 | + | GUAACAUGCAAGAGCAAUGGUUUU | 24 | 4355 |
| myoC-4610 | - | GCCAUUGUCCUCUCCAAA | 18 | 4356 |
| myoC-4611 | - | UGCCAUUGUCCUCUCCAAA | 19 | 4357 |
| myoC-4612 | - | GUGCCAUUGUCCUCUCCAAA | 20 | 4358 |
| myoC-4613 | - | GGUGCCAUUGUCCUCUCCAAA | 21 | 4359 |
| myoC-4614 | - | AGGUGCCAUUGUCCUCUCCAAA | 22 | 4360 |
| myoC-4615 | - | AAGGUGCCAUUGUCCUCUCCAAA | 23 | 4361 |
| myoC-4616 | - | AAAGGUGCCAUUGUCCUCUCCAAA | 24 | 4362 |

TABLE 7G-continued

| 7th Tier | | | | |
|---|---|---|---|---|
| gRNA Name | DNA Strand | Targeting Domain | Target Site Length | SEQ ID NO |
| myoC-4617 | - | ACUUUGGCCUUCCAGGAA | 18 | 4363 |
| myoC-4618 | - | CACUUUGGCCUUCCAGGAA | 19 | 4364 |
| myoC-4619 | - | ACACUUUGGCCUUCCAGGAA | 20 | 4365 |
| myoC-4620 | - | GACACUUUGGCCUUCCAGGAA | 21 | 4366 |
| myoC-4621 | - | GGACACUUUGGCCUUCCAGGAA | 22 | 4367 |
| myoC-4622 | - | UGGACACUUUGGCCUUCCAGGAA | 23 | 4368 |
| myoC-4623 | - | UUGGACACUUUGGCCUUCCAGGAA | 24 | 4369 |
| myoC-4624 | - | UGGGGGGAGCAGGCUGAA | 18 | 4370 |
| myoC-4625 | - | CUGGGGGGAGCAGGCUGAA | 19 | 4371 |
| myoC-417 | - | CCUGGGGGGAGCAGGCUGAA | 20 | 781 |
| myoC-4626 | - | UCCUGGGGGGAGCAGGCUGAA | 21 | 4372 |
| myoC-4627 | - | CUCCUGGGGGGAGCAGGCUGAA | 22 | 4373 |
| myoC-4628 | - | GCUCCUGGGGGGAGCAGGCUGAA | 23 | 4374 |
| myoC-4629 | - | GGCUCCUGGGGGGAGCAGGCUGAA | 24 | 4375 |
| myoC-4630 | - | AACUGAAGUCCGAGCUAA | 18 | 4376 |
| myoC-4631 | - | GAACUGAAGUCCGAGCUAA | 19 | 4377 |
| myoC-4632 | - | GGAACUGAAGUCCGAGCUAA | 20 | 4378 |
| myoC-4633 | - | AGGAACUGAAGUCCGAGCUAA | 21 | 4379 |
| myoC-4634 | - | CAGGAACUGAAGUCCGAGCUAA | 22 | 4380 |
| myoC-4635 | - | CCAGGAACUGAAGUCCGAGCUAA | 23 | 4381 |
| myoC-4636 | - | UCCAGGAACUGAAGUCCGAGCUAA | 24 | 4382 |
| myoC-4637 | - | AAAAAGCAUAACUUCUAA | 18 | 4383 |
| myoC-4638 | - | UAAAAAGCAUAACUUCUAA | 19 | 4384 |
| myoC-495 | - | AUAAAAAGCAUAACUUCUAA | 20 | 837 |
| myoC-4639 | - | AAUAAAAAGCAUAACUUCUAA | 21 | 4385 |
| myoC-4640 | - | CAAUAAAAAGCAUAACUUCUAA | 22 | 4386 |
| myoC-4641 | - | ACAAUAAAAAGCAUAACUUCUAA | 23 | 4387 |
| myoC-4642 | - | CACAAUAAAAAGCAUAACUUCUAA | 24 | 4388 |
| myoC-4643 | - | GAGCUGAAUACCGAGACA | 18 | 4389 |
| myoC-4644 | - | UGAGCUGAAUACCGAGACA | 19 | 4390 |
| myoC-2907 | - | AUGAGCUGAAUACCGAGACA | 20 | 1809 |
| myoC-4645 | - | UAUGAGCUGAAUACCGAGACA | 21 | 4391 |
| myoC-4646 | - | AUAUGAGCUGAAUACCGAGACA | 22 | 4392 |
| myoC-4647 | - | GAUAUGAGCUGAAUACCGAGACA | 23 | 4393 |
| myoC-4648 | - | AGAUAUGAGCUGAAUACCGAGACA | 24 | 4394 |
| myoC-4649 | - | CACAUACUGCCUAGGCCA | 18 | 4395 |
| myoC-4650 | - | UCACAUACUGCCUAGGCCA | 19 | 4396 |

TABLE 7G-continued

| 7th Tier | | | | |
|---|---|---|---|---|
| gRNA Name | DNA Strand | Targeting Domain | Target Site Length | SEQ ID NO |
| myoC-4651 | − | UUCACAUACUGCCUAGGCCA | 20 | 4397 |
| myoC-4652 | − | GUUCACAUACUGCCUAGGCCA | 21 | 4398 |
| myoC-4653 | − | GGUUCACAUACUGCCUAGGCCA | 22 | 4399 |
| myoC-4654 | − | AGGUUCACAUACUGCCUAGGCCA | 23 | 4400 |
| myoC-4655 | − | AAGGUUCACAUACUGCCUAGGCCA | 24 | 4401 |
| myoC-4656 | − | CUGUGCCACCAGGCUCCA | 18 | 4402 |
| myoC-4657 | − | GCUGUGCCACCAGGCUCCA | 19 | 4403 |
| myoC-1662 | − | GGCUGUGCCACCAGGCUCCA | 20 | 1924 |
| myoC-4658 | − | GGGCUGUGCCACCAGGCUCCA | 21 | 4404 |
| myoC-4659 | − | CGGGCUGUGCCACCAGGCUCCA | 22 | 4405 |
| myoC-4660 | − | UCGGGCUGUGCCACCAGGCUCCA | 23 | 4406 |
| myoC-4661 | − | CUCGGGCUGUGCCACCAGGCUCCA | 24 | 4407 |
| myoC-4662 | − | UGUACAGGCAAUGGCAGA | 18 | 4408 |
| myoC-4663 | − | CUGUACAGGCAAUGGCAGA | 19 | 4409 |
| myoC-407 | − | GCUGUACAGGCAAUGGCAGA | 20 | 771 |
| myoC-4664 | − | AGCUGUACAGGCAAUGGCAGA | 21 | 4410 |
| myoC-4665 | − | AAGCUGUACAGGCAAUGGCAGA | 22 | 4411 |
| myoC-4666 | − | CAAGCUGUACAGGCAAUGGCAGA | 23 | 4412 |
| myoC-4667 | − | CCAAGCUGUACAGGCAAUGGCAGA | 24 | 4413 |
| myoC-4668 | − | AGAAGGUAAGAAUGCAGA | 18 | 4414 |
| myoC-4669 | − | GAGAAGGUAAGAAUGCAGA | 19 | 4415 |
| myoC-4670 | − | AGAGAAGGUAAGAAUGCAGA | 20 | 4416 |
| myoC-4671 | − | CAGAGAAGGUAAGAAUGCAGA | 21 | 4417 |
| myoC-4672 | − | CCAGAGAAGGUAAGAAUGCAGA | 22 | 4418 |
| myoC-4673 | − | UCCAGAGAAGGUAAGAAUGCAGA | 23 | 4419 |
| myoC-4674 | − | CUCCAGAGAAGGUAAGAAUGCAGA | 24 | 4420 |
| myoC-4675 | − | CUAUCUCAGGAGUGGAGA | 18 | 4421 |
| myoC-4676 | − | GCUAUCUCAGGAGUGGAGA | 19 | 4422 |
| myoC-322 | − | GGCUAUCUCAGGAGUGGAGA | 20 | 708 |
| myoC-4677 | − | UGGCUAUCUCAGGAGUGGAGA | 21 | 4423 |
| myoC-4678 | − | CUGGCUAUCUCAGGAGUGGAGA | 22 | 4424 |
| myoC-4679 | − | UCUGGCUAUCUCAGGAGUGGAGA | 23 | 4425 |
| myoC-4680 | − | AUCUGGCUAUCUCAGGAGUGGAGA | 24 | 4426 |
| myoC-4681 | − | GAGGUAGCAAGGCUGAGA | 18 | 4427 |
| myoC-4682 | − | GGAGGUAGCAAGGCUGAGA | 19 | 4428 |
| myoC-198 | − | AGGAGGUAGCAAGGCUGAGA | 20 | 584 |
| myoC-4683 | − | CAGGAGGUAGCAAGGCUGAGA | 21 | 4429 |
| myoC-4684 | − | CCAGGAGGUAGCAAGGCUGAGA | 22 | 4430 |

TABLE 7G-continued

| 7th Tier | | | | |
|---|---|---|---|---|
| gRNA Name | DNA Strand | Targeting Domain | Target Site Length | SEQ ID NO |
| myoC-4685 | – | GCCAGGAGGUAGCAAGGCUGAGA | 23 | 4431 |
| myoC-4686 | – | AGCCAGGAGGUAGCAAGGCUGAGA | 24 | 4432 |
| myoC-4687 | – | AGACAGUGAAGGCUGAGA | 18 | 4433 |
| myoC-4688 | – | GAGACAGUGAAGGCUGAGA | 19 | 4434 |
| myoC-2 | – | CGAGACAGUGAAGGCUGAGA | 20 | 405 |
| myoC-4689 | – | CCGAGACAGUGAAGGCUGAGA | 21 | 4435 |
| myoC-4690 | – | ACCGAGACAGUGAAGGCUGAGA | 22 | 4436 |
| myoC-4691 | – | UACCGAGACAGUGAAGGCUGAGA | 23 | 4437 |
| myoC-4692 | – | AUACCGAGACAGUGAAGGCUGAGA | 24 | 4438 |
| myoC-4693 | – | CAUCUGGCUAUCUCAGGA | 18 | 4439 |
| myoC-4694 | – | CCAUCUGGCUAUCUCAGGA | 19 | 4440 |
| myoC-4695 | – | CCCAUCUGGCUAUCUCAGGA | 20 | 4441 |
| myoC-4696 | – | GCCCAUCUGGCUAUCUCAGGA | 21 | 4442 |
| myoC-4697 | – | AGCCCAUCUGGCUAUCUCAGGA | 22 | 4443 |
| myoC-4698 | – | GAGCCCAUCUGGCUAUCUCAGGA | 23 | 4444 |
| myoC-4699 | – | AGAGCCCAUCUGGCUAUCUCAGGA | 24 | 4445 |
| myoC-4700 | – | GGCUAUCUCAGGAGUGGA | 18 | 4446 |
| myoC-4701 | – | UGGCUAUCUCAGGAGUGGA | 19 | 4447 |
| myoC-4702 | – | CUGGCUAUCUCAGGAGUGGA | 20 | 4448 |
| myoC-4703 | – | UCUGGCUAUCUCAGGAGUGGA | 21 | 4449 |
| myoC-4704 | – | AUCUGGCUAUCUCAGGAGUGGA | 22 | 4450 |
| myoC-4705 | – | CAUCUGGCUAUCUCAGGAGUGGA | 23 | 4451 |
| myoC-4706 | – | CCAUCUGGCUAUCUCAGGAGUGGA | 24 | 4452 |
| myoC-4707 | – | CUGGGGGGAGCAGGCUGA | 18 | 4453 |
| myoC-4708 | – | CCUGGGGGGAGCAGGCUGA | 19 | 4454 |
| myoC-416 | – | UCCUGGGGGGAGCAGGCUGA | 20 | 780 |
| myoC-4709 | – | CUCCUGGGGGGAGCAGGCUGA | 21 | 4455 |
| myoC-4710 | – | GCUCCUGGGGGGAGCAGGCUGA | 22 | 4456 |
| myoC-4711 | – | GGCUCCUGGGGGGAGCAGGCUGA | 23 | 4457 |
| myoC-4712 | – | GGGCUCCUGGGGGGAGCAGGCUGA | 24 | 4458 |
| myoC-4713 | – | CUGCUUCCCGAAUUUUGA | 18 | 4459 |
| myoC-4714 | – | CCUGCUUCCCGAAUUUUGA | 19 | 4460 |
| myoC-317 | – | UCCUGCUUCCCGAAUUUUGA | 20 | 703 |
| myoC-4715 | – | UUCCUGCUUCCCGAAUUUUGA | 21 | 4461 |
| myoC-4716 | – | GUUCCUGCUUCCCGAAUUUUGA | 22 | 4462 |
| myoC-4717 | – | AGUUCCUGCUUCCCGAAUUUUGA | 23 | 4463 |
| myoC-4718 | – | AAGUUCCUGCUUCCCGAAUUUUGA | 24 | 4464 |

TABLE 7G-continued

| 7th Tier | | | | |
|---|---|---|---|---|
| gRNA Name | DNA Strand | Targeting Domain | Target Site Length | SEQ ID NO |
| myoC-4719 | - | UAAGAUAUGAGCUGAAUA | 18 | 4465 |
| myoC-4720 | - | AUAAGAUAUGAGCUGAAUA | 19 | 4466 |
| myoC-2906 | - | CAUAAGAUAUGAGCUGAAUA | 20 | 1808 |
| myoC-4721 | - | UCAUAAGAUAUGAGCUGAAUA | 21 | 4467 |
| myoC-4722 | - | GUCAUAAGAUAUGAGCUGAAUA | 22 | 4468 |
| myoC-4723 | - | UGUCAUAAGAUAUGAGCUGAAUA | 23 | 4469 |
| myoC-4724 | - | CUGUCAUAAGAUAUGAGCUGAAUA | 24 | 4470 |
| myoC-4725 | - | UAAAAAGCAUAACUUCUA | 18 | 4471 |
| myoC-4726 | - | AUAAAAAGCAUAACUUCUA | 19 | 4472 |
| myoC-4727 | - | AAUAAAAAGCAUAACUUCUA | 20 | 4473 |
| myoC-4728 | - | CAAUAAAAAGCAUAACUUCUA | 21 | 4474 |
| myoC-4729 | - | ACAAUAAAAAGCAUAACUUCUA | 22 | 4475 |
| myoC-4730 | - | CACAAUAAAAAGCAUAACUUCUA | 23 | 4476 |
| myoC-4731 | - | CCACAAUAAAAAGCAUAACUUCUA | 24 | 4477 |
| myoC-4732 | - | UCUGGAACUCGAACAAAC | 18 | 4478 |
| myoC-4733 | - | AUCUGGAACUCGAACAAAC | 19 | 4479 |
| myoC-4734 | - | AAUCUGGAACUCGAACAAAC | 20 | 4480 |
| myoC-4735 | - | GAAUCUGGAACUCGAACAAAC | 21 | 4481 |
| myoC-4736 | - | AGAAUCUGGAACUCGAACAAAC | 22 | 4482 |
| myoC-4737 | - | GAGAAUCUGGAACUCGAACAAAC | 23 | 4483 |
| myoC-4738 | - | AGAGAAUCUGGAACUCGAACAAAC | 24 | 4484 |
| myoC-4739 | - | CUCUUUGCCUGGGACAAC | 18 | 4485 |
| myoC-4740 | - | GCUCUUUGCCUGGGACAAC | 19 | 4486 |
| myoC-2963 | - | AGCUCUUUGCCUGGGACAAC | 20 | 1851 |
| myoC-4741 | - | AAGCUCUUUGCCUGGGACAAC | 21 | 4487 |
| myoC-4742 | - | GAAGCUCUUUGCCUGGGACAAC | 22 | 4488 |
| myoC-4743 | - | AGAAGCUCUUUGCCUGGGACAAC | 23 | 4489 |
| myoC-4744 | - | AAGAAGCUCUUUGCCUGGGACAAC | 24 | 4490 |
| myoC-4745 | - | ACCCAGAGAAUCUGGAAC | 18 | 4491 |
| myoC-4746 | - | AACCCAGAGAAUCUGGAAC | 19 | 4492 |
| myoC-4747 | - | GAACCCAGAGAAUCUGGAAC | 20 | 4493 |
| myoC-4748 | - | UGAACCCAGAGAAUCUGGAAC | 21 | 4494 |
| myoC-4749 | - | CUGAACCCAGAGAAUCUGGAAC | 22 | 4495 |
| myoC-4750 | - | ACUGAACCCAGAGAAUCUGGAAC | 23 | 4496 |
| myoC-4751 | - | AACUGAACCCAGAGAAUCUGGAAC | 24 | 4497 |
| myoC-4752 | - | CUACACCCAGGAGACCAC | 18 | 4498 |
| myoC-4753 | - | CCUACACCCAGGAGACCAC | 19 | 4499 |
| myoC-4754 | - | CCCUACACCCAGGAGACCAC | 20 | 4500 |

TABLE 7G-continued

| 7th Tier | | | | |
|---|---|---|---|---|
| gRNA Name | DNA Strand | Targeting Domain | Target Site Length | SEQ ID NO |
| myoC-4755 | - | CCCCUACACCCAGGAGACCAC | 21 | 4501 |
| myoC-4756 | - | ACCCCUACACCCAGGAGACCAC | 22 | 4502 |
| myoC-4757 | - | UACCCCUACACCCAGGAGACCAC | 23 | 4503 |
| myoC-4758 | - | CUACCCCUACACCCAGGAGACCAC | 24 | 4504 |
| myoC-4759 | - | ACAUACUGCCUAGGCCAC | 18 | 4505 |
| myoC-4760 | - | CACAUACUGCCUAGGCCAC | 19 | 4506 |
| myoC-369 | - | UCACAUACUGCCUAGGCCAC | 20 | 755 |
| myoC-4761 | - | UUCACAUACUGCCUAGGCCAC | 21 | 4507 |
| myoC-4762 | - | GUUCACAUACUGCCUAGGCCAC | 22 | 4508 |
| myoC-4763 | - | GGUUCACAUACUGCCUAGGCCAC | 23 | 4509 |
| myoC-4764 | - | AGGUUCACAUACUGCCUAGGCCAC | 24 | 4510 |
| myoC-4765 | - | GGGCCAGUGUCCCCAGAC | 18 | 4511 |
| myoC-4766 | - | GGGGCCAGUGUCCCCAGAC | 19 | 4512 |
| myoC-1659 | - | AGGGGCCAGUGUCCCCAGAC | 20 | 1921 |
| myoC-4767 | - | AAGGGGCCAGUGUCCCCAGAC | 21 | 4513 |
| myoC-4768 | - | GAAGGGGCCAGUGUCCCCAGAC | 22 | 4514 |
| myoC-4769 | - | AGAAGGGGCCAGUGUCCCCAGAC | 23 | 4515 |
| myoC-4770 | - | GAGAAGGGGCCAGUGUCCCCAGAC | 24 | 4516 |
| myoC-4771 | - | UAUUCUUGGGGUGGCUAC | 18 | 4517 |
| myoC-4772 | - | GUAUUCUUGGGGUGGCUAC | 19 | 4518 |
| myoC-2917 | - | CGUAUUCUUGGGGUGGCUAC | 20 | 1816 |
| myoC-4773 | - | CCGUAUUCUUGGGGUGGCUAC | 21 | 4519 |
| myoC-4774 | - | CCCGUAUUCUUGGGGUGGCUAC | 22 | 4520 |
| myoC-4775 | - | UCCCGUAUUCUUGGGGUGGCUAC | 23 | 4521 |
| myoC-4776 | - | UUCCCGUAUUCUUGGGGUGGCUAC | 24 | 4522 |
| myoC-4777 | - | UUUUAAUGCAGUUUCUAC | 18 | 4523 |
| myoC-4778 | - | CUUUUAAUGCAGUUUCUAC | 19 | 4524 |
| myoC-4779 | - | UCUUUUAAUGCAGUUUCUAC | 20 | 4525 |
| myoC-4780 | - | UUCUUUUAAUGCAGUUUCUAC | 21 | 4526 |
| myoC-4781 | - | UUUCUUUUAAUGCAGUUUCUAC | 22 | 4527 |
| myoC-4782 | - | CUUUCUUUUAAUGCAGUUUCUAC | 23 | 4528 |
| myoC-4783 | - | UCUUUCUUUUAAUGCAGUUUCUAC | 24 | 4529 |
| myoC-4784 | - | ACGGGUGCUGUGGUGUAC | 18 | 4530 |
| myoC-4785 | - | CACGGGUGCUGUGGUGUAC | 19 | 4531 |
| myoC-4786 | - | GCACGGGUGCUGUGGUGUAC | 20 | 4532 |
| myoC-4787 | - | AGCACGGGUGCUGUGGUGUAC | 21 | 4533 |
| myoC-4788 | - | AAGCACGGGUGCUGUGGUGUAC | 22 | 4534 |

TABLE 7G-continued

| 7th Tier | | | | |
|---|---|---|---|---|
| gRNA Name | DNA Strand | Targeting Domain | Target Site Length | SEQ ID NO |
| myoC-4789 | - | AAAGCACGGGUGCUGUGGUGUAC | 23 | 4535 |
| myoC-4790 | - | GAAAGCACGGGUGCUGUGGUGUAC | 24 | 4536 |
| myoC-4791 | - | CUGGAACUCGAACAAACC | 18 | 4537 |
| myoC-4792 | - | UCUGGAACUCGAACAAACC | 19 | 4538 |
| myoC-396 | - | AUCUGGAACUCGAACAAACC | 20 | 766 |
| myoC-4793 | - | AAUCUGGAACUCGAACAAACC | 21 | 4539 |
| myoC-4794 | - | GAAUCUGGAACUCGAACAAACC | 22 | 4540 |
| myoC-4795 | - | AGAAUCUGGAACUCGAACAAACC | 23 | 4541 |
| myoC-4796 | - | GAGAAUCUGGAACUCGAACAAACC | 24 | 4542 |
| myoC-4797 | - | UCCUCUCCAAACUGAACC | 18 | 4543 |
| myoC-4798 | - | GUCCUCUCCAAACUGAACC | 19 | 4544 |
| myoC-4799 | - | UGUCCUCUCCAAACUGAACC | 20 | 4545 |
| myoC-4800 | - | UUGUCCUCUCCAAACUGAACC | 21 | 4546 |
| myoC-4801 | - | AUUGUCCUCUCCAAACUGAACC | 22 | 4547 |
| myoC-4802 | - | CAUUGUCCUCUCCAAACUGAACC | 23 | 4548 |
| myoC-4803 | - | CCAUUGUCCUCUCCAAACUGAACC | 24 | 4549 |
| myoC-4804 | - | CCCACCUACCCCUACACC | 18 | 4550 |
| myoC-4805 | - | GCCCACCUACCCCUACACC | 19 | 4551 |
| myoC-4806 | - | AGCCCACCUACCCCUACACC | 20 | 4552 |
| myoC-4807 | - | AAGCCCACCUACCCCUACACC | 21 | 4553 |
| myoC-4808 | - | CAAGCCCACCUACCCCUACACC | 22 | 4554 |
| myoC-4809 | - | CCAAGCCCACCUACCCCUACACC | 23 | 4555 |
| myoC-4810 | - | CCCAAGCCCACCUACCCCUACACC | 24 | 4556 |
| myoC-4811 | - | UCCCUGGAGCUGGCUACC | 18 | 4557 |
| myoC-4812 | - | AUCCCUGGAGCUGGCUACC | 19 | 4558 |
| myoC-2914 | - | AAUCCCUGGAGCUGGCUACC | 20 | 1814 |
| myoC-4813 | - | AAAUCCCUGGAGCUGGCUACC | 21 | 4559 |
| myoC-4814 | - | GAAAUCCCUGGAGCUGGCUACC | 22 | 4560 |
| myoC-4815 | - | GGAAAUCCCUGGAGCUGGCUACC | 23 | 4561 |
| myoC-4816 | - | AGGAAAUCCCUGGAGCUGGCUACC | 24 | 4562 |
| myoC-4817 | - | CCACCUACCCCUACACCC | 18 | 4563 |
| myoC-4818 | - | CCCACCUACCCCUACACCC | 19 | 4564 |
| myoC-360 | - | GCCCACCUACCCCUACACCC | 20 | 746 |
| myoC-4819 | - | AGCCCACCUACCCCUACACCC | 21 | 4565 |
| myoC-4820 | - | AAGCCCACCUACCCCUACACCC | 22 | 4566 |
| myoC-4821 | - | CAAGCCCACCUACCCCUACACCC | 23 | 4567 |
| myoC-4822 | - | CCAAGCCCACCUACCCCUACACCC | 24 | 4568 |
| myoC-4823 | - | AUGAUUGACUACAACCCC | 18 | 4569 |

TABLE 7G-continued

| 7th Tier | | | | |
|---|---|---|---|---|
| gRNA Name | DNA Strand | Targeting Domain | Target Site Length | SEQ ID NO |
| myoC-4824 | - | CAUGAUUGACUACAACCCC | 19 | 4570 |
| myoC-2957 | - | GCAUGAUUGACUACAACCCC | 20 | 1847 |
| myoC-4825 | - | AGCAUGAUUGACUACAACCCC | 21 | 4571 |
| myoC-4826 | - | CAGCAUGAUUGACUACAACCCC | 22 | 4572 |
| myoC-4827 | - | GCAGCAUGAUUGACUACAACCCC | 23 | 4573 |
| myoC-4828 | - | AGCAGCAUGAUUGACUACAACCCC | 24 | 4574 |
| myoC-4829 | - | UGAUUGACUACAACCCCC | 18 | 4575 |
| myoC-4830 | - | AUGAUUGACUACAACCCCC | 19 | 4576 |
| myoC-55 | - | CAUGAUUGACUACAACCCCC | 20 | 454 |
| myoC-4831 | - | GCAUGAUUGACUACAACCCCC | 21 | 4577 |
| myoC-4832 | - | AGCAUGAUUGACUACAACCCCC | 22 | 4578 |
| myoC-4833 | - | CAGCAUGAUUGACUACAACCCCC | 23 | 4579 |
| myoC-4834 | - | GCAGCAUGAUUGACUACAACCCCC | 24 | 4580 |
| myoC-4835 | - | GGCUGAGAAGGAAAUCCC | 18 | 4581 |
| myoC-4836 | - | AGGCUGAGAAGGAAAUCCC | 19 | 4582 |
| myoC-3 | - | AAGGCUGAGAAGGAAAUCCC | 20 | 406 |
| myoC-4837 | - | GAAGGCUGAGAAGGAAAUCCC | 21 | 4583 |
| myoC-4838 | - | UGAAGGCUGAGAAGGAAAUCCC | 22 | 4584 |
| myoC-4839 | - | GUGAAGGCUGAGAAGGAAAUCCC | 23 | 4585 |
| myoC-4840 | - | AGUGAAGGCUGAGAAGGAAAUCCC | 24 | 4586 |
| myoC-3549 | - | GGUUGGAAAGCAGCAGCC | 18 | 3295 |
| myoC-3550 | - | AGGUUGGAAAGCAGCAGCC | 19 | 3296 |
| myoC-107 | - | GAGGUUGGAAAGCAGCAGCC | 20 | 511 |
| myoC-4841 | - | GAGAAGAAGCUCUUUGCC | 18 | 4587 |
| myoC-4842 | - | GGAGAAGAAGCUCUUUGCC | 19 | 4588 |
| myoC-56 | - | UGGAGAAGAAGCUCUUUGCC | 20 | 455 |
| myoC-4843 | - | CUGGAGAAGAAGCUCUUUGCC | 21 | 4589 |
| myoC-4844 | - | CCUGGAGAAGAAGCUCUUUGCC | 22 | 4590 |
| myoC-4845 | - | CCCUGGAGAAGAAGCUCUUUGCC | 23 | 4591 |
| myoC-4846 | - | CCCCUGGAGAAGAAGCUCUUUGCC | 24 | 4592 |
| myoC-4847 | - | AGGCUGAGAAGGAAAUCC | 18 | 4593 |
| myoC-4848 | - | AAGGCUGAGAAGGAAAUCC | 19 | 4594 |
| myoC-2912 | - | GAAGGCUGAGAAGGAAAUCC | 20 | 1813 |
| myoC-4849 | - | UGAAGGCUGAGAAGGAAAUCC | 21 | 4595 |
| myoC-4850 | - | GUGAAGGCUGAGAAGGAAAUCC | 22 | 4596 |
| myoC-4851 | - | AGUGAAGGCUGAGAAGGAAAUCC | 23 | 4597 |
| myoC-4852 | - | CAGUGAAGGCUGAGAAGGAAAUCC | 24 | 4598 |

TABLE 7G-continued

| 7th Tier | | | | |
|---|---|---|---|---|
| gRNA Name | DNA Strand | Targeting Domain | Target Site Length | SEQ ID NO |
| myoC-4853 | - | GGAGAUGCUCAGGGCUCC | 18 | 4599 |
| myoC-4854 | - | AGGAGAUGCUCAGGGCUCC | 19 | 4600 |
| myoC-410 | - | AAGGAGAUGCUCAGGGCUCC | 20 | 774 |
| myoC-4855 | - | GAAGGAGAUGCUCAGGGCUCC | 21 | 4601 |
| myoC-4856 | - | AGAAGGAGAUGCUCAGGGCUCC | 22 | 4602 |
| myoC-4857 | - | CAGAAGGAGAUGCUCAGGGCUCC | 23 | 4603 |
| myoC-4858 | - | GCAGAAGGAGAUGCUCAGGGCUCC | 24 | 4604 |
| myoC-4859 | - | UGGACACUUUGGCCUUCC | 18 | 4605 |
| myoC-4860 | - | UUGGACACUUUGGCCUUCC | 19 | 4606 |
| myoC-316 | - | UUUGGACACUUUGGCCUUCC | 20 | 702 |
| myoC-4861 | - | AUUUGGACACUUUGGCCUUCC | 21 | 4607 |
| myoC-4862 | - | AAUUUGGACACUUUGGCCUUCC | 22 | 4608 |
| myoC-4863 | - | GAAUUUGGACACUUUGGCCUUCC | 23 | 4609 |
| myoC-4864 | - | GGAAUUUGGACACUUUGGCCUUCC | 24 | 4610 |
| myoC-4865 | - | UACCCAACGUUCUCUUCC | 18 | 4611 |
| myoC-4866 | - | UUACCCAACGUUCUCUUCC | 19 | 4612 |
| myoC-4867 | - | CUUACCCAACGUUCUCUUCC | 20 | 4613 |
| myoC-4868 | - | UCUUACCCAACGUUCUCUUCC | 21 | 4614 |
| myoC-4869 | - | UUCUUACCCAACGUUCUCUUCC | 22 | 4615 |
| myoC-4870 | - | UUUCUUACCCAACGUUCUCUUCC | 23 | 4616 |
| myoC-4871 | - | UUUUCUUACCCAACGUUCUCUUCC | 24 | 4617 |
| myoC-4872 | - | AAGGGAGAGCCAGCCAGC | 18 | 4618 |
| myoC-4873 | - | GAAGGGAGAGCCAGCCAGC | 19 | 4619 |
| myoC-3018 | - | UGAAGGGAGAGCCAGCCAGC | 20 | 2802 |
| myoC-4874 | - | CUGAAGGGAGAGCCAGCCAGC | 21 | 4620 |
| myoC-4875 | - | GCUGAAGGGAGAGCCAGCCAGC | 22 | 4621 |
| myoC-4876 | - | GGCUGAAGGGAGAGCCAGCCAGC | 23 | 4622 |
| myoC-4877 | - | AGGCUGAAGGGAGAGCCAGCCAGC | 24 | 4623 |
| myoC-3579 | - | AGGUUGGAAAGCAGCAGC | 18 | 3325 |
| myoC-3580 | - | GAGGUUGGAAAGCAGCAGC | 19 | 3326 |
| myoC-1653 | - | GGAGGUUGGAAAGCAGCAGC | 20 | 1917 |
| myoC-4878 | - | CCAGACCCGAGACACUGC | 18 | 4624 |
| myoC-4879 | - | CCCAGACCCGAGACACUGC | 19 | 4625 |
| myoC-1660 | - | CCCCAGACCCGAGACACUGC | 20 | 1922 |
| myoC-4880 | - | UCCCCAGACCCGAGACACUGC | 21 | 4626 |
| myoC-4881 | - | GUCCCCAGACCCGAGACACUGC | 22 | 4627 |
| myoC-4882 | - | UGUCCCCAGACCCGAGACACUGC | 23 | 4628 |
| myoC-4883 | - | GUGUCCCCAGACCCGAGACACUGC | 24 | 4629 |

TABLE 7G-continued

| 7th Tier | | | | |
|---|---|---|---|---|
| gRNA Name | DNA Strand | Targeting Domain | Target Site Length | SEQ ID NO |
| myoC-4884 | - | GGAGAAGAAGCUCUUUGC | 18 | 4630 |
| myoC-4885 | - | UGGAGAAGAAGCUCUUUGC | 19 | 4631 |
| myoC-2961 | - | CUGGAGAAGAAGCUCUUUGC | 20 | 1850 |
| myoC-4886 | - | CCUGGAGAAGAAGCUCUUUGC | 21 | 4632 |
| myoC-4887 | - | CCCUGGAGAAGAAGCUCUUUGC | 22 | 4633 |
| myoC-4888 | - | CCCCUGGAGAAGAAGCUCUUUGC | 23 | 4634 |
| myoC-4889 | - | CCCCCUGGAGAAGAAGCUCUUUGC | 24 | 4635 |
| myoC-4890 | - | AACUGAACCCAGAGAAUC | 18 | 4636 |
| myoC-4891 | - | AAACUGAACCCAGAGAAUC | 19 | 4637 |
| myoC-395 | - | CAAACUGAACCCAGAGAAUC | 20 | 765 |
| myoC-4892 | - | CCAAACUGAACCCAGAGAAUC | 21 | 4638 |
| myoC-4893 | - | UCCAAACUGAACCCAGAGAAUC | 22 | 4639 |
| myoC-4894 | - | CUCCAAACUGAACCCAGAGAAUC | 23 | 4640 |
| myoC-4895 | - | UCUCCAAACUGAACCCAGAGAAUC | 24 | 4641 |
| myoC-4896 | - | UCCAAGUUUUCAUUAAUC | 18 | 4642 |
| myoC-4897 | - | UUCCAAGUUUUCAUUAAUC | 19 | 4643 |
| myoC-3019 | - | UUUCCAAGUUUUCAUUAAUC | 20 | 2803 |
| myoC-4898 | - | CUUUCCAAGUUUUCAUUAAUC | 21 | 4644 |
| myoC-4899 | - | GCUUUCCAAGUUUUCAUUAAUC | 22 | 4645 |
| myoC-4900 | - | UGCUUUCCAAGUUUUCAUUAAUC | 23 | 4646 |
| myoC-4901 | - | CUGCUUUCCAAGUUUUCAUUAAUC | 24 | 4647 |
| myoC-4902 | - | GGGUGCUGUGGUGUACUC | 18 | 4648 |
| myoC-4903 | - | CGGGUGCUGUGGUGUACUC | 19 | 4649 |
| myoC-374 | - | ACGGGUGCUGUGGUGUACUC | 20 | 760 |
| myoC-4904 | - | CACGGGUGCUGUGGUGUACUC | 21 | 4650 |
| myoC-4905 | - | GCACGGGUGCUGUGGUGUACUC | 22 | 4651 |
| myoC-4906 | - | AGCACGGGUGCUGUGGUGUACUC | 23 | 4652 |
| myoC-4907 | - | AAGCACGGGUGCUGUGGUGUACUC | 24 | 4653 |
| myoC-4908 | - | GGCUGUGCCACCAGGCUC | 18 | 4654 |
| myoC-4909 | - | GGGCUGUGCCACCAGGCUC | 19 | 4655 |
| myoC-1661 | - | CGGGCUGUGCCACCAGGCUC | 20 | 1923 |
| myoC-4910 | - | UCGGGCUGUGCCACCAGGCUC | 21 | 4656 |
| myoC-4911 | - | CUCGGGCUGUGCCACCAGGCUC | 22 | 4657 |
| myoC-4912 | - | GCUCGGGCUGUGCCACCAGGCUC | 23 | 4658 |
| myoC-4913 | - | UGCUCGGGCUGUGCCACCAGGCUC | 24 | 4659 |
| myoC-4914 | - | AGGAGAUGCUCAGGGCUC | 18 | 4660 |
| myoC-4915 | - | AAGGAGAUGCUCAGGGCUC | 19 | 4661 |

TABLE 7G-continued

| 7th Tier | | | | |
|---|---|---|---|---|
| gRNA Name | DNA Strand | Targeting Domain | Target Site Length | SEQ ID NO |
| myoC-3007 | - | GAAGGAGAUGCUCAGGGCUC | 20 | 2798 |
| myoC-4916 | - | AGAAGGAGAUGCUCAGGGCUC | 21 | 4662 |
| myoC-4917 | - | CAGAAGGAGAUGCUCAGGGCUC | 22 | 4663 |
| myoC-4918 | - | GCAGAAGGAGAUGCUCAGGGCUC | 23 | 4664 |
| myoC-4919 | - | GGCAGAAGGAGAUGCUCAGGGCUC | 24 | 4665 |
| myoC-4920 | - | UUUCCAGGGCGCUGAGUC | 18 | 4666 |
| myoC-4921 | - | AUUUCCAGGGCGCUGAGUC | 19 | 4667 |
| myoC-4922 | - | UAUUUCCAGGGCGCUGAGUC | 20 | 4668 |
| myoC-4923 | - | CUAUUUCCAGGGCGCUGAGUC | 21 | 4669 |
| myoC-4924 | - | UCUAUUUCCAGGGCGCUGAGUC | 22 | 4670 |
| myoC-4925 | - | CUCUAUUUCCAGGGCGCUGAGUC | 23 | 4671 |
| myoC-4926 | - | CCUCUAUUUCCAGGGCGCUGAGUC | 24 | 4672 |
| myoC-4927 | - | ACCCUGACCAUCCCAUUC | 18 | 4673 |
| myoC-4928 | - | GACCCUGACCAUCCCAUUC | 19 | 4674 |
| myoC-2956 | - | AGACCCUGACCAUCCCAUUC | 20 | 1846 |
| myoC-4929 | - | AAGACCCUGACCAUCCCAUUC | 21 | 4675 |
| myoC-4930 | - | CAAGACCCUGACCAUCCCAUUC | 22 | 4676 |
| myoC-4931 | - | GCAAGACCCUGACCAUCCCAUUC | 23 | 4677 |
| myoC-4932 | - | AGCAAGACCCUGACCAUCCCAUUC | 24 | 4678 |
| myoC-4933 | - | CGGACAGUUCCCGUAUUC | 18 | 4679 |
| myoC-4934 | - | ACGGACAGUUCCCGUAUUC | 19 | 4680 |
| myoC-2915 | - | CACGGACAGUUCCCGUAUUC | 20 | 1815 |
| myoC-4935 | - | CCACGGACAGUUCCCGUAUUC | 21 | 4681 |
| myoC-4936 | - | ACCACGGACAGUUCCCGUAUUC | 22 | 4682 |
| myoC-4937 | - | UACCACGGACAGUUCCCGUAUUC | 23 | 4683 |
| myoC-4938 | - | CUACCACGGACAGUUCCCGUAUUC | 24 | 4684 |
| myoC-4939 | - | UUGGACACUUUGGCCUUC | 18 | 4685 |
| myoC-4940 | - | UUUGGACACUUUGGCCUUC | 19 | 4686 |
| myoC-4941 | - | AUUUGGACACUUUGGCCUUC | 20 | 4687 |
| myoC-4942 | - | AAUUUGGACACUUUGGCCUUC | 21 | 4688 |
| myoC-4943 | - | GAAUUUGGACACUUUGGCCUUC | 22 | 4689 |
| myoC-4944 | - | GGAAUUUGGACACUUUGGCCUUC | 23 | 4690 |
| myoC-4945 | - | UGGAAUUUGGACACUUUGGCCUUC | 24 | 4691 |
| myoC-4946 | - | AGGCAUAAUAGUUUCUUC | 18 | 4692 |
| myoC-4947 | - | AAGGCAUAAUAGUUUCUUC | 19 | 4693 |
| myoC-4948 | - | UAAGGCAUAAUAGUUUCUUC | 20 | 4694 |
| myoC-4949 | - | GUAAGGCAUAAUAGUUUCUUC | 21 | 4695 |
| myoC-4950 | - | UGUAAGGCAUAAUAGUUUCUUC | 22 | 4696 |

TABLE 7G-continued

| 7th Tier | | | | |
|---|---|---|---|---|
| gRNA Name | DNA Strand | Targeting Domain | Target Site Length | SEQ ID NO |
| myoC-4951 | - | CUGUAAGGCAUAAUAGUUUCUUC | 23 | 4697 |
| myoC-4952 | - | GCUGUAAGGCAUAAUAGUUUCUUC | 24 | 4698 |
| myoC-4953 | - | UCGGGGAGCCUCUAUUUC | 18 | 4699 |
| myoC-4954 | - | CUCGGGGAGCCUCUAUUUC | 19 | 4700 |
| myoC-4955 | - | ACUCGGGGAGCCUCUAUUUC | 20 | 4701 |
| myoC-4956 | - | UACUCGGGGAGCCUCUAUUUC | 21 | 4702 |
| myoC-4957 | - | GUACUCGGGGAGCCUCUAUUUC | 22 | 4703 |
| myoC-4958 | - | UGUACUCGGGGAGCCUCUAUUUC | 23 | 4704 |
| myoC-4959 | - | GUGUACUCGGGGAGCCUCUAUUUC | 24 | 4705 |
| myoC-4960 | - | GCUUCCCGAAUUUUGAAG | 18 | 4706 |
| myoC-4961 | - | UGCUUCCCGAAUUUUGAAG | 19 | 4707 |
| myoC-4962 | - | CUGCUUCCCGAAUUUUGAAG | 20 | 4708 |
| myoC-4963 | - | CCUGCUUCCCGAAUUUUGAAG | 21 | 4709 |
| myoC-4964 | - | UCCUGCUUCCCGAAUUUUGAAG | 22 | 4710 |
| myoC-4965 | - | UUCCUGCUUCCCGAAUUUUGAAG | 23 | 4711 |
| myoC-4966 | - | GUUCCUGCUUCCCGAAUUUUGAAG | 24 | 4712 |
| myoC-4967 | - | CUCUCACGCUGAGAACAG | 18 | 4713 |
| myoC-4968 | - | CCUCUCACGCUGAGAACAG | 19 | 4714 |
| myoC-4969 | - | GCCUCUCACGCUGAGAACAG | 20 | 4715 |
| myoC-4970 | - | AGCCUCUCACGCUGAGAACAG | 21 | 4716 |
| myoC-4971 | - | GAGCCUCUCACGCUGAGAACAG | 22 | 4717 |
| myoC-4972 | - | AGAGCCUCUCACGCUGAGAACAG | 23 | 4718 |
| myoC-4973 | - | GAGAGCCUCUCACGCUGAGAACAG | 24 | 4719 |
| myoC-4974 | - | CUGUACAGGCAAUGGCAG | 18 | 4720 |
| myoC-4975 | - | GCUGUACAGGCAAUGGCAG | 19 | 4721 |
| myoC-3004 | - | AGCUGUACAGGCAAUGGCAG | 20 | 2796 |
| myoC-4976 | - | AAGCUGUACAGGCAAUGGCAG | 21 | 4722 |
| myoC-4977 | - | CAAGCUGUACAGGCAAUGGCAG | 22 | 4723 |
| myoC-4978 | - | CCAAGCUGUACAGGCAAUGGCAG | 23 | 4724 |
| myoC-4979 | - | UCCAAGCUGUACAGGCAAUGGCAG | 24 | 4725 |
| myoC-4980 | - | GAAGGUAAGAAUGCAGAG | 18 | 4726 |
| myoC-4981 | - | AGAAGGUAAGAAUGCAGAG | 19 | 4727 |
| myoC-3185 | - | GAGAAGGUAAGAAUGCAGAG | 20 | 2931 |
| myoC-4982 | - | AGAGAAGGUAAGAAUGCAGAG | 21 | 4728 |
| myoC-4983 | - | CAGAGAAGGUAAGAAUGCAGAG | 22 | 4729 |
| myoC-4984 | - | CCAGAGAAGGUAAGAAUGCAGAG | 23 | 4730 |
| myoC-4985 | - | UCCAGAGAAGGUAAGAAUGCAGAG | 24 | 4731 |

TABLE 7G-continued

| 7th Tier | | | | |
|---|---|---|---|---|
| gRNA Name | DNA Strand | Targeting Domain | Target Site Length | SEQ ID NO |
| myoC-4986 | - | AUCUGGCUAUCUCAGGAG | 18 | 4732 |
| myoC-4987 | - | CAUCUGGCUAUCUCAGGAG | 19 | 4733 |
| myoC-320 | - | CCAUCUGGCUAUCUCAGGAG | 20 | 706 |
| myoC-4988 | - | CCCAUCUGGCUAUCUCAGGAG | 21 | 4734 |
| myoC-4989 | - | GCCCAUCUGGCUAUCUCAGGAG | 22 | 4735 |
| myoC-4990 | - | AGCCCAUCUGGCUAUCUCAGGAG | 23 | 4736 |
| myoC-4991 | - | GAGCCCAUCUGGCUAUCUCAGGAG | 24 | 4737 |
| myoC-4992 | - | GACUACAACCCCCUGGAG | 18 | 4738 |
| myoC-4993 | - | UGACUACAACCCCCUGGAG | 19 | 4739 |
| myoC-2960 | - | UUGACUACAACCCCCUGGAG | 20 | 1849 |
| myoC-4994 | - | AUUGACUACAACCCCCUGGAG | 21 | 4740 |
| myoC-4995 | - | GAUUGACUACAACCCCCUGGAG | 22 | 4741 |
| myoC-4996 | - | UGAUUGACUACAACCCCCUGGAG | 23 | 4742 |
| myoC-4997 | - | AUGAUUGACUACAACCCCCUGGAG | 24 | 4743 |
| myoC-4998 | - | GCUAUCUCAGGAGUGGAG | 18 | 4744 |
| myoC-4999 | - | GGCUAUCUCAGGAGUGGAG | 19 | 4745 |
| myoC-321 | - | UGGCUAUCUCAGGAGUGGAG | 20 | 707 |
| myoC-5000 | - | CUGGCUAUCUCAGGAGUGGAG | 21 | 4746 |
| myoC-5001 | - | UCUGGCUAUCUCAGGAGUGGAG | 22 | 4747 |
| myoC-5002 | - | AUCUGGCUAUCUCAGGAGUGGAG | 23 | 4748 |
| myoC-5003 | - | CAUCUGGCUAUCUCAGGAGUGGAG | 24 | 4749 |
| myoC-5004 | - | GGAGGUAGCAAGGCUGAG | 18 | 4750 |
| myoC-5005 | - | AGGAGGUAGCAAGGCUGAG | 19 | 4751 |
| myoC-1657 | - | CAGGAGGUAGCAAGGCUGAG | 20 | 1920 |
| myoC-5006 | - | CCAGGAGGUAGCAAGGCUGAG | 21 | 4752 |
| myoC-5007 | - | GCCAGGAGGUAGCAAGGCUGAG | 22 | 4753 |
| myoC-5008 | - | AGCCAGGAGGUAGCAAGGCUGAG | 23 | 4754 |
| myoC-5009 | - | CAGCCAGGAGGUAGCAAGGCUGAG | 24 | 4755 |
| myoC-5010 | - | GAGACAGUGAAGGCUGAG | 18 | 4756 |
| myoC-5011 | - | CGAGACAGUGAAGGCUGAG | 19 | 4757 |
| myoC-2910 | - | CCGAGACAGUGAAGGCUGAG | 20 | 1812 |
| myoC-5012 | - | ACCGAGACAGUGAAGGCUGAG | 21 | 4758 |
| myoC-5013 | - | UACCGAGACAGUGAAGGCUGAG | 22 | 4759 |
| myoC-5014 | - | AUACCGAGACAGUGAAGGCUGAG | 23 | 4760 |
| myoC-5015 | - | AAUACCGAGACAGUGAAGGCUGAG | 24 | 4761 |
| myoC-5016 | - | GAGAACUAGUUUGGGUAG | 18 | 4762 |
| myoC-5017 | - | GGAGAACUAGUUUGGGUAG | 19 | 4763 |
| myoC-5018 | - | UGGAGAACUAGUUUGGGUAG | 20 | 4764 |

TABLE 7G-continued

| 7th Tier | | | | |
|---|---|---|---|---|
| gRNA Name | DNA Strand | Targeting Domain | Target Site Length | SEQ ID NO |
| myoC-5019 | - | GUGGAGAACUAGUUUGGGUAG | 21 | 4765 |
| myoC-5020 | - | UGUGGAGAACUAGUUUGGGUAG | 22 | 4766 |
| myoC-5021 | - | AUGUGGAGAACUAGUUUGGGUAG | 23 | 4767 |
| myoC-5022 | - | GAUGUGGAGAACUAGUUUGGGUAG | 24 | 4768 |
| myoC-5023 | - | UACACCCAGGAGACCACG | 18 | 4769 |
| myoC-5024 | - | CUACACCCAGGAGACCACG | 19 | 4770 |
| myoC-361 | - | CCUACACCCAGGAGACCACG | 20 | 747 |
| myoC-5025 | - | CCCUACACCCAGGAGACCACG | 21 | 4771 |
| myoC-5026 | - | CCCCUACACCCAGGAGACCACG | 22 | 4772 |
| myoC-5027 | - | ACCCCUACACCCAGGAGACCACG | 23 | 4773 |
| myoC-5028 | - | UACCCCUACACCCAGGAGACCACG | 24 | 4774 |
| myoC-5029 | - | GUAGGAGAGCCUCUCACG | 18 | 4775 |
| myoC-5030 | - | GGUAGGAGAGCCUCUCACG | 19 | 4776 |
| myoC-5031 | - | GGGUAGGAGAGCCUCUCACG | 20 | 4777 |
| myoC-5032 | - | UGGGUAGGAGAGCCUCUCACG | 21 | 4778 |
| myoC-5033 | - | UUGGGUAGGAGAGCCUCUCACG | 22 | 4779 |
| myoC-5034 | - | UUUGGGUAGGAGAGCCUCUCACG | 23 | 4780 |
| myoC-5035 | - | GUUUGGGUAGGAGAGCCUCUCACG | 24 | 4781 |
| myoC-5036 | - | GGGUCAUUUACAGCACCG | 18 | 4782 |
| myoC-5037 | - | UGGGUCAUUUACAGCACCG | 19 | 4783 |
| myoC-2921 | - | CUGGGUCAUUUACAGCACCG | 20 | 1820 |
| myoC-5038 | - | UCUGGGUCAUUUACAGCACCG | 21 | 4784 |
| myoC-5039 | - | CUCUGGGUCAUUUACAGCACCG | 22 | 4785 |
| myoC-5040 | - | CCUCUGGGUCAUUUACAGCACCG | 23 | 4786 |
| myoC-5041 | - | GCCUCUGGGUCAUUUACAGCACCG | 24 | 4787 |
| myoC-5042 | - | GGUGCUGUGGUGUACUCG | 18 | 4788 |
| myoC-5043 | - | GGGUGCUGUGGUGUACUCG | 19 | 4789 |
| myoC-375 | - | CGGGUGCUGUGGUGUACUCG | 20 | 761 |
| myoC-5044 | - | ACGGGUGCUGUGGUGUACUCG | 21 | 4790 |
| myoC-5045 | - | CACGGGUGCUGUGGUGUACUCG | 22 | 4791 |
| myoC-5046 | - | GCACGGGUGCUGUGGUGUACUCG | 23 | 4792 |
| myoC-5047 | - | AGCACGGGUGCUGUGGUGUACUCG | 24 | 4793 |
| myoC-5048 | - | AGCCAGGAGGUAGCAAGG | 18 | 4794 |
| myoC-5049 | - | CAGCCAGGAGGUAGCAAGG | 19 | 4795 |
| myoC-1655 | - | GCAGCCAGGAGGUAGCAAGG | 20 | 1918 |
| myoC-5050 | - | AGCAGCCAGGAGGUAGCAAGG | 21 | 4796 |
| myoC-5051 | - | CAGCAGCCAGGAGGUAGCAAGG | 22 | 4797 |

TABLE 7G-continued

| 7th Tier | | | | |
|---|---|---|---|---|
| gRNA Name | DNA Strand | Targeting Domain | Target Site Length | SEQ ID NO |
| myoC-5052 | – | GCAGCAGCCAGGAGGUAGCAAGG | 23 | 4798 |
| myoC-5053 | – | AGCAGCAGCCAGGAGGUAGCAAGG | 24 | 4799 |
| myoC-5054 | – | UUUCAUUAAUCCAGAAGG | 18 | 4800 |
| myoC-5055 | – | UUUUCAUUAAUCCAGAAGG | 19 | 4801 |
| myoC-3021 | – | GUUUUCAUUAAUCCAGAAGG | 20 | 2805 |
| myoC-5056 | – | AGUUUUCAUUAAUCCAGAAGG | 21 | 4802 |
| myoC-5057 | – | AAGUUUUCAUUAAUCCAGAAGG | 22 | 4803 |
| myoC-5058 | – | CAAGUUUUCAUUAAUCCAGAAGG | 23 | 4804 |
| myoC-5059 | – | CCAAGUUUUCAUUAAUCCAGAAGG | 24 | 4805 |
| myoC-5060 | – | GGGGGAGCAGGCUGAAGG | 18 | 4806 |
| myoC-5061 | – | GGGGGGAGCAGGCUGAAGG | 19 | 4807 |
| myoC-3017 | – | UGGGGGGAGCAGGCUGAAGG | 20 | 2801 |
| myoC-5062 | – | CUGGGGGGAGCAGGCUGAAGG | 21 | 4808 |
| myoC-5063 | – | CCUGGGGGGAGCAGGCUGAAGG | 22 | 4809 |
| myoC-5064 | – | UCCUGGGGGGAGCAGGCUGAAGG | 23 | 4810 |
| myoC-5065 | – | CUCCUGGGGGGAGCAGGCUGAAGG | 24 | 4811 |
| myoC-5066 | – | AUACCGAGACAGUGAAGG | 18 | 4812 |
| myoC-5067 | – | AAUACCGAGACAGUGAAGG | 19 | 4813 |
| myoC-2908 | – | GAAUACCGAGACAGUGAAGG | 20 | 1810 |
| myoC-5068 | – | UGAAUACCGAGACAGUGAAGG | 21 | 4814 |
| myoC-5069 | – | CUGAAUACCGAGACAGUGAAGG | 22 | 4815 |
| myoC-5070 | – | GCUGAAUACCGAGACAGUGAAGG | 23 | 4816 |
| myoC-5071 | – | AGCUGAAUACCGAGACAGUGAAGG | 24 | 4817 |
| myoC-5072 | – | GCUCCUGGGGGGAGCAGG | 18 | 4818 |
| myoC-5073 | – | GGCUCCUGGGGGGAGCAGG | 19 | 4819 |
| myoC-3013 | – | GGGCUCCUGGGGGGAGCAGG | 20 | 2799 |
| myoC-5074 | – | AGGGCUCCUGGGGGGAGCAGG | 21 | 4820 |
| myoC-5075 | – | CAGGGCUCCUGGGGGGAGCAGG | 22 | 4821 |
| myoC-5076 | – | UCAGGGCUCCUGGGGGGAGCAGG | 23 | 4822 |
| myoC-5077 | – | CUCAGGGCUCCUGGGGGGAGCAGG | 24 | 4823 |
| myoC-5078 | – | AUGCUCAGGGCUCCUGGG | 18 | 4824 |
| myoC-5079 | – | GAUGCUCAGGGCUCCUGGG | 19 | 4825 |
| myoC-414 | – | AGAUGCUCAGGGCUCCUGGG | 20 | 778 |
| myoC-5080 | – | GAGAUGCUCAGGGCUCCUGGG | 21 | 4826 |
| myoC-5081 | – | GGAGAUGCUCAGGGCUCCUGGG | 22 | 4827 |
| myoC-5082 | – | AGGAGAUGCUCAGGGCUCCUGGG | 23 | 4828 |
| myoC-5083 | – | AAGGAGAUGCUCAGGGCUCCUGGG | 24 | 4829 |
| myoC-5084 | – | GUGGAGAACUAGUUUGGG | 18 | 4830 |

TABLE 7G-continued

| 7th Tier | | | | |
|---|---|---|---|---|
| gRNA Name | DNA Strand | Targeting Domain | Target Site Length | SEQ ID NO |
| myoC-5085 | – | UGUGGAGAACUAGUUUGGG | 19 | 4831 |
| myoC-5086 | – | AUGUGGAGAACUAGUUUGGG | 20 | 4832 |
| myoC-5087 | – | GAUGUGGAGAACUAGUUUGGG | 21 | 4833 |
| myoC-5088 | – | GGAUGUGGAGAACUAGUUUGGG | 22 | 4834 |
| myoC-5089 | – | AGGAUGUGGAGAACUAGUUUGGG | 23 | 4835 |
| myoC-5090 | – | CAGGAUGUGGAGAACUAGUUUGGG | 24 | 4836 |
| myoC-5091 | – | AAGCUGUACAGGCAAUGG | 18 | 4837 |
| myoC-5092 | – | CAAGCUGUACAGGCAAUGG | 19 | 4838 |
| myoC-3003 | – | CCAAGCUGUACAGGCAAUGG | 20 | 2795 |
| myoC-5093 | – | UCCAAGCUGUACAGGCAAUGG | 21 | 4839 |
| myoC-5094 | – | CUCCAAGCUGUACAGGCAAUGG | 22 | 4840 |
| myoC-5095 | – | CCUCCAAGCUGUACAGGCAAUGG | 23 | 4841 |
| myoC-5096 | – | GCCUCCAAGCUGUACAGGCAAUGG | 24 | 4842 |
| myoC-5097 | – | GAUGCUCAGGGCUCCUGG | 18 | 4843 |
| myoC-5098 | – | AGAUGCUCAGGGCUCCUGG | 19 | 4844 |
| myoC-413 | – | GAGAUGCUCAGGGCUCCUGG | 20 | 777 |
| myoC-5099 | – | GGAGAUGCUCAGGGCUCCUGG | 21 | 4845 |
| myoC-5100 | – | AGGAGAUGCUCAGGGCUCCUGG | 22 | 4846 |
| myoC-5101 | – | AAGGAGAUGCUCAGGGCUCCUGG | 23 | 4847 |
| myoC-5102 | – | GAAGGAGAUGCUCAGGGCUCCUGG | 24 | 4848 |
| myoC-5103 | – | GGUAAGAAUGCAGAGUGG | 18 | 4849 |
| myoC-5104 | – | AGGUAAGAAUGCAGAGUGG | 19 | 4850 |
| myoC-3188 | – | AAGGUAAGAAUGCAGAGUGG | 20 | 2934 |
| myoC-5105 | – | GAAGGUAAGAAUGCAGAGUGG | 21 | 4851 |
| myoC-5106 | – | AGAAGGUAAGAAUGCAGAGUGG | 22 | 4852 |
| myoC-5107 | – | GAGAAGGUAAGAAUGCAGAGUGG | 23 | 4853 |
| myoC-5108 | – | AGAGAAGGUAAGAAUGCAGAGUGG | 24 | 4854 |
| myoC-5109 | – | ACAUUGACUUGGCUGUGG | 18 | 4855 |
| myoC-5110 | – | GACAUUGACUUGGCUGUGG | 19 | 4856 |
| myoC-2919 | – | GGACAUUGACUUGGCUGUGG | 20 | 1818 |
| myoC-5111 | – | CGGACAUUGACUUGGCUGUGG | 21 | 4857 |
| myoC-5112 | – | ACGGACAUUGACUUGGCUGUGG | 22 | 4858 |
| myoC-5113 | – | CACGGACAUUGACUUGGCUGUGG | 23 | 4859 |
| myoC-5114 | – | ACACGGACAUUGACUUGGCUGUGG | 24 | 4860 |
| myoC-5115 | – | UCUGAAUUUACCAGGAUG | 18 | 4861 |
| myoC-5116 | – | UUCUGAAUUUACCAGGAUG | 19 | 4862 |
| myoC-353 | – | UUUCUGAAUUUACCAGGAUG | 20 | 739 |

TABLE 7G-continued

| 7th Tier | | | | |
|---|---|---|---|---|
| gRNA Name | DNA Strand | Targeting Domain | Target Site Length | SEQ ID NO |
| myoC-5117 | - | UUUUCUGAAUUUACCAGGAUG | 21 | 4863 |
| myoC-5118 | - | CUUUUCUGAAUUUACCAGGAUG | 22 | 4864 |
| myoC-5119 | - | UCUUUUCUGAAUUUACCAGGAUG | 23 | 4865 |
| myoC-5120 | - | UUCUUUUCUGAAUUUACCAGGAUG | 24 | 4866 |
| myoC-5121 | - | CUCAUCAGCCAGUUUAUG | 18 | 4867 |
| myoC-5122 | - | CCUCAUCAGCCAGUUUAUG | 19 | 4868 |
| myoC-5123 | - | ACCUCAUCAGCCAGUUUAUG | 20 | 4869 |
| myoC-5124 | - | GACCUCAUCAGCCAGUUUAUG | 21 | 4870 |
| myoC-5125 | - | UGACCUCAUCAGCCAGUUUAUG | 22 | 4871 |
| myoC-5126 | - | AUGACCUCAUCAGCCAGUUUAUG | 23 | 4872 |
| myoC-5127 | - | UAUGACCUCAUCAGCCAGUUUAUG | 24 | 4873 |
| myoC-5128 | - | AUUGACUACAACCCCCUG | 18 | 4874 |
| myoC-5129 | - | GAUUGACUACAACCCCCUG | 19 | 4875 |
| myoC-2959 | - | UGAUUGACUACAACCCCCUG | 20 | 1848 |
| myoC-5130 | - | AUGAUUGACUACAACCCCCUG | 21 | 4876 |
| myoC-5131 | - | CAUGAUUGACUACAACCCCCUG | 22 | 4877 |
| myoC-5132 | - | GCAUGAUUGACUACAACCCCCUG | 23 | 4878 |
| myoC-5133 | - | AGCAUGAUUGACUACAACCCCCUG | 24 | 4879 |
| myoC-5134 | - | AGAUGCUCAGGGCUCCUG | 18 | 4880 |
| myoC-5135 | - | GAGAUGCUCAGGGCUCCUG | 19 | 4881 |
| myoC-412 | - | GGAGAUGCUCAGGGCUCCUG | 20 | 776 |
| myoC-5136 | - | AGGAGAUGCUCAGGGCUCCUG | 21 | 4882 |
| myoC-5137 | - | AAGGAGAUGCUCAGGGCUCCUG | 22 | 4883 |
| myoC-5138 | - | GAAGGAGAUGCUCAGGGCUCCUG | 23 | 4884 |
| myoC-5139 | - | AGAAGGAGAUGCUCAGGGCUCCUG | 24 | 4885 |
| myoC-5140 | - | CCUGGGGGGAGCAGGCUG | 18 | 4886 |
| myoC-5141 | - | UCCUGGGGGGAGCAGGCUG | 19 | 4887 |
| myoC-3014 | - | CUCCUGGGGGGAGCAGGCUG | 20 | 2800 |
| myoC-5142 | - | GCUCCUGGGGGGAGCAGGCUG | 21 | 4888 |
| myoC-5143 | - | GGCUCCUGGGGGGAGCAGGCUG | 22 | 4889 |
| myoC-5144 | - | GGGCUCCUGGGGGGAGCAGGCUG | 23 | 4890 |
| myoC-5145 | - | AGGGCUCCUGGGGGGAGCAGGCUG | 24 | 4891 |
| myoC-5146 | - | AGGUAAGAAUGCAGAGUG | 18 | 4892 |
| myoC-5147 | - | AAGGUAAGAAUGCAGAGUG | 19 | 4893 |
| myoC-3189 | - | GAAGGUAAGAAUGCAGAGUG | 20 | 2935 |
| myoC-5148 | - | AGAAGGUAAGAAUGCAGAGUG | 21 | 4894 |
| myoC-5149 | - | GAGAAGGUAAGAAUGCAGAGUG | 22 | 4895 |
| myoC-5150 | - | AGAGAAGGUAAGAAUGCAGAGUG | 23 | 4896 |

TABLE 7G-continued

| 7th Tier | | | | |
|---|---|---|---|---|
| gRNA Name | DNA Strand | Targeting Domain | Target Site Length | SEQ ID NO |
| myoC-5151 | - | CAGAGAAGGUAAGAAUGCAGAGUG | 24 | 4897 |
| myoC-5152 | - | CUGGCUAUCUCAGGAGUG | 18 | 4898 |
| myoC-5153 | - | UCUGGCUAUCUCAGGAGUG | 19 | 4899 |
| myoC-5154 | - | AUCUGGCUAUCUCAGGAGUG | 20 | 4900 |
| myoC-5155 | - | CAUCUGGCUAUCUCAGGAGUG | 21 | 4901 |
| myoC-5156 | - | CCAUCUGGCUAUCUCAGGAGUG | 22 | 4902 |
| myoC-5157 | - | CCCAUCUGGCUAUCUCAGGAGUG | 23 | 4903 |
| myoC-5158 | - | GCCCAUCUGGCUAUCUCAGGAGUG | 24 | 4904 |
| myoC-5159 | - | UGAAUUUACCAGGAUGUG | 18 | 4905 |
| myoC-5160 | - | CUGAAUUUACCAGGAUGUG | 19 | 4906 |
| myoC-5161 | - | UCUGAAUUUACCAGGAUGUG | 20 | 4907 |
| myoC-5162 | - | UUCUGAAUUUACCAGGAUGUG | 21 | 4908 |
| myoC-5163 | - | UUUCUGAAUUUACCAGGAUGUG | 22 | 4909 |
| myoC-5164 | - | UUUUCUGAAUUUACCAGGAUGUG | 23 | 4910 |
| myoC-5165 | - | CUUUUCUGAAUUUACCAGGAUGUG | 24 | 4911 |
| myoC-5166 | - | UCUCUUCCUUGAACUUUG | 18 | 4912 |
| myoC-5167 | - | UUCUCUUCCUUGAACUUUG | 19 | 4913 |
| myoC-3190 | - | GUUCUCUUCCUUGAACUUUG | 20 | 2936 |
| myoC-5168 | - | CGUUCUCUUCCUUGAACUUUG | 21 | 4914 |
| myoC-5169 | - | ACGUUCUCUUCCUUGAACUUUG | 22 | 4915 |
| myoC-5170 | - | AACGUUCUCUUCCUUGAACUUUG | 23 | 4916 |
| myoC-5171 | - | CAACGUUCUCUUCCUUGAACUUUG | 24 | 4917 |
| myoC-5172 | - | CCUGCUUCCCGAAUUUUG | 18 | 4918 |
| myoC-5173 | - | UCCUGCUUCCCGAAUUUUG | 19 | 4919 |
| myoC-5174 | - | UUCCUGCUUCCCGAAUUUUG | 20 | 4920 |
| myoC-5175 | - | GUUCCUGCUUCCCGAAUUUUG | 21 | 4921 |
| myoC-5176 | - | AGUUCCUGCUUCCCGAAUUUUG | 22 | 4922 |
| myoC-5177 | - | AAGUUCCUGCUUCCCGAAUUUUG | 23 | 4923 |
| myoC-5178 | - | GAAGUUCCUGCUUCCCGAAUUUUG | 24 | 4924 |
| myoC-5179 | - | AAACUGAACCCAGAGAAU | 18 | 4925 |
| myoC-5180 | - | CAAACUGAACCCAGAGAAU | 19 | 4926 |
| myoC-5181 | - | CCAAACUGAACCCAGAGAAU | 20 | 4927 |
| myoC-5182 | - | UCCAAACUGAACCCAGAGAAU | 21 | 4928 |
| myoC-5183 | - | CUCCAAACUGAACCCAGAGAAU | 22 | 4929 |
| myoC-5184 | - | UCUCCAAACUGAACCCAGAGAAU | 23 | 4930 |
| myoC-5185 | - | CUCUCCAAACUGAACCCAGAGAAU | 24 | 4931 |
| myoC-5186 | - | GCAGUUUCUACGUGGAAU | 18 | 4932 |

TABLE 7G-continued

| 7th Tier | | | | |
|---|---|---|---|---|
| gRNA Name | DNA Strand | Targeting Domain | Target Site Length | SEQ ID NO |
| myoC-5187 | - | UGCAGUUUCUACGUGGAAU | 19 | 4933 |
| myoC-5188 | - | AUGCAGUUUCUACGUGGAAU | 20 | 4934 |
| myoC-5189 | - | AAUGCAGUUUCUACGUGGAAU | 21 | 4935 |
| myoC-5190 | - | UAAUGCAGUUUCUACGUGGAAU | 22 | 4936 |
| myoC-5191 | - | UUAAUGCAGUUUCUACGUGGAAU | 23 | 4937 |
| myoC-5192 | - | UUUAAUGCAGUUUCUACGUGGAAU | 24 | 4938 |
| myoC-5193 | - | CAUCAAGCUCUCCAAGAU | 18 | 4939 |
| myoC-5194 | - | ACAUCAAGCUCUCCAAGAU | 19 | 4940 |
| myoC-2964 | - | GACAUCAAGCUCUCCAAGAU | 20 | 1852 |
| myoC-5195 | - | UGACAUCAAGCUCUCCAAGAU | 21 | 4941 |
| myoC-5196 | - | AUGACAUCAAGCUCUCCAAGAU | 22 | 4942 |
| myoC-5197 | - | UAUGACAUCAAGCUCUCCAAGAU | 23 | 4943 |
| myoC-5198 | - | UUAUGACAUCAAGCUCUCCAAGAU | 24 | 4944 |
| myoC-5199 | - | CCAGAACUGUCAUAAGAU | 18 | 4945 |
| myoC-5200 | - | UCCAGAACUGUCAUAAGAU | 19 | 4946 |
| myoC-2904 | - | GUCCAGAACUGUCAUAAGAU | 20 | 1806 |
| myoC-5201 | - | AGUCCAGAACUGUCAUAAGAU | 21 | 4947 |
| myoC-5202 | - | GAGUCCAGAACUGUCAUAAGAU | 22 | 4948 |
| myoC-5203 | - | UGAGUCCAGAACUGUCAUAAGAU | 23 | 4949 |
| myoC-5204 | - | CUGAGUCCAGAACUGUCAUAAGAU | 24 | 4950 |
| myoC-5205 | - | UUCUGAAUUUACCAGGAU | 18 | 4951 |
| myoC-5206 | - | UUUCUGAAUUUACCAGGAU | 19 | 4952 |
| myoC-5207 | - | UUUUCUGAAUUUACCAGGAU | 20 | 4953 |
| myoC-5208 | - | CUUUUCUGAAUUUACCAGGAU | 21 | 4954 |
| myoC-5209 | - | UCUUUUCUGAAUUUACCAGGAU | 22 | 4955 |
| myoC-5210 | - | UUCUUUUCUGAAUUUACCAGGAU | 23 | 4956 |
| myoC-5211 | - | UUUCUUUUCUGAAUUUACCAGGAU | 24 | 4957 |
| myoC-5212 | - | CAAGUAUGGUGUGUGGAU | 18 | 4958 |
| myoC-5213 | - | GCAAGUAUGGUGUGUGGAU | 19 | 4959 |
| myoC-5214 | - | GGCAAGUAUGGUGUGUGGAU | 20 | 4960 |
| myoC-5215 | - | UGGCAAGUAUGGUGUGUGGAU | 21 | 4961 |
| myoC-5216 | - | CUGGCAAGUAUGGUGUGUGGAU | 22 | 4962 |
| myoC-5217 | - | ACUGGCAAGUAUGGUGUGUGGAU | 23 | 4963 |
| myoC-5218 | - | UACUGGCAAGUAUGGUGUGUGGAU | 24 | 4964 |
| myoC-5219 | - | UUCAAGUUUUCUUGUGAU | 18 | 4965 |
| myoC-5220 | - | GUUCAAGUUUUCUUGUGAU | 19 | 4966 |
| myoC-5221 | - | AGUUCAAGUUUUCUUGUGAU | 20 | 4967 |
| myoC-5222 | - | UAGUUCAAGUUUUCUUGUGAU | 21 | 4968 |

TABLE 7G-continued

| 7th Tier | | | | |
|---|---|---|---|---|
| gRNA Name | DNA Strand | Targeting Domain | Target Site Length | SEQ ID NO |
| myoC-5223 | - | AUAGUUCAAGUUUUCUUGUGAU | 22 | 4969 |
| myoC-5224 | - | CAUAGUUCAAGUUUUCUUGUGAU | 23 | 4970 |
| myoC-5225 | - | ACAUAGUUCAAGUUUUCUUGUGAU | 24 | 4971 |
| myoC-5226 | - | CGGGUGCUGUGGUGUACU | 18 | 4972 |
| myoC-5227 | - | ACGGGUGCUGUGGUGUACU | 19 | 4973 |
| myoC-373 | - | CACGGGUGCUGUGGUGUACU | 20 | 759 |
| myoC-5228 | - | GCACGGGUGCUGUGGUGUACU | 21 | 4974 |
| myoC-5229 | - | AGCACGGGUGCUGUGGUGUACU | 22 | 4975 |
| myoC-5230 | - | AAGCACGGGUGCUGUGGUGUACU | 23 | 4976 |
| myoC-5231 | - | AAAGCACGGGUGCUGUGGUGUACU | 24 | 4977 |
| myoC-5232 | - | UGGAACUCGAACAAACCU | 18 | 4978 |
| myoC-5233 | - | CUGGAACUCGAACAAACCU | 19 | 4979 |
| myoC-397 | - | UCUGGAACUCGAACAAACCU | 20 | 767 |
| myoC-5234 | - | AUCUGGAACUCGAACAAACCU | 21 | 4980 |
| myoC-5235 | - | AAUCUGGAACUCGAACAAACCU | 22 | 4981 |
| myoC-5236 | - | GAAUCUGGAACUCGAACAAACCU | 23 | 4982 |
| myoC-5237 | - | AGAAUCUGGAACUCGAACAAACCU | 24 | 4983 |
| myoC-5238 | - | GAGAUGCUCAGGGCUCCU | 18 | 4984 |
| myoC-5239 | - | GGAGAUGCUCAGGGCUCCU | 19 | 4985 |
| myoC-411 | - | AGGAGAUGCUCAGGGCUCCU | 20 | 775 |
| myoC-5240 | - | AAGGAGAUGCUCAGGGCUCCU | 21 | 4986 |
| myoC-5241 | - | GAAGGAGAUGCUCAGGGCUCCU | 22 | 4987 |
| myoC-5242 | - | AGAAGGAGAUGCUCAGGGCUCCU | 23 | 4988 |
| myoC-5243 | - | CAGAAGGAGAUGCUCAGGGCUCCU | 24 | 4989 |
| myoC-5244 | - | AGGAGAGCCUCUCACGCU | 18 | 4990 |
| myoC-5245 | - | UAGGAGAGCCUCUCACGCU | 19 | 4991 |
| myoC-5246 | - | GUAGGAGAGCCUCUCACGCU | 20 | 4992 |
| myoC-5247 | - | GGUAGGAGAGCCUCUCACGCU | 21 | 4993 |
| myoC-5248 | - | GGGUAGGAGAGCCUCUCACGCU | 22 | 4994 |
| myoC-5249 | - | UGGGUAGGAGAGCCUCUCACGCU | 23 | 4995 |
| myoC-5250 | - | UUGGGUAGGAGAGCCUCUCACGCU | 24 | 4996 |
| myoC-5251 | - | CCAGGAGGUAGCAAGGCU | 18 | 4997 |
| myoC-5252 | - | GCCAGGAGGUAGCAAGGCU | 19 | 4998 |
| myoC-1656 | - | AGCCAGGAGGUAGCAAGGCU | 20 | 1919 |
| myoC-5253 | - | CAGCCAGGAGGUAGCAAGGCU | 21 | 4999 |
| myoC-5254 | - | GCAGCCAGGAGGUAGCAAGGCU | 22 | 5000 |
| myoC-5255 | - | AGCAGCCAGGAGGUAGCAAGGCU | 23 | 5001 |

TABLE 7G-continued

| 7th Tier | | | | |
|---|---|---|---|---|
| gRNA Name | DNA Strand | Targeting Domain | Target Site Length | SEQ ID NO |
| myoC-5256 | - | CAGCAGCCAGGAGGUAGCAAGGCU | 24 | 5002 |
| myoC-5257 | - | ACCGAGACAGUGAAGGCU | 18 | 5003 |
| myoC-5258 | - | UACCGAGACAGUGAAGGCU | 19 | 5004 |
| myoC-2909 | - | AUACCGAGACAGUGAAGGCU | 20 | 1811 |
| myoC-5259 | - | AAUACCGAGACAGUGAAGGCU | 21 | 5005 |
| myoC-5260 | - | GAAUACCGAGACAGUGAAGGCU | 22 | 5006 |
| myoC-5261 | - | UGAAUACCGAGACAGUGAAGGCU | 23 | 5007 |
| myoC-5262 | - | CUGAAUACCGAGACAGUGAAGGCU | 24 | 5008 |
| myoC-5263 | - | AUGGCAGAAGGAGAUGCU | 18 | 5009 |
| myoC-5264 | - | AAUGGCAGAAGGAGAUGCU | 19 | 5010 |
| myoC-3006 | - | CAAUGGCAGAAGGAGAUGCU | 20 | 2797 |
| myoC-5265 | - | GCAAUGGCAGAAGGAGAUGCU | 21 | 5011 |
| myoC-5266 | - | GGCAAUGGCAGAAGGAGAUGCU | 22 | 5012 |
| myoC-5267 | - | AGGCAAUGGCAGAAGGAGAUGCU | 23 | 5013 |
| myoC-5268 | - | CAGGCAAUGGCAGAAGGAGAUGCU | 24 | 5014 |
| myoC-5269 | - | GAGCCCAUCUGGCUAUCU | 18 | 5015 |
| myoC-5270 | - | AGAGCCCAUCUGGCUAUCU | 19 | 5016 |
| myoC-5271 | - | GAGAGCCCAUCUGGCUAUCU | 20 | 5017 |
| myoC-5272 | - | GGAGAGCCCAUCUGGCUAUCU | 21 | 5018 |
| myoC-5273 | - | AGGAGAGCCCAUCUGGCUAUCU | 22 | 5019 |
| myoC-5274 | - | AAGGAGAGCCCAUCUGGCUAUCU | 23 | 5020 |
| myoC-5275 | - | GAAGGAGAGCCCAUCUGGCUAUCU | 24 | 5021 |
| myoC-5276 | - | AUUCAGGAAUUGUAGUCU | 18 | 5022 |
| myoC-5277 | - | UAUUCAGGAAUUGUAGUCU | 19 | 5023 |
| myoC-3025 | - | CUAUUCAGGAAUUGUAGUCU | 20 | 2808 |
| myoC-5278 | - | ACUAUUCAGGAAUUGUAGUCU | 21 | 5024 |
| myoC-5279 | - | AACUAUUCAGGAAUUGUAGUCU | 22 | 5025 |
| myoC-5280 | - | UAACUAUUCAGGAAUUGUAGUCU | 23 | 5026 |
| myoC-5281 | - | CUAACUAUUCAGGAAUUGUAGUCU | 24 | 5027 |
| myoC-5282 | - | CCUUCCAGGAACUGAAGU | 18 | 5028 |
| myoC-5283 | - | GCCUUCCAGGAACUGAAGU | 19 | 5029 |
| myoC-5284 | - | GGCCUUCCAGGAACUGAAGU | 20 | 5030 |
| myoC-5285 | - | UGGCCUUCCAGGAACUGAAGU | 21 | 5031 |
| myoC-5286 | - | UUGGCCUUCCAGGAACUGAAGU | 22 | 5032 |
| myoC-5287 | - | UUUGGCCUUCCAGGAACUGAAGU | 23 | 5033 |
| myoC-5288 | - | CUUUGGCCUUCCAGGAACUGAAGU | 24 | 5034 |
| myoC-5289 | - | AAGGUAAGAAUGCAGAGU | 18 | 5035 |
| myoC-5290 | - | GAAGGUAAGAAUGCAGAGU | 19 | 5036 |

TABLE 7G-continued

| 7th Tier | | | | |
|---|---|---|---|---|
| gRNA Name | DNA Strand | Targeting Domain | Target Site Length | SEQ ID NO |
| myoC-3191 | - | AGAAGGUAAGAAUGCAGAGU | 20 | 2937 |
| myoC-5291 | - | GAGAAGGUAAGAAUGCAGAGU | 21 | 5037 |
| myoC-5292 | - | AGAGAAGGUAAGAAUGCAGAGU | 22 | 5038 |
| myoC-5293 | - | CAGAGAAGGUAAGAAUGCAGAGU | 23 | 5039 |
| myoC-5294 | - | CCAGAGAAGGUAAGAAUGCAGAGU | 24 | 5040 |
| myoC-5295 | - | CUAUUCAGGAAUUGUAGU | 18 | 5041 |
| myoC-5296 | - | ACUAUUCAGGAAUUGUAGU | 19 | 5042 |
| myoC-3024 | - | AACUAUUCAGGAAUUGUAGU | 20 | 2807 |
| myoC-5297 | - | UAACUAUUCAGGAAUUGUAGU | 21 | 5043 |
| myoC-5298 | - | CUAACUAUUCAGGAAUUGUAGU | 22 | 5044 |
| myoC-5299 | - | UCUAACUAUUCAGGAAUUGUAGU | 23 | 5045 |
| myoC-5300 | - | AUCUAACUAUUCAGGAAUUGUAGU | 24 | 5046 |
| myoC-5301 | - | GGAGAGGGAGACACCGGU | 18 | 5047 |
| myoC-5302 | - | UGGAGAGGGAGACACCGGU | 19 | 5048 |
| myoC-5303 | - | GUGGAGAGGGAGACACCGGU | 20 | 5049 |
| myoC-5304 | - | AGUGGAGAGGGAGACACCGGU | 21 | 5050 |
| myoC-5305 | - | GAGUGGAGAGGGAGACACCGGU | 22 | 5051 |
| myoC-5306 | - | GGAGUGGAGAGGGAGACACCGGU | 23 | 5052 |
| myoC-5307 | - | AGGAGUGGAGAGGGAGACACCGGU | 24 | 5053 |
| myoC-5308 | - | UGGAGAACUAGUUUGGGU | 18 | 5054 |
| myoC-5309 | - | GUGGAGAACUAGUUUGGGU | 19 | 5055 |
| myoC-356 | - | UGUGGAGAACUAGUUUGGGU | 20 | 742 |
| myoC-5310 | - | AUGUGGAGAACUAGUUUGGGU | 21 | 5056 |
| myoC-5311 | - | GAUGUGGAGAACUAGUUUGGGU | 22 | 5057 |
| myoC-5312 | - | GGAUGUGGAGAACUAGUUUGGGU | 23 | 5058 |
| myoC-5313 | - | AGGAUGUGGAGAACUAGUUUGGGU | 24 | 5059 |
| myoC-5314 | - | GUUCCUGCUUCCCGAAUU | 18 | 5060 |
| myoC-5315 | - | AGUUCCUGCUUCCCGAAUU | 19 | 5061 |
| myoC-5316 | - | AAGUUCCUGCUUCCCGAAUU | 20 | 5062 |
| myoC-5317 | - | GAAGUUCCUGCUUCCCGAAUU | 21 | 5063 |
| myoC-5318 | - | UGAAGUUCCUGCUUCCCGAAUU | 22 | 5064 |
| myoC-5319 | - | CUGAAGUUCCUGCUUCCCGAAUU | 23 | 5065 |
| myoC-5320 | - | ACUGAAGUUCCUGCUUCCCGAAUU | 24 | 5066 |
| myoC-5321 | - | CACAUAACCCUUUACAUU | 18 | 5067 |
| myoC-5322 | - | UCACAUAACCCUUUACAUU | 19 | 5068 |
| myoC-5323 | - | CUCACAUAACCCUUUACAUU | 20 | 5069 |
| myoC-5324 | - | UCUCACAUAACCCUUUACAUU | 21 | 5070 |

TABLE 7G-continued

| 7th Tier | | | | |
|---|---|---|---|---|
| gRNA Name | DNA Strand | Targeting Domain | Target Site Length | SEQ ID NO |
| myoC-5325 | - | GUCUCACAUAACCCUUUACAUU | 22 | 5071 |
| myoC-5326 | - | GGUCUCACAUAACCCUUUACAUU | 23 | 5072 |
| myoC-5327 | - | GGGUCUCACAUAACCCUUUACAUU | 24 | 5073 |
| myoC-5328 | - | UCAAGUUUUCUUGUGAUU | 18 | 5074 |
| myoC-5329 | - | UUCAAGUUUUCUUGUGAUU | 19 | 5075 |
| myoC-490 | - | GUUCAAGUUUUCUUGUGAUU | 20 | 832 |
| myoC-5330 | - | AGUUCAAGUUUUCUUGUGAUU | 21 | 5076 |
| myoC-5331 | - | UAGUUCAAGUUUUCUUGUGAUU | 22 | 5077 |
| myoC-5332 | - | AUAGUUCAAGUUUUCUUGUGAUU | 23 | 5078 |
| myoC-5333 | - | CAUAGUUCAAGUUUUCUUGUGAUU | 24 | 5079 |
| myoC-5334 | - | GGUCACCAUCUAACUAUU | 18 | 5080 |
| myoC-5335 | - | UGGUCACCAUCUAACUAUU | 19 | 5081 |
| myoC-3022 | - | AUGGUCACCAUCUAACUAUU | 20 | 2806 |
| myoC-5336 | - | CAUGGUCACCAUCUAACUAUU | 21 | 5082 |
| myoC-5337 | - | ACAUGGUCACCAUCUAACUAUU | 22 | 5083 |
| myoC-5338 | - | AACAUGGUCACCAUCUAACUAUU | 23 | 5084 |
| myoC-5339 | - | GAACAUGGUCACCAUCUAACUAUU | 24 | 5085 |
| myoC-5340 | - | UAUCUUCUGUCAGCAUUU | 18 | 5086 |
| myoC-5341 | - | UUAUCUUCUGUCAGCAUUU | 19 | 5087 |
| myoC-5342 | - | UUUAUCUUCUGUCAGCAUUU | 20 | 5088 |
| myoC-5343 | - | CUUUAUCUUCUGUCAGCAUUU | 21 | 5089 |
| myoC-5344 | - | CCUUUAUCUUCUGUCAGCAUUU | 22 | 5090 |
| myoC-5345 | - | UCCUUUAUCUUCUGUCAGCAUUU | 23 | 5091 |
| myoC-5346 | - | AUCCUUUAUCUUCUGUCAGCAUUU | 24 | 5092 |
| myoC-5347 | - | UUCUCUUCCUUGAACUUU | 18 | 5093 |
| myoC-5348 | - | GUUCUCUUCCUUGAACUUU | 19 | 5094 |
| myoC-5349 | - | CGUUCUCUUCCUUGAACUUU | 20 | 5095 |
| myoC-5350 | - | ACGUUCUCUUCCUUGAACUUU | 21 | 5096 |
| myoC-5351 | - | AACGUUCUCUUCCUUGAACUUU | 22 | 5097 |
| myoC-5352 | - | CAACGUUCUCUUCCUUGAACUUU | 23 | 5098 |
| myoC-5353 | - | CCAACGUUCUCUUCCUUGAACUUU | 24 | 5099 |

Table 8A provides exemplary targeting domains for knocking out the MYOC gene selected according to the first tier parameters. The targeting domains bind within the first 500 bp of the coding sequence (e.g., within 500 bp downstream from the start codon), have a high level of orthogonality and start with a 5'G. It is contemplated herein that in an embodiment the targeting domain hybridizes to the target domain through complementary base pairing. Any of the targeting domains in the Table 1 can be used with a *N. meningitidis* Cas9 molecule that generates a double stranded break (Cas9 nuclease) or a single-stranded break (Cas9 nickase).

TABLE 8A

| 1st Tier | | | | |
|---|---|---|---|---|
| gRNA Name | DNA Strand | Targeting Domain | Target Site Length | SEQ ID NO |
| myoC-5354 | - | GAUGCCAGCUGUCCAGC | 17 | 5100 |
| myoC-3082 | + | GCCUGGCUCUGCUCUGGGCA | 20 | 2844 |
| myoC-5355 | + | GCACAGAAGAACCUCAUUGC | 20 | 5101 |
| myoC-5356 | - | GGUUCUUCUGUGCACGUUGC | 20 | 5102 |

Table 8B provides exemplary targeting domains for knocking out the MYOC gene selected according to the second tier parameters. The targeting domains bind within the first 500 bp of the coding sequence (e.g., within 500 bp downstream from the start codon) and have a high level of orthogonality. It is contemplated herein that in an embodiment the targeting domain hybridizes to the target domain through complementary base pairing. Any of the targeting domains in the Table 1 can be used with a *N. meningitidis* Cas9 molecule that generates a double stranded break (Cas9 nuclease) or a single-stranded break (Cas9 nickase).

TABLE 8B

| 2nd Tier | | | | |
|---|---|---|---|---|
| gRNA Name | DNA Strand | Targeting Domain | Target Site Length | SEQ ID NO |
| myoC-5357 | - | AGAGAGACAGCAGCACC | 17 | 5103 |
| myoC-5358 | + | CAGAAGAACCUCAUUGC | 17 | 5104 |
| myoC-5359 | - | UCUUCUGUGCACGUUGC | 17 | 5105 |
| myoC-5360 | + | UCAUUGCAGAGGCUUGG | 17 | 5106 |
| myoC-3085 | + | UGCUUUCCAACCUCCUG | 17 | 2851 |
| myoC-5361 | - | UACAGAGAGACAGCAGCACC | 20 | 5107 |
| myoC-5362 | + | ACCUCAUUGCAGAGGCUUGG | 20 | 5108 |
| myoC-3083 | + | UGCUGCUUUCCAACCUCCUG | 20 | 2845 |

Table 8C provides exemplary targeting domains for knocking out the MYOC gene selected according to the third tier parameters. The targeting domains bind within the first 500 bp of the coding sequence (e.g., within 500 bp downstream from the start codon) and start with a 5'G. It is contemplated herein that in an embodiment the targeting domain hybridizes to the target domain through complementary base pairing. Any of the targeting domains in the Table 1 can be used with a *N. meningitidis* Cas9 molecule that generates a double stranded break (Cas9 nuclease) or a single-stranded break (Cas9 nickase).

TABLE 8C

| 3rd Tier | | | | |
|---|---|---|---|---|
| gRNA Name | DNA Strand | Targeting Domain | Target Site Length | SEQ ID NO |
| myoC-5363 | + | GAUUCUCAUUUUCUUGCCUU | 20 | 5109 |

Table 8D provides exemplary targeting domains for knocking out the MYOC gene selected according to the fourth tier parameters. The targeting domains bind within the first 500 bp of the coding sequence (e.g., within 500 bp downstream from the start codon). It is contemplated herein that in an embodiment the targeting domain hybridizes to the target domain through complementary base pairing. Any of the targeting domains in the Table 1 can be used with a *N. meningitidis* Cas9 molecule that generates a double stranded break (Cas9 nuclease) or a single-stranded break (Cas9 nickase).

TABLE 8D

| 4th Tier | | | | |
|---|---|---|---|---|
| gRNA Name | DNA Strand | Targeting Domain | Target Site Length | SEQ ID NO |
| myoC-3084 | + | UGGCUCUGCUCUGGGCA | 17 | 2850 |
| myoC-1788 | + | CUCUCCAGGGAGCUGAG | 17 | 2017 |
| myoC-5364 | + | UCUCAUUUUCUUGCCUU | 17 | 5110 |
| myoC-5365 | - | UGAGAUGCCAGCUGUCCAGC | 20 | 5111 |
| myoC-1678 | + | AGGCUCUCCAGGGAGCUGAG | 20 | 1939 |

Table 8E provides exemplary targeting domains for knocking out the MYOC gene selected according to the fifth tier parameters. The targeting domains fall in the coding sequence of the gene, downstream of the first 500 bp of coding sequence (e.g., anywhere from +500 (relative to the start codon) to the stop codon of the gene). It is contemplated herein that in an embodiment the targeting domain hybridizes to the target domain through complementary base pairing. Any of the targeting domains in the Table 1 can be used with a *N. meningitidis* Cas9 molecule that generates a double stranded break (Cas9 nuclease) or a single-stranded break (Cas9 nickase).

TABLE 8E

| 5th Tier | | | | |
|---|---|---|---|---|
| gRNA Name | DNA Strand | Targeting Domain | Target Site Length | SEQ ID NO |
| myoC-5366 | - | GCAGAUGCUACCGUCAA | 17 | 5112 |
| myoC-5367 | - | AAGAUGCAUUUACUACA | 17 | 5113 |
| myoC-5368 | - | CAGCCAGCCAGGGCCCA | 17 | 5114 |
| myoC-3157 | - | CCGCUAUAAGUACAGCA | 17 | 2843 |
| myoC-2994 | + | UCAAGUUGUCCCAGGCA | 17 | 1873 |
| myoC-5369 | + | GCUGGCCAGAGGAGCUA | 17 | 5115 |
| myoC-5370 | + | CGAGUACACCACAGCAC | 17 | 5116 |
| myoC-5371 | + | CCUUGCUACCUCCUGGC | 17 | 5117 |
| myoC-2950 | + | UCCGUGGUAGCCAGCUC | 17 | 1842 |
| myoC-5372 | - | UUACUACAGUUGGCUUC | 17 | 5118 |
| myoC-3093 | - | ACAUAGUUCAAGUUUUC | 17 | 2852 |
| myoC-5373 | + | UCUGCUUCCUUUAGAAG | 17 | 5119 |

TABLE 8E-continued

| gRNA Name | DNA Strand | Targeting Domain | Target Site Length | SEQ ID NO |
|---|---|---|---|---|
| 5th Tier | | | | |
| myoC-5374 | + | CUGUAAAUGACCCAGAG | 17 | 5120 |
| myoC-5375 | + | CCUGGGUGUAGGGGUAG | 17 | 5121 |
| myoC-3094 | + | GACAUCCGUGCCAACUG | 17 | 2853 |
| myoC-5376 | + | CCUUCUGCCAUUGCCUG | 17 | 5122 |
| myoC-2995 | + | AGGCUUUUCACAUCUUG | 17 | 1874 |
| myoC-5377 | + | GAAGUUAUGCUUUUUAU | 17 | 5123 |
| myoC-5378 | + | UGAAGGCAUUGGCGACU | 17 | 5124 |
| myoC-5379 | + | AAGAAACUAUUAUGCCU | 17 | 5125 |
| myoC-3097 | + | GUGACCAUGUUCAUCCU | 17 | 2855 |
| myoC-5380 | - | UCCGAGCUAACUGAAGU | 17 | 5126 |
| myoC-3096 | + | CCCAGGUUUGUUCGAGU | 17 | 2854 |
| myoC-5381 | + | CAUUGCCUGUACAGCUU | 17 | 5127 |
| myoC-5382 | - | AGGGCCCAGGCAGCUUU | 17 | 5128 |
| myoC-5383 | - | UCAGCAGAUGCUACCGUCAA | 20 | 5129 |
| myoC-5384 | - | AGUAAGAUGCAUUUACUACA | 20 | 5130 |
| myoC-5385 | - | AGCCAGCCAGCCAGGGCCCA | 20 | 5131 |
| myoC-3156 | - | GAACCGCUAUAAGUACAGCA | 20 | 2842 |
| myoC-2973 | + | UGUUCAAGUUGUCCCAGGCA | 20 | 1858 |
| myoC-5386 | + | GAUGCUGGCCAGAGGAGCUA | 20 | 5132 |
| myoC-5387 | + | CCCCGAGUACACCACAGCAC | 20 | 5133 |
| myoC-5388 | + | CAGCCUUGCUACCUCCUGGC | 20 | 5134 |
| myoC-2924 | + | CUGUCCGUGGUAGCCAGCUC | 20 | 1822 |
| myoC-5389 | - | CAUUUACUACAGUUGGCUUC | 20 | 5135 |
| myoC-3087 | - | AUGACAUAGUUCAAGUUUUC | 20 | 2846 |
| myoC-5390 | + | UAUUCUGCUUCCUUUAGAAG | 20 | 5136 |
| myoC-5391 | + | GUGCUGUAAAUGACCCAGAG | 20 | 5137 |
| myoC-4390 | + | UCUCCUGGGUGUAGGGGUAG | 20 | 4136 |
| myoC-3088 | + | GCGGACAUCCGUGCCAACUG | 20 | 2847 |
| myoC-5392 | + | UCUCCUUCUGCCAUUGCCUG | 20 | 5138 |
| myoC-2974 | + | UGGAGGCUUUUCACAUCUUG | 20 | 1859 |
| myoC-5393 | + | UUAGAAGUUAUGCUUUUUAU | 20 | 5139 |
| myoC-5394 | + | UGAUGAAGGCAUUGGCGACU | 20 | 5140 |
| myoC-5395 | + | AGGAAGAAACUAUUAUGCCU | 20 | 5141 |
| myoC-3091 | + | AUGGUGACCAUGUUCAUCCU | 20 | 2849 |
| myoC-5396 | - | AAGUCCGAGCUAACUGAAGU | 20 | 5142 |
| myoC-3090 | + | UCUCCCAGGUUUGUUCGAGU | 20 | 2848 |
| myoC-5397 | + | UGCCAUUGCCUGUACAGCUU | 20 | 5143 |
| myoC-5398 | - | GCCAGGGCCCAGGCAGCUUU | 20 | 5144 |

Table 9A provides exemplary targeting domains for knocking down the MYOC gene selected according to the first tier parameters. The targeting domains bind within 3454-2454 bp upstream of transcription start site or 500 bp upstream and downstream of transcription start site, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 9A

| gRNA Name | DNA Strand | Targeting Domain | Target Site Length | Seq ID |
|---|---|---|---|---|
| 1st Tier | | | | |
| myoC-1263 | - | GCUGAGCGGGUGCUGAA | 17 | 1563 |
| myoC-1237 | - | GAGGGAAACUAGUCUAA | 17 | 1537 |
| myoC-955 | + | GUGUGCUGAUUUCAACA | 17 | 1002 |
| myoC-163 | + | GUUAUGGAUGACUGACA | 17 | 496 |
| myoC-791 | + | GCACGAUGGAGGCAGCA | 17 | 1028 |
| myoC-822 | + | GACCCCGGGUGCUUGCA | 17 | 982 |
| myoC-155 | + | GUCCCGCUCCCGCCUCA | 17 | 546 |
| myoC-788 | + | GGGGCCUCCGGGCACGA | 17 | 1043 |
| myoC-798 | + | GGGAGGUGGCCUUGUUA | 17 | 1041 |
| myoC-2709 | + | GCACCAGGACGAUUCAC | 17 | 2649 |
| myoC-167 | + | GCUGGAUUCAUUGGGAC | 17 | 497 |
| myoC-931 | + | GAGAGGUUUAUAUAUAC | 17 | 997 |
| myoC-818 | + | GGUUGCUCAGGACACCC | 17 | 1044 |
| myoC-764 | - | GACUCGUUCAUUCAUCC | 17 | 1022 |
| myoC-139 | - | GCGGGAGCGGGACCAGC | 17 | 534 |
| myoC-959 | + | GUCCUUUAAGACGUAGC | 17 | 1000 |
| myoC-821 | + | GGACCCCGGGUGCUUGC | 17 | 1033 |
| myoC-919 | - | GUAUAUAUAAACCUCUC | 17 | 998 |
| myoC-138 | - | GCACCCUGAGGCGGGAG | 17 | 533 |
| myoC-1271 | - | GUUCAGUGUUGUUCACG | 17 | 1571 |
| myoC-772 | - | GCCUCCAUCGUGCCCGG | 17 | 985 |

TABLE 9A-continued

1st Tier

| gRNA Name | DNA Strand | Targeting Domain | Target Site Length | Seq ID |
|---|---|---|---|---|
| myoC-828 | + | GAGGAAACCUCUGCCGG | 17 | 983 |
| myoC-152 | + | GAACUGACUUGUCUCGG | 17 | 492 |
| myoC-937 | + | GAGCCAGCCCUUCAUGG | 17 | 1056 |
| myoC-789 | + | GCCUCCGGGCACGAUGG | 17 | 986 |
| myoC-157 | + | GGUCCAAGGUCAAUUGG | 17 | 493 |
| myoC-785 | + | GGAAGACUCGGGCUUGG | 17 | 1032 |
| myoC-161 | + | GCUGAGUCGAGCUUUGG | 17 | 495 |
| myoC-909 | - | GGUAUGGGUGCAUAAAU | 17 | 1067 |
| myoC-1273 | - | GUGUUGUUCACGGGGCU | 17 | 1573 |
| myoC-806 | + | GUCACCUCCACGAAGGU | 17 | 987 |
| myoC-910 | - | GUAUGGGUGCAUAAAUU | 17 | 999 |
| myoC-166 | + | GGGCAGCUGGAUUCAUU | 17 | 553 |
| myoC-129 | - | GCACGUUGCUGCAGCUU | 17 | 488 |
| myoC-160 | + | GGAGCUGAGUCGAGCUU | 17 | 494 |
| myoC-967 | - | GGAGAGGGAAACUAGUCUAA | 20 | 1267 |
| myoC-694 | - | GUGCGCAGCAUCCCUUAACA | 20 | 981 |
| myoC-692 | - | GUGGAGGUGACAGUUUCUCA | 20 | 1021 |
| myoC-973 | - | GGGGACAGUGUUUCCUCAGA | 20 | 1273 |
| myoC-1012 | - | GCAUGGGUUUUCCUUCACGA | 20 | 1312 |
| myoC-995 | - | GCGGGUGCUGAAAGGCAGGA | 20 | 1295 |
| myoC-848 | - | GAAUCUUGCUGGCAGCGUGA | 20 | 988 |
| myoC-2163 | + | GAUGCACCAGGACGAUUCAC | 20 | 2269 |
| myoC-126 | + | GCAGCUGGAUUCAUUGGGAC | 20 | 523 |
| myoC-680 | - | GGGGGAGCCCUGCAAGCACC | 20 | 1020 |
| myoC-1116 | + | GUCUCCAGCUCAGAUGCACC | 20 | 1416 |
| myoC-741 | + | GCAGGUUGCUCAGGACACCC | 20 | 1007 |
| myoC-681 | - | GGGGAGCCCUGCAAGCACCC | 20 | 1019 |
| myoC-857 | - | GCCAGCAAGGCCACCCAUCC | 20 | 990 |
| myoC-123 | + | GUCGAGCUUUGGUGGCCUCC | 20 | 485 |
| myoC-977 | - | GGAAAGGGGCCUCCACGUCC | 20 | 1277 |
| myoC-105 | - | GAGGCGGGAGCGGGACCAGC | 20 | 510 |
| myoC-104 | - | GGGCACCCUGAGGCGGGAGC | 20 | 509 |
| myoC-117 | + | GCUGGUCCCGCUCCCGCCUC | 20 | 484 |
| myoC-709 | + | GACUCGGGCUUGGGGGCCUC | 20 | 1003 |
| myoC-125 | + | GACAUGGCCUGGCUCUGCUC | 20 | 522 |
| myoC-965 | - | GCUCCAGAAAGGAAAUGGAG | 20 | 1265 |
| myoC-971 | - | GUCUAACGGAGAAUCUGGAG | 20 | 1271 |
| myoC-1001 | - | GAUGUUCAGUGUUGUUCACG | 20 | 1301 |
| myoC-682 | - | GGGAGCCCUGCAAGCACCCG | 20 | 979 |
| myoC-114 | + | GAACUGACUUGUCUCGGAGG | 20 | 482 |
| myoC-696 | - | GCUGCCUCCAUCGUGCCCGG | 20 | 976 |
| myoC-751 | + | GGAGAGGAAACCUCUGCCGG | 20 | 1013 |
| myoC-719 | + | GGCAGCAGGGGGCGCUAGGG | 20 | 1017 |
| myoC-871 | + | GGGGAGCCAGCCCUUCAUGG | 20 | 992 |
| myoC-712 | + | GGGGCCUCCGGGCACGAUGG | 20 | 980 |
| myoC-679 | - | GAGGUUUCCUCUCCAGCUGG | 20 | 1005 |
| myoC-121 | + | GGUCCAAGGUCAAUUGGUGG | 20 | 520 |
| myoC-122 | + | GGAGCUGAGUCGAGCUUUGG | 20 | 521 |
| myoC-707 | + | GCUUGGAAGACUCGGGCUUG | 20 | 977 |
| myoC-127 | + | GCAUCGGCCACUCUGGUCAU | 20 | 487 |
| myoC-861 | + | GUGCUGAGAGGUGCCUGGAU | 20 | 995 |
| myoC-837 | - | GUAAAACCAGGUGGAGAUAU | 20 | 994 |
| myoC-838 | - | GGAGAUAUAGGAACUAUUAU | 20 | 991 |
| myoC-1107 | + | GUGAACAACACUGAACAUCU | 20 | 1407 |
| myoC-106 | - | GGAAACCCAAACCAGAGAGU | 20 | 479 |
| myoC-878 | + | GUGGCCACGUGAGGCUGGGU | 20 | 1054 |
| myoC-95 | - | GCCUGCCUGGUGUGGGAUGU | 20 | 500 |
| myoC-115 | + | GUCUCGGAGGAGGUUGCUGU | 20 | 516 |
| myoC-93 | - | GCUUCUGGCCUGCCUGGUGU | 20 | 478 |
| myoC-844 | - | GGGGUAUGGGUGCAUAAAUU | 20 | 993 |
| myoC-839 | - | GAGAUAUAGGAACUAUUAUU | 20 | 989 |
| myoC-706 | + | GGCUUGGAAGACUCGGGCUU | 20 | 978 |
| myoC-124 | + | GGCCUCCAGGUCUAAGCGUU | 20 | 486 |
| myoC-91 | - | GUGCACGUUGCUGCAGCUUU | 20 | 477 |

Table 9B provides exemplary targeting domains for knocking down the MYOC gene selected according to the second tier parameters. The targeting domains bind within 3454-2454 bp upstream of transcription start site or 500 bp upstream and downstream of transcription start site and have a high level of orthogonality. It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 9B

| 2nd Tier | | | | |
|---|---|---|---|---|
| gRNA Name | DNA Strand | Targeting Domain | Target Site Length | Seq ID |
| myoC-1368 | + | CUUCUUCCGUGAAUUAA | 17 | 1668 |
| myoC-895 | - | UCCCUGCUACGUCUUAA | 17 | 1249 |
| myoC-1283 | - | CGAAGGCCUUUAUUUAA | 17 | 1583 |
| myoC-770 | - | CGCAGCAUCCCUUAACA | 17 | 1154 |
| myoC-960 | + | UCCUUUAAGACGUAGCA | 17 | 1250 |
| myoC-813 | + | CAAAACAACCAGUGGCA | 17 | 1145 |
| myoC-1287 | - | CCUAGGCCGUUAAUUCA | 17 | 1587 |
| myoC-2710 | + | UGCACCAGGACGAUUCA | 17 | 2650 |
| myoC-800 | + | CGCACAAUUCUUCAAGA | 17 | 1153 |
| myoC-805 | + | AACUGUCACCUCCACGA | 17 | 1128 |
| myoC-1282 | - | UGGGUUUUCCUUCACGA | 17 | 1582 |
| myoC-1240 | - | CUAACGGAGAAUCUGGA | 17 | 1540 |
| myoC-775 | + | UGCAGCGCUGUGACUGA | 17 | 1164 |
| myoC-914 | - | UCUUGCUGGCAGCGUGA | 17 | 1253 |
| myoC-1371 | + | AAUAAAGGCCUUCGUGA | 17 | 1671 |
| myoC-271 | - | AAGAGAAGAAGCGACUA | 17 | 657 |
| myoC-807 | + | UCACCUCCACGAAGGUA | 17 | 1159 |
| myoC-761 | - | CUGCCAGCCCGUGCCAC | 17 | 1156 |
| myoC-1270 | - | UGUUCAGUGUUGUUCAC | 17 | 1570 |
| myoC-303 | + | CCACACUGAAGGUAUAC | 17 | 689 |
| myoC-954 | + | ACUUACACCAGGACUAC | 17 | 1227 |
| myoC-1386 | + | UCCAGCUCAGAUGCACC | 17 | 1686 |
| myoC-254 | - | CACCCAACGCUUAGACC | 17 | 640 |
| myoC-258 | - | CCAAUUGACCUUGGACC | 17 | 644 |
| myoC-1486 | + | AAGGACAGCACCCUACC | 17 | 1786 |
| myoC-256 | - | AGCUCGACUCAGCUCCC | 17 | 642 |
| myoC-923 | - | AGCAAGGCCACCCAUCC | 17 | 1231 |
| myoC-1247 | - | AAGGGGCCUCCACGUCC | 17 | 1547 |
| myoC-5399 | - | CUUCCCGUGAAUCGUCC | 17 | 5145 |
| myoC-1248 | - | ACGUCCAGGAGAAUUCC | 17 | 1548 |
| myoC-773 | - | AGUCACAGCGCUGCAGC | 17 | 1143 |
| myoC-2390 | - | UCCUGGUGCAUCUGAGC | 17 | 2434 |
| myoC-1264 | - | AGCGGGUGCUGAAAGGC | 17 | 1564 |
| myoC-774 | + | UUCACGGGAAGCGAGGC | 17 | 1167 |
| myoC-815 | + | CAACCAGUGGCACGGGC | 17 | 1146 |
| myoC-1272 | - | AGUGUUGUUCACGGGGC | 17 | 1572 |
| myoC-5400 | - | UGUCCUUGUGUUCUGGC | 17 | 5146 |

TABLE 9B-continued

| 2nd Tier | | | | |
|---|---|---|---|---|
| gRNA Name | DNA Strand | Targeting Domain | Target Site Length | Seq ID |
| myoC-804 | + | ACUGGGUUUAAGUUGGC | 17 | 1132 |
| myoC-929 | + | UGGAUGGGUGGCCUUGC | 17 | 1255 |
| myoC-1238 | - | UAGUCUAACGGAGAAUC | 17 | 1538 |
| myoC-305 | + | ACUGGCAUCGGCCACUC | 17 | 691 |
| myoC-2902 | + | CUUGGUGAGGCUUCCUC | 17 | 2790 |
| myoC-269 | - | CCGAGACAAGUCAGUUC | 17 | 655 |
| myoC-5401 | - | CUUGAAGCCCCCGGCAG | 17 | 5147 |
| myoC-930 | + | AUGCCCGAGCUCCAGAG | 17 | 1236 |
| myoC-1241 | - | UAACGGAGAAUCUGGAG | 17 | 1541 |
| myoC-1380 | + | UGGAAUUCUCCUGGACG | 17 | 1680 |
| myoC-827 | + | AGAGGAAACCUCUGCCG | 17 | 1134 |
| myoC-5402 | + | ACGAUUCACGGGAAGCG | 17 | 5148 |
| myoC-766 | - | UCACUGCCCUACCUUCG | 17 | 1160 |
| myoC-296 | + | AGGUCAAUUGGUGGAGG | 17 | 682 |
| myoC-776 | + | AGCGCUGUGACUGAUGG | 17 | 1137 |
| myoC-255 | - | CCAACGCUUAGACCUGG | 17 | 641 |
| myoC-1239 | - | UCUAACGGAGAAUCUGG | 17 | 1539 |
| myoC-270 | - | AGACAAGUCAGUUCUGG | 17 | 656 |
| myoC-1381 | + | AAUUCUCCUGGACGUGG | 17 | 1681 |
| myoC-767 | - | CUGCCCUACCUUCGUGG | 17 | 1157 |
| myoC-3158 | - | ACCAAGCCUCUGCAAUG | 17 | 2904 |
| myoC-252 | - | CCAGUAUACCUUCAGUG | 17 | 638 |
| myoC-294 | + | CCUGGUCCAAGGUCAAU | 17 | 680 |
| myoC-304 | + | UGAAGGUAUACUGGCAU | 17 | 690 |
| myoC-1281 | - | AAUUCCAGGGUGUGCAU | 17 | 1581 |
| myoC-306 | + | UCGGCCACUCUGGUCAU | 17 | 692 |
| myoC-257 | - | CCUCCACCAAUUGACCU | 17 | 643 |
| myoC-1369 | + | CCGUGAAUUAACGGCCU | 17 | 1669 |
| myoC-782 | + | CUUGGAAGACUCGGGCU | 17 | 1158 |
| myoC-281 | + | CCAGAACUGACUUGUCU | 17 | 667 |
| myoC-803 | + | CAGCACUGGGUUUAAGU | 17 | 1150 |
| myoC-268 | - | AACCCAAACCAGAGAGU | 17 | 654 |
| myoC-297 | + | CCUCCAGGUCUAAGCGU | 17 | 683 |
| myoC-783 | + | UUGGAAGACUCGGGCUU | 17 | 1169 |
| myoC-298 | + | CUCCAGGUCUAAGCGUU | 17 | 684 |
| myoC-951 | + | CCUUCCAGAAGUCUGUU | 17 | 1242 |
| myoC-975 | - | AGUGUUUCCUCAGAGGGAAA | 20 | 1275 |

TABLE 9B-continued

| 2nd Tier | | | | |
|---|---|---|---|---|
| gRNA Name | DNA Strand | Targeting Domain | Target Site Length | Seq ID |
| myoC-974 | - | CAGUGUUUCCUCAGAGGGAA | 20 | 1274 |
| myoC-1098 | + | UCACUUCUUCCGUGAAUUAA | 20 | 1398 |
| myoC-829 | - | CUGUCCCUGCUACGUCUUAA | 20 | 1207 |
| myoC-722 | + | UAGGGAGGUGGCCUUGUUAA | 20 | 1115 |
| myoC-1013 | - | UCACGAAGGCCUUUAUUUAA | 20 | 1313 |
| myoC-889 | + | CUGGUGUGCUGAUUUCAACA | 20 | 1206 |
| myoC-227 | + | UAAGUUAUGGAUGACUGACA | 20 | 613 |
| myoC-1009 | - | AGUCAGCUGUUAAAAUUCCA | 20 | 1309 |
| myoC-856 | - | AGCUCGGGCAUGAGCCAGCA | 20 | 1183 |
| myoC-714 | + | CGGGCACGAUGGAGGCAGCA | 20 | 1105 |
| myoC-894 | + | AAGUCCUUUAAGACGUAGCA | 20 | 1173 |
| myoC-736 | + | UAACAAAACAACCAGUGGCA | 20 | 1114 |
| myoC-1010 | - | UUAAAAUUCCAGGGUGUGCA | 20 | 1310 |
| myoC-745 | + | CAGGACCCCGGGUGCUUGCA | 20 | 1098 |
| myoC-213 | + | CUGGUCCCGCUCCCGCCUCA | 20 | 599 |
| myoC-1017 | - | UUUCCUAGGCCGUUAAUUCA | 20 | 1317 |
| myoC-2164 | + | AGAUGCACCAGGACGAUUCA | 20 | 2270 |
| myoC-868 | + | ACUGGGGAGCCAGCCCUUCA | 20 | 1177 |
| myoC-999 | - | CAGAUGUUCAGUGUUGUUCA | 20 | 1299 |
| myoC-723 | + | CUGCGCACAAUUCUUCAAGA | 20 | 1109 |
| myoC-728 | + | AGAAACUGUCACCUCCACGA | 20 | 1084 |
| myoC-711 | + | UUGGGGGCCUCCGGGCACGA | 20 | 1123 |
| myoC-970 | - | AGUCUAACGGAGAAUCUGGA | 20 | 1270 |
| myoC-846 | - | ACUCCAAACAGACUUCUGGA | 20 | 1176 |
| myoC-1006 | - | AGAAGAAGUCUAUUUCAUGA | 20 | 1306 |
| myoC-233 | + | AUUGGGACUGGCCACACUGA | 20 | 619 |
| myoC-698 | + | AGCUGCAGCGCUGUGACUGA | 20 | 1089 |
| myoC-1101 | + | UUAAAUAAAGGCCUUCGUGA | 20 | 1401 |
| myoC-730 | + | CUGUCACCUCCACGAAGGUA | 20 | 1111 |
| myoC-841 | - | UAGGAACUAUUAUUGGGGUA | 20 | 1210 |
| myoC-226 | + | UGCUGUCUCUCUGUAAGUUA | 20 | 612 |
| myoC-721 | + | CUAGGGAGGUGGCCUUGUUA | 20 | 1106 |
| myoC-685 | - | AACCUGCCAGCCCGUGCCAC | 20 | 1079 |
| myoC-737 | + | AACAAAACAACCAGUGGCAC | 20 | 1077 |
| myoC-1000 | - | AGAUGUUCAGUGUUGUUCAC | 20 | 1300 |
| myoC-1018 | - | UAAUUCACGGAAGAAGUGAC | 20 | 1318 |
| myoC-865 | + | CCAGAGAGGUUUAUAUAUAC | 20 | 1195 |
| myoC-234 | + | UGGCCACACUGAAGGUAUAC | 20 | 620 |
| myoC-888 | + | CACACUUACACCAGGACUAC | 20 | 1189 |
| myoC-886 | + | AUAGUUCCUAUAUCUCCACC | 20 | 1185 |
| myoC-179 | - | CAGCACCCAACGCUUAGACC | 20 | 565 |
| myoC-183 | - | CCACCAAUUGACCUUGGACC | 20 | 569 |
| myoC-1216 | + | CACAAGGACAGCACCCUACC | 20 | 1516 |
| myoC-1102 | + | AGGAAAACCCAUGCACACCC | 20 | 1402 |
| myoC-181 | - | CAAAGCUCGACUCAGCUCCC | 20 | 567 |
| myoC-1114 | + | UCCAUUUCCUUUCUGGAGCC | 20 | 1414 |
| myoC-228 | + | UAUGGAUGACUGACAUGGCC | 20 | 614 |
| myoC-859 | + | CUGCUGUGCUGAGAGGUGCC | 20 | 1203 |
| myoC-688 | - | UGUGACUCGUUCAUUCAUCC | 20 | 1121 |
| myoC-710 | + | ACUCGGGCUUGGGGGCCUCC | 20 | 1082 |
| myoC-222 | + | AUUGGUGGAGGAGGCUCUCC | 20 | 608 |
| myoC-1109 | + | CCCACCUCCUGGAAUUCUCC | 20 | 1409 |
| myoC-5403 | - | UCGCUUCCCGUGAAUCGUCC | 20 | 5149 |
| myoC-683 | - | CCUGCAAGCACCCGGGGUCC | 20 | 1103 |
| myoC-978 | - | UCCACGUCCAGGAGAAUUCC | 20 | 1278 |
| myoC-212 | + | CUCUGGUUUGGGUUUCCAGC | 20 | 598 |
| myoC-713 | + | CCGGGCACGAUGGAGGCAGC | 20 | 1102 |
| myoC-697 | - | AUCAGUCACAGCGCUGCAGC | 20 | 1094 |
| myoC-1844 | - | UCGUCCUGGUGCAUCUGAGC | 20 | 2054 |
| myoC-893 | + | CAAGUCCUUUAAGACGUAGC | 20 | 1187 |
| myoC-994 | - | CUGAGCGGGUGCUGAAAGGC | 20 | 1294 |
| myoC-239 | + | CCCCACAUCCCACACCAGGC | 20 | 625 |
| myoC-5404 | + | CGAUUCACGGGAAGCGAGGC | 20 | 5150 |
| myoC-875 | + | CAGAGGUGGCCACGUGAGGC | 20 | 1192 |
| myoC-738 | + | AAACAACCAGUGGCACGGGC | 20 | 1076 |
| myoC-1002 | - | UUCAGUGUUGUUCACGGGGC | 20 | 1302 |
| myoC-739 | + | AACCAGUGGCACGGGCUGGC | 20 | 1078 |
| myoC-727 | + | AGCACUGGGUUUAAGUUGGC | 20 | 1086 |
| myoC-744 | + | CCAGGACCCCGGGUGCUUGC | 20 | 1101 |
| myoC-968 | - | AACUAGUCUAACGGAGAAUC | 20 | 1268 |
| myoC-1106 | + | CGUGAACAACACUGAACAUC | 20 | 1406 |
| myoC-236 | + | UAUACUGGCAUCGGCCACUC | 20 | 622 |
| myoC-2356 | + | AGGCUUGGUGAGGCUUCCUC | 20 | 2410 |
| myoC-855 | - | UAUAAACCUCUCUGGAGCUC | 20 | 1211 |

TABLE 9B-continued

2nd Tier

| gRNA Name | DNA Strand | Targeting Domain | Target Site Length | Seq ID |
|---|---|---|---|---|
| myoC-740 | + | CACGGGCUGGCAGGUUGCUC | 20 | 1096 |
| myoC-241 | + | AGCUGGACAGCUGGCAUCUC | 20 | 627 |
| myoC-853 | - | CCAGUAUAUAUAAACCUCUC | 20 | 1197 |
| myoC-732 | + | ACCAUUUUGUCUCUGGUGUC | 20 | 1081 |
| myoC-170 | - | AGCUGUCCAGCUGCUGCUUC | 20 | 556 |
| myoC-191 | - | CCUCCGAGACAAGUCAGUUC | 20 | 577 |
| myoC-1215 | - | AGGGUGCUGUCCUUGUGUUC | 20 | 1515 |
| myoC-735 | + | AGUGAUAACAAAACAACCAG | 20 | 1092 |
| myoC-3159 | + | ACAGAAGAACCUCAUUGCAG | 20 | 2905 |
| myoC-972 | - | AGGGGACAGUGUUUCCUCAG | 20 | 1272 |
| myoC-864 | + | CUCAUGCCCGAGCUCCAGAG | 20 | 1201 |
| myoC-190 | - | UGGGCACCCUGAGGCGGGAG | 20 | 576 |
| myoC-1110 | + | UCCUGGAAUUCUCCUGGACG | 20 | 1410 |
| myoC-750 | + | UGGAGAGGAAACCUCUGCCG | 20 | 1119 |
| myoC-5405 | + | AGGACGAUUCACGGGAAGCG | 20 | 5151 |
| myoC-690 | - | CAGUCACUGCCCUACCUUCG | 20 | 1100 |
| myoC-979 | - | ACGUCCAGGAGAAUUCCAGG | 20 | 1279 |
| myoC-980 | - | UCCAGGAGAAUUCCAGGAGG | 20 | 1280 |
| myoC-720 | + | AGCAGGGGGCGCUAGGGAGG | 20 | 1087 |
| myoC-700 | + | AGCGCUGUGACUGAUGGAGG | 20 | 1088 |
| myoC-221 | + | CCAAGGUCAAUUGGUGGAGG | 20 | 607 |
| myoC-209 | + | CCAGAACUGACUUGUCUCGG | 20 | 595 |
| myoC-699 | + | UGCAGCGCUGUGACUGAUGG | 20 | 1118 |
| myoC-180 | - | CACCCAACGCUUAGACCUGG | 20 | 566 |
| myoC-969 | - | UAGUCUAACGGAGAAUCUGG | 20 | 1269 |
| myoC-192 | - | CCGAGACAAGUCAGUUCUGG | 20 | 578 |
| myoC-1111 | + | UGGAAUUCUCCUGGACGUGG | 20 | 1411 |
| myoC-691 | - | UCACUGCCCUACCUUCGUGG | 20 | 1117 |
| myoC-220 | + | CCUGGUCCAAGGUCAAUUGG | 20 | 606 |
| myoC-708 | + | CUUGGAAGACUCGGGCUUGG | 20 | 1112 |
| myoC-3160 | - | CUCACCAAGCCUCUGCAAUG | 20 | 2906 |
| myoC-867 | + | AGAGAGGUUUAUAUAUACUG | 20 | 1180 |
| myoC-177 | - | AUGCCAGUAUACCUUCAGUG | 20 | 563 |
| myoC-3161 | + | CUCAUUGCAGAGGCUUGGUG | 20 | 2907 |
| myoC-840 | - | AGAUAUAGGAACUAUUAUUG | 20 | 1182 |
| myoC-843 | - | UGGGGUAUGGGUGCAUAAAU | 20 | 1214 |
| myoC-219 | + | CAGCCUGGUCCAAGGUCAAU | 20 | 605 |

TABLE 9B-continued

2nd Tier

| gRNA Name | DNA Strand | Targeting Domain | Target Site Length | Seq ID |
|---|---|---|---|---|
| myoC-1014 | - | CACGAAGGCCUUUAUUUAAU | 20 | 1314 |
| myoC-235 | + | CACUGAAGGUAUACUGGCAU | 20 | 621 |
| myoC-1011 | - | UAAAAUUCCAGGGUGUGCAU | 20 | 1311 |
| myoC-842 | - | AGGAACUAUUAUUGGGGUAU | 20 | 1184 |
| myoC-866 | + | CAGAGAGGUUUAUAUAUACU | 20 | 1191 |
| myoC-182 | - | CCUCCUCCACCAAUUGACCU | 20 | 568 |
| myoC-1099 | + | CUUCCGUGAAUUAACGGCCU | 20 | 1399 |
| myoC-961 | - | CAUCUGAGCUGGAGACUCCU | 20 | 1261 |
| myoC-684 | - | CUGCAAGCACCCGGGGUCCU | 20 | 1108 |
| myoC-1016 | - | AGGAAGCGAGCUCAUUUCCU | 20 | 1316 |
| myoC-854 | - | AUAUAAACCUCUCUGGAGCU | 20 | 1186 |
| myoC-3162 | + | AGAACCUCAUUGCAGAGGCU | 20 | 2908 |
| myoC-876 | + | AGAGGUGGCCACGUGAGGCU | 20 | 1181 |
| myoC-705 | + | AGGCUUGGAAGACUCGGGCU | 20 | 1091 |
| myoC-1003 | - | UCAGUGUUGUUCACGGGGCU | 20 | 1303 |
| myoC-208 | + | CCUCCAGAACUGACUUGUCU | 20 | 594 |
| myoC-726 | + | UUUCAGCACUGGGUUUAAGU | 20 | 1125 |
| myoC-225 | + | UGGCCUCCAGGUCUAAGCGU | 20 | 611 |
| myoC-729 | + | ACUGUCACCUCCACGAAGGU | 20 | 1083 |
| myoC-981 | - | CCAGGAGAAUUCCAGGAGGU | 20 | 1281 |
| myoC-232 | + | UCUGGGCAGCUGGAUUCAUU | 20 | 618 |
| myoC-169 | - | UGUGCACGUUGCUGCAGCUU | 20 | 555 |
| myoC-224 | + | CAGGGAGCUGAGUCGAGCUU | 20 | 610 |
| myoC-210 | + | CAGUCUCCAACUCUCUGGUU | 20 | 596 |
| myoC-885 | + | UAACCUUCCAGAAGUCUGUU | 20 | 1208 |
| myoC-830 | - | UACGUCUUAAAGGACUUGUU | 20 | 1209 |

Table 9C provides exemplary targeting domains for knocking down the MYOC gene selected according to the third tier parameters. The targeting domains bind within 3454-2454 bp upstream of transcription start site or 500 bp upstream and downstream of transcription start site and start with a 5'G. It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 9C

| 3rd Tier | | | | |
|---|---|---|---|---|
| gRNA Name | DNA Strand | Targeting Domain | Target Site Length | Seq ID |
| myoC-1373 | + | GCAGAGAAAAGAUAAAA | 17 | 1673 |
| myoC-1245 | - | GUUUCCUCAGAGGGAAA | 17 | 1545 |
| myoC-1233 | - | GGCUCCAGGCUCCAGAA | 17 | 1533 |
| myoC-1277 | - | GAAGUCUAUUUCAUGAA | 17 | 1577 |
| myoC-799 | + | GGAGGUGGCCUUGUUAA | 17 | 1037 |
| myoC-947 | + | GGGUGGGGCUGUGCACA | 17 | 1066 |
| myoC-159 | + | GUGGAGGAGGCUCUCCA | 17 | 549 |
| myoC-1268 | - | GGAAGGUGAAAAGGGCA | 17 | 1568 |
| myoC-768 | - | GAGGUGACAGUUUCUCA | 17 | 1025 |
| myoC-934 | + | GGGGAGCCAGCCCUUCA | 17 | 1065 |
| myoC-1243 | - | GACAGUGUUUCCUCAGA | 17 | 1543 |
| myoC-1265 | - | GGUGCUGAAAGGCAGGA | 17 | 1565 |
| myoC-132 | - | GACAGCUCAGCUCAGGA | 17 | 527 |
| myoC-926 | + | GCUGAGAGGUGCCUGGA | 17 | 1060 |
| myoC-168 | + | GGGACUGGCCACACUGA | 17 | 554 |
| myoC-795 | + | GGCAGCAGGGGGCGCUA | 17 | 1039 |
| myoC-907 | - | GAACUAUUAUUGGGGUA | 17 | 996 |
| myoC-958 | + | GGCACUAUGCUAGGAAC | 17 | 1062 |
| myoC-953 | + | GUACACACACUUACACC | 17 | 1070 |
| myoC-952 | + | GUUCCUAUAUCUCCACC | 17 | 1075 |
| myoC-756 | - | GGAGCCCUGCAAGCACC | 17 | 1035 |
| myoC-757 | - | GAGCCCUGCAAGCACCC | 17 | 1024 |
| myoC-164 | + | GGAUGACUGACAUGGCC | 17 | 551 |
| myoC-130 | - | GCUGCUUCUGGCCUGCC | 17 | 525 |
| myoC-826 | + | GAGAGGAAACCUCUGCC | 17 | 1023 |
| myoC-897 | - | GUUCCUAGCAUAGUGCC | 17 | 1074 |
| myoC-771 | - | GCUGCCUCCAUCGUGCC | 17 | 1030 |
| myoC-162 | + | GAGCUUUGGUGGCCUCC | 17 | 550 |
| myoC-1232 | - | GGAGACUCCUUGGCUCC | 17 | 1532 |
| myoC-158 | + | GGUGGAGGAGGCUCUCC | 17 | 548 |
| myoC-156 | + | GCCCCUCCUGGGUCUCC | 17 | 547 |
| myoC-759 | - | GCAAGCACCCGGGGUCC | 17 | 1027 |
| myoC-752 | - | GAGGUUUCCUCUCCAGC | 17 | 1026 |
| myoC-790 | + | GGCACGAUGGAGGCAGC | 17 | 1038 |
| myoC-165 | + | GCUCUGCUCUGGGCAGC | 17 | 552 |
| myoC-134 | - | GGGGCUGCAGAGGGAGC | 17 | 529 |
| myoC-1262 | - | GGACGCUGGGGCUGAGC | 17 | 1562 |

TABLE 9C-continued

| 3rd Tier | | | | |
|---|---|---|---|---|
| gRNA Name | DNA Strand | Targeting Domain | Target Site Length | Seq ID |
| myoC-1258 | - | GCAGGGAGUGGGGACGC | 17 | 1558 |
| myoC-137 | - | GCUGGGCACCCUGAGGC | 17 | 532 |
| myoC-825 | + | GGAGAGGAAACCUCUGC | 17 | 1034 |
| myoC-140 | - | GCAAGAAAAUGAGAAUC | 17 | 535 |
| myoC-1376 | + | GAACAACACUGAACAUC | 17 | 1676 |
| myoC-781 | + | GGAGGCUUGGAAGACUC | 17 | 1036 |
| myoC-154 | + | GGUCCCGCUCCCGCCUC | 17 | 545 |
| myoC-817 | + | GGGCUGGCAGGUUGCUC | 17 | 1042 |
| myoC-153 | + | GGCAGUCUCCAACUCUC | 17 | 544 |
| myoC-808 | + | GCUCACCAUUUUGUCUC | 17 | 1029 |
| myoC-1485 | - | GUGCUGUCCUUGUGUUC | 17 | 1785 |
| myoC-948 | + | GGUGGGGCUGUGCACAG | 17 | 1069 |
| myoC-812 | + | GAUAACAAAACAACCAG | 17 | 984 |
| myoC-3163 | + | GAAGAACCUCAUUGCAG | 17 | 2909 |
| myoC-1242 | - | GGACAGUGUUUCCUCAG | 17 | 1542 |
| myoC-1255 | - | GUGGGGACUGCAGGGAG | 17 | 1555 |
| myoC-824 | + | GGCUCCCCCAGCUGGAG | 17 | 1040 |
| myoC-1261 | - | GGGACGCUGGGGCUGAG | 17 | 1561 |
| myoC-949 | + | GUGGGGCUGUGCACAGG | 17 | 1072 |
| myoC-902 | - | GUGUGUGUAAAACCAGG | 17 | 1073 |
| myoC-133 | - | GCCCCAGGAGACCCAGG | 17 | 528 |
| myoC-778 | + | GUGACUGAUGGAGGAGG | 17 | 1046 |
| myoC-777 | + | GCUGUGACUGAUGGAGG | 17 | 1031 |
| myoC-943 | + | GGCCACGUGAGGCUGGG | 17 | 1063 |
| myoC-755 | - | GUUUCCUCUCCAGCUGG | 17 | 1047 |
| myoC-936 | + | GGAGCCAGCCCUUCAUG | 17 | 1061 |
| myoC-933 | + | GAGGUUUAUAUAUACUG | 17 | 1057 |
| myoC-136 | - | GGGAGCUGGGCACCCUG | 17 | 531 |
| myoC-754 | - | GGUUUCCUCUCCAGCUG | 17 | 1045 |
| myoC-1257 | - | GGGGACUGCAGGGAGUG | 17 | 1557 |
| myoC-1252 | - | GAGAAUUCCAGGAGGUG | 17 | 1552 |
| myoC-131 | - | GCCUGGUGUGGGAUGUG | 17 | 526 |
| myoC-1284 | - | GAAGGCCUUUAUUUAAU | 17 | 1584 |
| myoC-935 | + | GGGAGCCAGCCCUUCAU | 17 | 1064 |
| myoC-904 | - | GAUAUAGGAACUAUUAU | 17 | 1058 |
| myoC-135 | - | GGGCUGCAGAGGGAGCU | 17 | 530 |
| myoC-942 | + | GGUGGCCACGUGAGGCU | 17 | 1068 |

TABLE 9C-continued

| 3rd Tier | | | | |
|---|---|---|---|---|
| gRNA Name | DNA Strand | Targeting Domain | Target Site Length | Seq ID |
| myoC-957 | + | GUGCCAGGCACUAUGCU | 17 | 1071 |
| myoC-1251 | - | GGAGAAUUCCAGGAGGU | 17 | 1551 |
| myoC-944 | + | GCCACGUGAGGCUGGGU | 17 | 1059 |
| myoC-896 | - | GUCUUAAAGGACUUGUU | 17 | 1001 |
| myoC-689 | - | GCCAGACACCAGAGACAAAA | 20 | 1008 |
| myoC-997 | - | GAAAGGCAGGAAGGUGAAAA | 20 | 1297 |
| myoC-1007 | - | GAAGAAGUCUAUUUCAUGAA | 20 | 1307 |
| myoC-993 | - | GGGGCUGAGCGGGUGCUGAA | 20 | 1293 |
| myoC-881 | + | GCUGGGUGGGGCUGUGCACA | 20 | 1050 |
| myoC-120 | + | GGGCCUGGCAGCCUGGUCCA | 20 | 519 |
| myoC-998 | - | GCAGGAAGGUGAAAAGGGCA | 20 | 1298 |
| myoC-99 | - | GACCCAGGAGGGGCUGCAGA | 20 | 504 |
| myoC-718 | + | GGAGGCAGCAGGGGGCGCUA | 20 | 1015 |
| myoC-880 | + | GGCUGGGUGGGGCUGUGCAC | 20 | 1051 |
| myoC-1104 | + | GAAAAGAUAAAAAGGCUCAC | 20 | 1404 |
| myoC-835 | - | GUGUGUGUGUGUGUAAAACC | 20 | 1055 |
| myoC-742 | + | GCUCAGGACACCCAGGACCC | 20 | 1009 |
| myoC-97 | - | GGACCAGGCUGCCAGGCCCC | 20 | 502 |
| myoC-92 | - | GCUGCUGCUUCUGGCCUGCC | 20 | 498 |
| myoC-118 | + | GCUCCCUCUGCAGCCCCUCC | 20 | 517 |
| myoC-962 | - | GCUGGAGACUCCUUGGCUCC | 20 | 1262 |
| myoC-119 | + | GCAGCCCCUCCUGGGUCUCC | 20 | 518 |
| myoC-746 | + | GCUUGCAGGGCUCCCCCAGC | 20 | 1012 |
| myoC-676 | - | GCAGAGGUUUCCUCUCCAGC | 20 | 1006 |
| myoC-128 | + | GGCAGGCCAGAAGCAGCAGC | 20 | 524 |
| myoC-100 | - | GGAGGGGCUGCAGAGGGAGC | 20 | 505 |
| myoC-103 | - | GGAGCUGGGCACCCUGAGGC | 20 | 508 |
| myoC-748 | + | GCUGGAGAGGAAACCUCUGC | 20 | 1010 |
| myoC-863 | + | GCCUGGAUGGGUGGCCUUGC | 20 | 1049 |
| myoC-704 | + | GGAGGAGGCUUGGAAGACUC | 20 | 1014 |
| myoC-96 | - | GGGCCAGGACAGCUCAGCUC | 20 | 501 |
| myoC-116 | + | GUAGGCAGUCUCCAACUCUC | 20 | 483 |
| myoC-1019 | - | GUCUUUUCUUUCAUGUCUUC | 20 | 1319 |
| myoC-976 | - | GUGUUUCCUCAGAGGGAAAG | 20 | 1276 |
| myoC-715 | + | GGGCACGAUGGAGGCAGCAG | 20 | 1018 |
| myoC-98 | - | GGCCCCAGGAGACCCAGGAG | 20 | 503 |
| myoC-985 | - | GAGGUGGGGACUGCAGGGAG | 20 | 1285 |

TABLE 9C-continued

| 3rd Tier | | | | |
|---|---|---|---|---|
| gRNA Name | DNA Strand | Targeting Domain | Target Site Length | Seq ID |
| myoC-991 | - | GUGGGGACGCUGGGGCUGAG | 20 | 1291 |
| myoC-858 | + | GAAAGCUCUGCUGUGCUGAG | 20 | 1048 |
| myoC-716 | + | GGCACGAUGGAGGCAGCAGG | 20 | 1016 |
| myoC-701 | + | GCUGUGACUGAUGGAGGAGG | 20 | 1011 |
| myoC-102 | - | GGGAGCUGGGCACCCUGAGG | 20 | 507 |
| myoC-884 | + | GGGUGGGGCUGUGCACAGGG | 20 | 1052 |
| myoC-877 | + | GGUGGCCACGUGAGGCUGGG | 20 | 1053 |
| myoC-94 | - | GGCCUGCCUGGUGUGGGAUG | 20 | 499 |
| myoC-987 | - | GGUGGGGACUGCAGGGAGUG | 20 | 1287 |
| myoC-101 | - | GAGGGGCUGCAGAGGGAGCU | 20 | 506 |
| myoC-702 | + | GACUGAUGGAGGAGGAGGCU | 20 | 1004 |

Table 9D provides exemplary targeting domains for knocking down the MYOC gene selected according to the fourth tier parameters. The targeting domains bind within 3454-2454 bp upstream of transcription start site or 500 bp upstream and downstream of transcription start site. It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 9D

| 4th Tier | | | | |
|---|---|---|---|---|
| gRNA Name | DNA Strand | Targeting Domain | Target Site Length | Seq ID |
| myoC-765 | - | AGACACCAGAGACAAAA | 17 | 1133 |
| myoC-1267 | - | AGGCAGGAAGGUGAAAA | 17 | 1567 |
| myoC-1234 | - | AGGCUCCAGAAAGGAAA | 17 | 1534 |
| myoC-1266 | - | AAGGCAGGAAGGUGAAA | 17 | 1566 |
| myoC-1375 | + | AGGCUCACAGGAAGCAA | 17 | 1675 |
| myoC-769 | - | ACCCAGUGCUGAAAGAA | 17 | 1130 |
| myoC-1244 | - | UGUUUCCUCAGAGGGAA | 17 | 1544 |
| myoC-917 | - | CUGUCUUCCCCCAUGAA | 17 | 1244 |
| myoC-899 | - | UGAGUUUGCAGAGUGAA | 17 | 1254 |
| myoC-1370 | + | AUAUUCCCAUUAAAUAA | 17 | 1670 |
| myoC-5406 | + | CAGCCAGCCAGAACACA | 17 | 5152 |
| myoC-1385 | + | UCUGGAGCCUGGAGCCA | 17 | 1685 |

TABLE 9D-continued

4th Tier

| gRNA Name | DNA Strand | Targeting Domain | Target Site Length | Seq ID |
|---|---|---|---|---|
| myoC-293 | + | CCUGGCAGCCUGGUCCA | 17 | 679 |
| myoC-1279 | - | CAGCUGUUAAAAUUCCA | 17 | 1579 |
| myoC-922 | - | UCGGGCAUGAGCCAGCA | 17 | 1251 |
| myoC-1254 | - | AGGAGGUGGGGACUGCA | 17 | 1554 |
| myoC-1280 | - | AAAUUCCAGGGUGUGCA | 17 | 1580 |
| myoC-1269 | - | AUGUUCAGUGUUGUUCA | 17 | 1569 |
| myoC-265 | - | CCAGGAGGGGCUGCAGA | 17 | 651 |
| myoC-1236 | - | CAGAAAGGAAAUGGAGA | 17 | 1536 |
| myoC-262 | - | CCCCAGGAGACCCAGGA | 17 | 648 |
| myoC-912 | - | CCAAACAGACUUCUGGA | 17 | 1239 |
| myoC-916 | - | UCUGUCUUCCCCCAUGA | 17 | 1252 |
| myoC-1276 | - | AGAAGUCUAUUUCAUGA | 17 | 1576 |
| myoC-763 | - | UUUGUUAUCACUCUCUA | 17 | 1170 |
| myoC-299 | + | UGUCUCUCUGUAAGUUA | 17 | 685 |
| myoC-811 | + | CAGAAAUAGAAAGCAAC | 17 | 1149 |
| myoC-801 | + | UUCCUUUCUUUCAGCAC | 17 | 1168 |
| myoC-814 | + | AAAACAACCAGUGGCAC | 17 | 1127 |
| myoC-946 | + | UGGGUGGGGCUGUGCAC | 17 | 1257 |
| myoC-1374 | + | AAGAUAAAAAGGCUCAC | 17 | 1674 |
| myoC-1288 | - | UUCACGGAAGAAGUGAC | 17 | 1588 |
| myoC-901 | - | UGUGUGUGUGUAAAACC | 17 | 1258 |
| myoC-308 | + | CCCCCACAUCCCACACC | 17 | 694 |
| myoC-1372 | + | AAAACCCAUGCACACCC | 17 | 1672 |
| myoC-261 | - | CAGGCCCCAGGAGACCC | 17 | 647 |
| myoC-819 | + | CAGGACACCCAGGACCC | 17 | 1151 |
| myoC-820 | + | AGGACACCCAGGACCCC | 17 | 1138 |
| myoC-260 | - | CCAGGCUGCCAGGCCCC | 17 | 646 |
| myoC-292 | + | CCUGGGGCCUGGCAGCC | 17 | 678 |
| myoC-253 | - | CUGCCCAGAGCAGAGCC | 17 | 639 |
| myoC-1384 | + | AUUUCCUUUCUGGAGCC | 17 | 1684 |
| myoC-249 | - | UGUGGGAUGUGGGGGCC | 17 | 635 |
| myoC-291 | + | CUGGGUCUCCUGGGGCC | 17 | 677 |
| myoC-272 | - | AAAAUGAGAAUCUGGCC | 17 | 658 |
| myoC-810 | + | AAUUGUCAAUGAAUGCC | 17 | 1129 |
| myoC-259 | - | CCUUGGACCAGGCUGCC | 17 | 645 |
| myoC-925 | + | CUGUGCUGAGAGGUGCC | 17 | 1245 |
| myoC-956 | + | AGAACCUGCACUGUGCC | 17 | 1228 |
| myoC-1378 | + | CUGCAGUCCCCACCUCC | 17 | 1678 |
| myoC-287 | + | CCCUCUGCAGCCCCUCC | 17 | 673 |
| myoC-787 | + | CGGGCUUGGGGGCCUCC | 17 | 1155 |
| myoC-1379 | + | ACCUCCUGGAAUUCUCC | 17 | 1679 |
| myoC-900 | - | CAGCACACCAGUAGUCC | 17 | 1238 |
| myoC-307 | + | CCUGAGCUGAGCUGUCC | 17 | 693 |
| myoC-1278 | - | UCAGCUGUUAAAAUUCC | 17 | 1578 |
| myoC-311 | + | AGCAGCAGCUGGACAGC | 17 | 697 |
| myoC-823 | + | UGCAGGGCUCCCCCAGC | 17 | 1165 |
| myoC-286 | + | UGGUUUGGGUUUCCAGC | 17 | 672 |
| myoC-310 | + | AGGCCAGAAGCAGCAGC | 17 | 696 |
| myoC-267 | - | CACCCUGAGGCGGGAGC | 17 | 653 |
| myoC-309 | + | CACAUCCCACACCAGGC | 17 | 695 |
| myoC-941 | + | AGGUGGCCACGUGAGGC | 17 | 1233 |
| myoC-918 | - | CUUCCCCCAUGAAGGGC | 17 | 1246 |
| myoC-816 | + | CAGUGGCACGGGCUGGC | 17 | 1152 |
| myoC-1253 | - | CAGGAGGUGGGGACUGC | 17 | 1553 |
| myoC-898 | - | AGUGCCUGGCACAGUGC | 17 | 1234 |
| myoC-913 | - | UUUUCUAAGAAUCUUGC | 17 | 1260 |
| myoC-786 | + | UCGGGCUUGGGGGCCUC | 17 | 1162 |
| myoC-250 | - | CCAGGACAGCUCAGCUC | 17 | 636 |
| myoC-921 | - | AAACCUCUCUGGAGCUC | 17 | 1223 |
| myoC-300 | + | AUGGCCUGGCUCUGCUC | 17 | 686 |
| myoC-312 | + | UGGACAGCUGGCAUCUC | 17 | 698 |
| myoC-809 | + | AUUUUGUCUCUGGUGUC | 17 | 1144 |
| myoC-911 | - | AACUCCAAACAGACUUC | 17 | 1225 |
| myoC-243 | - | UGUCCAGCUGCUGCUUC | 17 | 629 |
| myoC-1289 | - | UUUUCUUUCAUGUCUUC | 17 | 1589 |
| myoC-1383 | + | CCUCUCCAUUUCCUUUC | 17 | 1683 |
| myoC-1246 | - | UUUCCUCAGAGGGAAAG | 17 | 1546 |
| myoC-938 | + | UUCAUGGGGGAAGACAG | 17 | 1259 |
| myoC-2657 | - | ACAGCAGAGCUUUCCAG | 17 | 2613 |
| myoC-792 | + | CACGAUGGAGGCAGCAG | 17 | 1148 |
| myoC-264 | - | CCCAGGAGGGGCUGCAG | 17 | 650 |
| myoC-251 | - | AAGGCCAAUGACCAGAG | 17 | 637 |
| myoC-263 | - | CCCAGGAGACCCAGGAG | 17 | 649 |
| myoC-1235 | - | CCAGAAAGGAAAUGGAG | 17 | 1535 |

TABLE 9D-continued

4th Tier

| gRNA Name | DNA Strand | Targeting Domain | Target Site Length | Seq ID |
|---|---|---|---|---|
| myoC-924 | + | AGCUCUGCUGUGCUGAG | 17 | 1232 |
| myoC-915 | − | CCCCACCCAGCCUCACG | 17 | 1241 |
| myoC-758 | − | AGCCCUGCAAGCACCCG | 17 | 1136 |
| myoC-273 | − | AUGAGAAUCUGGCCAGG | 17 | 659 |
| myoC-1249 | − | UCCAGGAGAAUUCCAGG | 17 | 1549 |
| myoC-793 | + | ACGAUGGAGGCAGCAGG | 17 | 1131 |
| myoC-939 | + | AUGGGGGAAGACAGAGG | 17 | 1237 |
| myoC-1250 | − | AGGAGAAUUCCAGGAGG | 17 | 1550 |
| myoC-282 | + | CUGACUUGUCUCGGAGG | 17 | 668 |
| myoC-797 | + | AGGGGGCGCUAGGGAGG | 17 | 1141 |
| myoC-266 | − | AGCUGGGCACCCUGAGG | 17 | 652 |
| myoC-950 | + | UGGGGCUGUGCACAGGG | 17 | 1256 |
| myoC-796 | + | AGCAGGGGGCGCUAGGG | 17 | 1135 |
| myoC-928 | + | AGAGGUGCCUGGAUGGG | 17 | 1229 |
| myoC-295 | + | CCAAGGUCAAUUGGUGG | 17 | 681 |
| myoC-248 | − | CCUGGUGUGGGAUGUGG | 17 | 634 |
| myoC-1275 | − | AUCUUUUCUCUGCUUGG | 17 | 1575 |
| myoC-246 | − | CUGCCUGGUGUGGGAUG | 17 | 632 |
| myoC-290 | + | CCCUCCUGGGUCUCCUG | 17 | 676 |
| myoC-1260 | − | AGGGAGUGGGGACGCUG | 17 | 1560 |
| myoC-1382 | + | AGGCCCCUUUCCCUCUG | 17 | 1682 |
| myoC-940 | + | ACAGAGGUGGCCACGUG | 17 | 1226 |
| myoC-945 | + | CCACGUGAGGCUGGGUG | 17 | 1240 |
| myoC-244 | − | UUCUGGCCUGCCUGGUG | 17 | 630 |
| myoC-3164 | + | AUUGCAGAGGCUUGGUG | 17 | 2910 |
| myoC-906 | − | UAUAGGAACUAUUAUUG | 17 | 1248 |
| myoC-784 | + | UGGAAGACUCGGGCUUG | 17 | 1166 |
| myoC-302 | + | UGGGCAGCUGGAUUCAU | 17 | 688 |
| myoC-927 | + | CUGAGAGGUGCCUGGAU | 17 | 1243 |
| myoC-1285 | − | UUAUUUAAUGGGAAUAU | 17 | 1585 |
| myoC-903 | − | AAACCAGGUGGAGAUAU | 17 | 1222 |
| myoC-908 | − | AACUAUUAUUGGGGUAU | 17 | 1224 |
| myoC-802 | + | UCCUUUCUUUCAGCACU | 17 | 1161 |
| myoC-780 | + | AGGAGGCUUGGAAGACU | 17 | 1139 |
| myoC-932 | + | AGAGGUUUAUAUAUACU | 17 | 1230 |
| myoC-1231 | − | CUGAGCUGGAGACUCCU | 17 | 1531 |
| myoC-288 | + | CCUCUGCAGCCCCUCCU | 17 | 674 |
| myoC-289 | + | CCCCUCCUGGGUCUCCU | 17 | 675 |
| myoC-760 | − | CAAGCACCCGGGGUCCU | 17 | 1147 |
| myoC-1286 | − | AAGCGAGCUCAUUUCCU | 17 | 1586 |
| myoC-753 | − | AGGUUUCCUCUCCAGCU | 17 | 1142 |
| myoC-920 | − | UAAACCUCUCUGGAGCU | 17 | 1247 |
| myoC-1259 | − | CAGGGAGUGGGGACGCU | 17 | 1559 |
| myoC-794 | + | AGGCAGCAGGGGGCGCU | 17 | 1140 |
| myoC-3165 | + | ACCUCAUUGCAGAGGCU | 17 | 2911 |
| myoC-779 | + | UGAUGGAGGAGGAGGCU | 17 | 1163 |
| myoC-1274 | − | UUUAUCUUUUCUCUGCU | 17 | 1574 |
| myoC-1377 | + | AACAACACUGAACAUCU | 17 | 1677 |
| myoC-301 | + | UGGCCUGGCUCUGCUCU | 17 | 687 |
| myoC-762 | − | UUUUGUUAUCACUCUCU | 17 | 1171 |
| myoC-1290 | − | UUUCUUUCAUGUCUUCU | 17 | 1590 |
| myoC-1256 | − | UGGGGACUGCAGGGAGU | 17 | 1556 |
| myoC-247 | − | UGCCUGGUGUGGGAUGU | 17 | 633 |
| myoC-283 | + | UCGGAGGAGGUUGCUGU | 17 | 669 |
| myoC-245 | − | UCUGGCCUGCCUGGUGU | 17 | 631 |
| myoC-905 | − | AUAUAGGAACUAUUAUU | 17 | 1235 |
| myoC-284 | + | UCUCCAACUCUCUGGUU | 17 | 670 |
| myoC-242 | − | CACGUUGCUGCAGCUUU | 17 | 628 |
| myoC-285 | + | CUCCAACUCUCUGGUUU | 17 | 671 |
| myoC-1103 | + | CAAGCAGAGAAAAGAUAAAA | 20 | 1403 |
| myoC-964 | − | UCCAGGCUCCAGAAAGGAAA | 20 | 1264 |
| myoC-996 | − | UGAAAGGCAGGAAGGUGAAA | 20 | 1296 |
| myoC-1105 | + | AAAAGGCUCACAGGAAGCAA | 20 | 1405 |
| myoC-693 | − | UAAACCCAGUGCUGAAAGAA | 20 | 1113 |
| myoC-963 | − | CUUGGCUCCAGGCUCCAGAA | 20 | 1263 |
| myoC-851 | − | CCUCUGUCUUCCCCCAUGAA | 20 | 1200 |
| myoC-833 | − | CAAUGAGUUUGCAGAGUGAA | 20 | 1188 |
| myoC-1100 | + | CCUAUAUUCCCAUUAAAUAA | 20 | 1400 |
| myoC-5407 | + | UAACAGCCAGCCAGAACACA | 20 | 5153 |
| myoC-1115 | + | CUUUCUGGAGCCUGGAGCCA | 20 | 1415 |
| myoC-223 | + | UUGGUGGAGGAGGCUCUCCA | 20 | 609 |
| myoC-984 | − | UCCAGGAGGUGGGGACUGCA | 20 | 1284 |
| myoC-966 | − | CUCCAGAAAGGAAAUGGAGA | 20 | 1266 |
| myoC-187 | − | AGGCCCCAGGAGACCCAGGA | 20 | 573 |

TABLE 9D-continued

4th Tier

| gRNA Name | DNA Strand | Targeting Domain | Target Site Length | Seq ID |
|---|---|---|---|---|
| myoC-175 | − | CAGGACAGCUCAGCUCAGGA | 20 | 561 |
| myoC-860 | + | UGUGCUGAGAGGUGCCUGGA | 20 | 1217 |
| myoC-850 | − | ACCUCUGUCUUCCCCCAUGA | 20 | 1175 |
| myoC-193 | − | AGGAAGAGAAGAAGCGACUA | 20 | 579 |
| myoC-687 | − | UGUUUUGUUAUCACUCUCUA | 20 | 1122 |
| myoC-734 | + | ACACAGAAAUAGAAAGCAAC | 20 | 1080 |
| myoC-892 | + | CCAGGCACUAUGCUAGGAAC | 20 | 1196 |
| myoC-724 | + | UAUUUCCUUUCUUUCAGCAC | 20 | 1116 |
| myoC-238 | + | UGGCCCCCACAUCCCACACC | 20 | 624 |
| myoC-887 | + | CACGUACACACACUUACACC | 20 | 1190 |
| myoC-185 | − | UGCCAGGCCCCAGGAGACCC | 20 | 571 |
| myoC-743 | + | CUCAGGACACCCAGGACCCC | 20 | 1107 |
| myoC-218 | + | UCUCCUGGGGCCUGGCAGCC | 20 | 604 |
| myoC-178 | − | CAGCUGCCCAGAGCAGAGCC | 20 | 564 |
| myoC-174 | − | UGGUGUGGGAUGUGGGGGCC | 20 | 560 |
| myoC-217 | + | CUCCUGGGUCUCCUGGGGCC | 20 | 603 |
| myoC-195 | − | AAGAAAAUGAGAAUCUGGCC | 20 | 581 |
| myoC-733 | + | AUAAAUUGUCAAUGAAUGCC | 20 | 1093 |
| myoC-184 | − | UGACCUUGGACCAGGCUGCC | 20 | 570 |
| myoC-749 | + | CUGGAGAGGAAACCUCUGCC | 20 | 1110 |
| myoC-831 | − | CCAGUUCCUAGCAUAGUGCC | 20 | 1198 |
| myoC-695 | − | CCUGCUGCCUCCAUCGUGCC | 20 | 1104 |
| myoC-890 | + | UUGAGAACCUGCACUGUGCC | 20 | 1221 |
| myoC-1108 | + | UCCCUGCAGUCCCCACCUCC | 20 | 1408 |
| myoC-834 | − | AAUCAGCACACCAGUAGUCC | 20 | 1174 |
| myoC-237 | + | CUUCCUGAGCUGAGCUGUCC | 20 | 623 |
| myoC-1008 | − | AAGUCAGCUGUUAAAAUUCC | 20 | 1308 |
| myoC-240 | + | AGAAGCAGCAGCUGGACAGC | 20 | 626 |
| myoC-230 | + | CUGGCUCUGCUCUGGGCAGC | 20 | 616 |
| myoC-992 | − | UGGGGACGCUGGGGCUGAGC | 20 | 1292 |
| myoC-988 | − | ACUGCAGGGAGUGGGGACGC | 20 | 1288 |
| myoC-852 | − | UGUCUUCCCCCAUGAAGGGC | 20 | 1216 |
| myoC-5408 | − | UGCUGUCCUUGUGUUCUGGC | 20 | 5154 |
| myoC-983 | − | UUCCAGGAGGUGGGGACUGC | 20 | 1283 |
| myoC-832 | − | CAUAGUGCCUGGCACAGUGC | 20 | 1194 |
| myoC-847 | − | UUAUUUUCUAAGAAUCUUGC | 20 | 1219 |
| myoC-194 | − | AAGGCAAGAAAAUGAGAAUC | 20 | 580 |

TABLE 9D-continued

4th Tier

| gRNA Name | DNA Strand | Targeting Domain | Target Site Length | Seq ID |
|---|---|---|---|---|
| myoC-731 | + | UUUGCUCACCAUUUUGUCUC | 20 | 1126 |
| myoC-845 | − | AGAAACUCCAAACAGACUUC | 20 | 1179 |
| myoC-1113 | + | UUCCCUCUCCAUUUCCUUUC | 20 | 1413 |
| myoC-882 | + | CUGGGUGGGGCUGUGCACAG | 20 | 1205 |
| myoC-872 | + | CCCUUCAUGGGGGAAGACAG | 20 | 1199 |
| myoC-2111 | − | AGCACAGCAGAGCUUUCCAG | 20 | 2233 |
| myoC-188 | − | AGACCCAGGAGGGGCUGCAG | 20 | 574 |
| myoC-176 | − | AGGAAGGCCAAUGACCAGAG | 20 | 562 |
| myoC-747 | + | CAGGGCUCCCCCAGCUGGAG | 20 | 1099 |
| myoC-849 | − | CAGCCCCACCCAGCCUCACG | 20 | 1193 |
| myoC-883 | + | UGGGUGGGGCUGUGCACAGG | 20 | 1215 |
| myoC-836 | − | UGUGUGUGUGUAAAACCAGG | 20 | 1218 |
| myoC-186 | − | CAGGCCCCAGGAGACCCAGG | 20 | 572 |
| myoC-196 | − | AAAAUGAGAAUCUGGCCAGG | 20 | 582 |
| myoC-873 | + | UUCAUGGGGGAAGACAGAGG | 20 | 1220 |
| myoC-862 | + | CUGAGAGGUGCCUGGAUGGG | 20 | 1202 |
| myoC-173 | − | CUGCCUGGUGUGGGAUGUGG | 20 | 559 |
| myoC-1005 | − | UUUAUCUUUUCUCUGCUUGG | 20 | 1305 |
| myoC-870 | + | UGGGGAGCCAGCCCUUCAUG | 20 | 1213 |
| myoC-189 | − | AGAGGGAGCUGGGCACCCUG | 20 | 575 |
| myoC-216 | + | AGCCCCUCCUGGGUCUCCUG | 20 | 602 |
| myoC-678 | − | AGAGGUUUCCUCUCCAGCUG | 20 | 1085 |
| myoC-990 | − | UGCAGGGAGUGGGGACGCUG | 20 | 1290 |
| myoC-1112 | + | UGGAGGCCCCUUUCCCUCUG | 20 | 1412 |
| myoC-874 | + | AAGACAGAGGUGGCCACGUG | 20 | 1172 |
| myoC-982 | − | CAGGAGAAUUCCAGGAGGUG | 20 | 1282 |
| myoC-879 | + | UGGCCACGUGAGGCUGGGUG | 20 | 1212 |
| myoC-171 | − | UGCUUCUGGCCUGCCUGGUG | 20 | 557 |
| myoC-172 | − | CCUGCCUGGUGUGGGAUGUG | 20 | 558 |
| myoC-231 | + | CUCUGGGCAGCUGGAUUCAU | 20 | 617 |
| myoC-869 | + | CUGGGGAGCCAGCCCUUCAU | 20 | 1204 |
| myoC-1015 | − | CCUUUAUUUAAUGGGAAUAU | 20 | 1315 |
| myoC-725 | + | AUUUCCUUUCUUUCAGCACU | 20 | 1095 |
| myoC-703 | + | AGGAGGAGGCUUGGAAGACU | 20 | 1090 |
| myoC-214 | + | CUCCCUCUGCAGCCCCUCCU | 20 | 600 |
| myoC-215 | + | CAGCCCCUCCUGGGUCUCCU | 20 | 601 |
| myoC-677 | − | CAGAGGUUUCCUCUCCAGCU | 20 | 1097 |

TABLE 9D-continued

| 4th Tier | | | | |
|---|---|---|---|---|
| gRNA Name | DNA Strand | Targeting Domain | Target Site Length | Seq ID |
| myoC-989 | - | CUGCAGGGAGUGGGGACGCU | 20 | 1289 |
| myoC-717 | + | UGGAGGCAGCAGGGGGCGCU | 20 | 1120 |
| myoC-891 | + | ACUGUGCCAGGCACUAUGCU | 20 | 1178 |
| myoC-1004 | - | CUUUUUAUCUUUUCUCUGCU | 20 | 1304 |
| myoC-229 | + | ACAUGGCCUGGCUCUGCUCU | 20 | 615 |
| myoC-686 | - | UUGUUUUGUUAUCACUCUCU | 20 | 1124 |
| myoC-1020 | - | UCUUUUCUUUCAUGUCUUCU | 20 | 1320 |
| myoC-986 | - | AGGUGGGGACUGCAGGGAGU | 20 | 1286 |
| myoC-211 | + | AGUCUCCAACUCUCUGGUUU | 20 | 597 |

Table 9E provides exemplary targeting domains for knocking down the MYOC gene selected according to the fifth tier parameters. The targeting domains bind within 2484-903 bp upstream of transcription start site or the additional 500 bp upstream and downstream of transcription start site (extending to 1 kb up and downstream of the transcription start site). It is contemplated herein that in an embodiment the targeting domain hybridizes to the target domain through complementary base pairing. Any of the targeting domains in the table can be used with a *S. pyogenes* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 9E

| 5th Tier | | | | |
|---|---|---|---|---|
| gRNA Name | DNA Strand | Targeting Domain | Target Site Length | Seq ID |
| myoC-5409 | + | GAGCAAAGGUUCAAAAA | 17 | 5155 |
| myoC-5410 | + | AGGAUAGUUUUUCAAAA | 17 | 5156 |
| myoC-1453 | + | CUUGAGACAUUUACAAA | 17 | 1753 |
| myoC-1456 | + | GUUUACAGCUGACCAAA | 17 | 1756 |
| myoC-1449 | + | AAAAAACAAAAAGCAAA | 17 | 1749 |
| myoC-5411 | - | UCACAGUCCAUAGCAAA | 17 | 5157 |
| myoC-5412 | + | GUCAUUUUAACAUCAAA | 17 | 5158 |
| myoC-5413 | + | AAGGAUAGUUUUUCAAA | 17 | 5159 |
| myoC-1460 | + | CUUCCUGUUAAAAGAAA | 17 | 1760 |
| myoC-5414 | + | GCAGUCUCUAGGAGAAA | 17 | 5160 |
| myoC-5415 | - | GCAAAAGGAGAAAUAAA | 17 | 5161 |
| myoC-1420 | - | UGGAGUUAGCAGCACAA | 17 | 1720 |

TABLE 9E-continued

| 5th Tier | | | | |
|---|---|---|---|---|
| gRNA Name | DNA Strand | Targeting Domain | Target Site Length | Seq ID |
| myoC-1332 | - | UCCCUAAGCAUAGACAA | 17 | 1632 |
| myoC-1497 | + | UAAAAUAUAGAUUACAA | 17 | 1797 |
| myoC-1364 | + | GUCGCACAGCCAACCAA | 17 | 1664 |
| myoC-1455 | + | UGUUUACAGCUGACCAA | 17 | 1755 |
| myoC-5416 | + | AAUAACAAUCUGAGCAA | 17 | 5162 |
| myoC-1443 | + | UAUGGCUCUAUUCGCAA | 17 | 1743 |
| myoC-1358 | + | GAACACGAGAGCUGCAA | 17 | 1658 |
| myoC-1432 | - | AACAUAAAGUUGCUCAA | 17 | 1732 |
| myoC-1395 | - | AAGACAGAUUCAUUCAA | 17 | 1695 |
| myoC-1412 | - | GGAAAAAAUCAGUUCAA | 17 | 1712 |
| myoC-5417 | + | UGCAGUCUCUAGGAGAA | 17 | 5163 |
| myoC-145 | - | GGUAGCAAGGCUGAGAA | 17 | 540 |
| myoC-1463 | + | AAUUACUCAGCUUGUAA | 17 | 1763 |
| myoC-1367 | + | AAGCCAAGUCCACCACA | 17 | 1667 |
| myoC-1399 | - | AGUGGGAAUUGACCACA | 17 | 1699 |
| myoC-1317 | - | GGAGCAGCUGAGCCACA | 17 | 1617 |
| myoC-1419 | - | GUGGAGUUAGCAGCACA | 17 | 1719 |
| myoC-1356 | + | CCUCACAGAGAAUCACA | 17 | 1656 |
| myoC-1415 | - | AUUCUGAGCAAGUCACA | 17 | 1715 |
| myoC-5418 | + | GACUGUGAAAACUGACA | 17 | 5164 |
| myoC-1361 | + | GAGAAGACUAUGGCCCA | 17 | 1661 |
| myoC-1363 | + | GGAGAGACACUUGCCCA | 17 | 1663 |
| myoC-1429 | - | UGGAGGUGAGUCUGCCA | 17 | 1729 |
| myoC-1488 | + | CACCCUACCAGGCUCCA | 17 | 1788 |
| myoC-1365 | + | CGAGUCUCCUGAUUCCA | 17 | 1665 |
| myoC-1439 | - | UUUAUUAAUGUAAAGCA | 17 | 1739 |
| myoC-1387 | - | AGUGACUGCUGACAGCA | 17 | 1687 |
| myoC-144 | - | GCAGCCAGGAGGUAGCA | 17 | 539 |
| myoC-1389 | - | GAGUGACCUGCAGCGCA | 17 | 1689 |
| myoC-5419 | + | AGGAGAAAGGGCAGGCA | 17 | 5165 |
| myoC-1405 | - | CUGGGUUCUAGGAGGCA | 17 | 1705 |
| myoC-1357 | + | AGAACACGAGAGCUGCA | 17 | 1657 |
| myoC-1474 | + | GCGUGGGGGUGCUGGUCA | 17 | 1774 |
| myoC-1394 | - | AAAGACAGAUUCAUUCA | 17 | 1694 |
| myoC-1411 | - | GGGAAAAAAUCAGUUCA | 17 | 1711 |
| myoC-1294 | - | ACUUGGCUUAUGCAAGA | 17 | 1594 |
| myoC-1393 | - | AGGAGAAGAAAAAGAGA | 17 | 1693 |

TABLE 9E-continued

| 5th Tier | | | | |
|---|---|---|---|---|
| gRNA Name | DNA Strand | Targeting Domain | Target Site Length | Seq ID |
| myoC-3167 | - | CCACCAGGCUCCAGAGA | 17 | 2913 |
| myoC-274 | - | AGGUAGCAAGGCUGAGA | 17 | 660 |
| myoC-1311 | - | GAGGGGGGAUGUUGAGA | 17 | 1611 |
| myoC-1444 | + | UGUUAAAUUUAGUUAGA | 17 | 1744 |
| myoC-1326 | - | GGUGGAGGGGGACAGGA | 17 | 1626 |
| myoC-1362 | + | AGACUAUGGCCCAGGGA | 17 | 1662 |
| myoC-1345 | + | UUGUCUAUGCUUAGGGA | 17 | 1645 |
| myoC-1313 | - | GGGAUGUUGAGAGGGGA | 17 | 1613 |
| myoC-5420 | + | GUGAAAACUGACAUGGA | 17 | 5166 |
| myoC-1322 | - | GCCACAGGGGAGGUGGA | 17 | 1622 |
| myoC-1353 | + | UGAUCAGUGAGGACUGA | 17 | 1653 |
| myoC-2616 | - | UUUAAAGCUAGGGGUGA | 17 | 2581 |
| myoC-1306 | - | CCUGUGAUUCUCUGUGA | 17 | 1606 |
| myoC-5421 | + | UUACUAGUAAUACUUGA | 17 | 5167 |
| myoC-1462 | + | AAAAAGAGUUCCUAAUA | 17 | 1762 |
| myoC-5422 | - | GAGUUCAGCAGGUGAUA | 17 | 5168 |
| myoC-1359 | + | UAUAGCAGAGAAGACUA | 17 | 1659 |
| myoC-271 | - | AAGAGAAGAAGCGACUA | 17 | 657 |
| myoC-5423 | - | CAGUUGUUUUAAAGCUA | 17 | 5169 |
| myoC-5424 | + | UAUUUCUCCUUUUGCUA | 17 | 5170 |
| myoC-1484 | - | CUCCCUGGAGCCUGGUA | 17 | 1784 |
| myoC-5425 | - | ACAAGACAGAUGAAUUA | 17 | 5171 |
| myoC-1344 | + | GCCAUUGUCUAUGCUUA | 17 | 1644 |
| myoC-1442 | + | UUACCACUUUGAGUUUA | 17 | 1742 |
| myoC-1336 | - | GCCUGGCAUUCAAAAAC | 17 | 1636 |
| myoC-1461 | + | UUCCUGUUAAAAGAAAC | 17 | 1761 |
| myoC-1333 | - | AGAAUGCAGAGACUAAC | 17 | 1633 |
| myoC-1421 | - | AUCCCGUUUCUUUUAAC | 17 | 1721 |
| myoC-279 | + | CUCGGGUCUGGGGACAC | 17 | 665 |
| myoC-1366 | + | UAAGCCAAGUCCACCAC | 17 | 1666 |
| myoC-1398 | - | CAGUGGGAAUUGACCAC | 17 | 1698 |
| myoC-1316 | - | UGGAGCAGCUGAGCCAC | 17 | 1616 |
| myoC-5426 | + | GGUAAUGACAAAAUCAC | 17 | 5172 |
| myoC-1355 | + | CCCUCACAGAGAAUCAC | 17 | 1655 |
| myoC-1446 | + | UCCUCAUUCAAAUUCAC | 17 | 1746 |
| myoC-5427 | - | AGGAGAAAUAAAAGGAC | 17 | 5173 |
| myoC-1325 | - | GGGAGGUGGAGGGGGAC | 17 | 1625 |
| myoC-5428 | - | UCGUAGUGACCUGCUAC | 17 | 5174 |
| myoC-148 | - | GCUCGGGCUGUGCCACC | 17 | 490 |
| myoC-5429 | + | UGCAGACACAUCUCACC | 17 | 5175 |
| myoC-5430 | - | GGAGAAAUAAAAGGACC | 17 | 5176 |
| myoC-1486 | + | AAGGACAGCACCCUACC | 17 | 1786 |
| myoC-1465 | + | CCUGCCUCCUAGAACCC | 17 | 1765 |
| myoC-1360 | + | AGAGAAGACUAUGGCCC | 17 | 1660 |
| myoC-1450 | + | AUAUUUCCAAACUGCCC | 17 | 1750 |
| myoC-1481 | - | UAUAGGAAUGCUCUCCC | 17 | 1781 |
| myoC-1303 | - | AAGUGUCUCUCCUUCCC | 17 | 1603 |
| myoC-142 | - | GUUGGAAAGCAGCAGCC | 17 | 537 |
| myoC-1482 | - | AUGCUCUCCCUGGAGCC | 17 | 1782 |
| myoC-3169 | + | UUACCUUCUCUGGAGCC | 17 | 2915 |
| myoC-5431 | + | GGGCAGGCAGGGAGGCC | 17 | 5177 |
| myoC-272 | - | AAAAUGAGAAUCUGGCC | 17 | 658 |
| myoC-1340 | + | CCCAGUUUUUGAAUGCC | 17 | 1640 |
| myoC-1428 | - | CUGGAGGUGAGUCUGCC | 17 | 1728 |
| myoC-1335 | - | UGGUGGUAGCUUUUGCC | 17 | 1635 |
| myoC-1400 | - | UAUAGUCCACGUGAUCC | 17 | 1700 |
| myoC-1330 | - | UGAUCACGUCAGACUCC | 17 | 1630 |
| myoC-151 | + | GCUGCUUUCCAACCUCC | 17 | 543 |
| myoC-280 | + | UCAGCCUUGCUACCUCC | 17 | 666 |
| myoC-5432 | - | CCUGCUACAGGCGCUCC | 17 | 5178 |
| myoC-1487 | + | GCACCCUACCAGGCUCC | 17 | 1787 |
| myoC-1351 | + | AUUGUGGCUCUCGGUCC | 17 | 1651 |
| myoC-1438 | - | GUUUAUUAAUGUAAAGC | 17 | 1738 |
| myoC-1328 | - | GGAAGGCAGGCAGAAGC | 17 | 1628 |
| myoC-1498 | + | UAAAAACAAGAUCCAGC | 17 | 1798 |
| myoC-5433 | - | GGGACUCUGAGUUCAGC | 17 | 5179 |
| myoC-1315 | - | GGGGAAGGAGGCAGAGC | 17 | 1615 |
| myoC-5434 | + | CCUGGAGCGCCUGUAGC | 17 | 5180 |
| myoC-1388 | - | GGAGUGACCUGCAGCGC | 17 | 1688 |
| myoC-1327 | - | GAGGGGGACAGGAAGGC | 17 | 1627 |
| myoC-5435 | + | UAGGAGAAAGGGCAGGC | 17 | 5181 |
| myoC-1404 | - | CCUGGGUUCUAGGAGGC | 17 | 1704 |
| myoC-5436 | + | UCUCUAGGAGAAAGGGC | 17 | 5182 |
| myoC-1475 | - | GAAAUUAGACCUCCUGC | 17 | 1775 |

TABLE 9E-continued

| 5th Tier | | | | |
|---|---|---|---|---|
| gRNA Name | DNA Strand | Targeting Domain | Target Site Length | Seq ID |
| myoC-1468 | + | CUCCUCCCCUGCGCUGC | 17 | 1768 |
| myoC-1472 | + | UGAGCUGCGUGGGGUGC | 17 | 1772 |
| myoC-1464 | + | AUAUAGUAUUAGAAAUC | 17 | 1764 |
| myoC-1494 | + | ACCUCAUUGGUGAAAUC | 17 | 1794 |
| myoC-140 | - | GCAAGAAAAUGAGAAUC | 17 | 535 |
| myoC-1296 | - | UCGAAAACCUUGGAAUC | 17 | 1596 |
| myoC-1426 | - | ACUGUGUUUCUCCACUC | 17 | 1726 |
| myoC-147 | - | GACCCGAGACACUGCUC | 17 | 489 |
| myoC-1339 | + | GCAUUUUCCACUUGCUC | 17 | 1639 |
| myoC-5437 | + | AAAAGUUUAACAAUCUC | 17 | 5183 |
| myoC-1492 | + | UUUCAGUCUUGCAUCUC | 17 | 1792 |
| myoC-5438 | + | AUCUAAAUGAAGCUCUC | 17 | 5184 |
| myoC-277 | + | AGCCCGAGCAGUGUCUC | 17 | 663 |
| myoC-3170 | + | UGCAUUCUUACCUUCUC | 17 | 2916 |
| myoC-1414 | - | UCAGUUCAAGGGAAGUC | 17 | 1714 |
| myoC-149 | + | GAGCAGUGUCUCGGGUC | 17 | 491 |
| myoC-1473 | + | UGCGUGGGGUGCUGGUC | 17 | 1773 |
| myoC-1331 | - | GAGAGCCACAAUGCUUC | 17 | 1631 |
| myoC-1425 | - | GUAAAUGUCUCAAGUUC | 17 | 1725 |
| myoC-1485 | - | GUGCUGUCCUUGUGUUC | 17 | 1785 |
| myoC-1447 | + | CAAAUUCACAGGCUUUC | 17 | 1747 |
| myoC-1298 | - | AGACUCGGUUUUCUUUC | 17 | 1598 |
| myoC-1441 | - | GAGCCAUAAACUCAAAG | 17 | 1741 |
| myoC-1338 | - | AACUGGGCCAGAGCAAG | 17 | 1638 |
| myoC-1433 | - | GCAAUCAUUAUUUCAAG | 17 | 1733 |
| myoC-146 | - | GUAGCAAGGCUGAGAAG | 17 | 541 |
| myoC-1489 | + | GAGCAUUCCUAUAGAAG | 17 | 1789 |
| myoC-1318 | - | GAGCAGCUGAGCCACAG | 17 | 1618 |
| myoC-1390 | - | AGUGACCUGCAGCGCAG | 17 | 1690 |
| myoC-1396 | - | GAUUCAUUCAAGGGCAG | 17 | 1696 |
| myoC-1392 | - | GAGGAGAAGAAAAAGAG | 17 | 1692 |
| myoC-1451 | + | CAGACUCACCUCCAGAG | 17 | 1751 |
| myoC-3171 | - | AAGGUAAGAAUGCAGAG | 17 | 2917 |
| myoC-1312 | - | AGGGGGGAUGUUGAGAG | 17 | 1612 |
| myoC-5439 | + | UGAAAACUGACAUGGAG | 17 | 5185 |
| myoC-1323 | - | CCACAGGGGAGGUGGAG | 17 | 1623 |
| myoC-2617 | - | UUAAAGCUAGGGGUGAG | 17 | 2582 |
| myoC-1307 | - | CUGUGAUUCUCUGUGAG | 17 | 1607 |
| myoC-1310 | - | UGAGGGGGGAUGUUGAG | 17 | 1610 |
| myoC-5440 | - | AGUUGUUUUAAAGCUAG | 17 | 5186 |
| myoC-5441 | - | AGCUUCAUUUAGAUUAG | 17 | 5187 |
| myoC-1478 | - | AGUAAGAACUGAUUUAG | 17 | 1778 |
| myoC-1466 | + | UAGAACCCAGGAUCACG | 17 | 1766 |
| myoC-1301 | - | GGUUGGCUGUGCGACCG | 17 | 1601 |
| myoC-1469 | + | GUCACUGCUGAGCUGCG | 17 | 1769 |
| myoC-1445 | + | UAAAUUUAGUUAGAAGG | 17 | 1745 |
| myoC-1314 | - | AUGUUGAGAGGGGAAGG | 17 | 1614 |
| myoC-143 | - | GGAAAGCAGCAGCCAGG | 17 | 538 |
| myoC-273 | - | AUGAGAAUCUGGCCAGG | 17 | 659 |
| myoC-1499 | + | AAACAAGAUCCAGCAGG | 17 | 1799 |
| myoC-1320 | - | CUGAGCCACAGGGGAGG | 17 | 1620 |
| myoC-1324 | - | CACAGGGGAGGUGGAGG | 17 | 1624 |
| myoC-2618 | - | UAAAGCUAGGGGUGAGG | 17 | 2583 |
| myoC-1308 | - | UGUGAUUCUCUGUGAGG | 17 | 1608 |
| myoC-1403 | - | UGAUCCUGGGUUCUAGG | 17 | 1703 |
| myoC-5442 | + | AGAAAGGGCAGGCAGGG | 17 | 5188 |
| myoC-2619 | - | AAAGCUAGGGGUGAGGG | 17 | 2584 |
| myoC-1309 | - | GUGAUUCUCUGUGAGGG | 17 | 1609 |
| myoC-1319 | - | CAGCUGAGCCACAGGGG | 17 | 1619 |
| myoC-1391 | - | GACCUGCAGCGCAGGGG | 17 | 1691 |
| myoC-3172 | - | UAAGAAUGCAGAGUGGG | 17 | 2918 |
| myoC-1410 | - | CAGGGCUAUAUUGUGGG | 17 | 1710 |
| myoC-5443 | + | UGUGAAAACUGACAUGG | 17 | 5189 |
| myoC-1334 | - | AUGCAGAGACUAACUGG | 17 | 1634 |
| myoC-3173 | + | CCUUCUCUGGAGCCUGG | 17 | 2919 |
| myoC-1427 | - | GUGUUUCUCCACUCUGG | 17 | 1727 |
| myoC-3174 | - | GUAAGAAUGCAGAGUGG | 17 | 2920 |
| myoC-1321 | - | AGCCACAGGGGAGGUGG | 17 | 1621 |
| myoC-1292 | - | ACUACUCAGCCCUGUGG | 17 | 1592 |
| myoC-1409 | - | GCAGGGCUAUAUUGUGG | 17 | 1709 |
| myoC-1346 | + | CUUAGGGAAGGAAAAUG | 17 | 1646 |
| myoC-1476 | - | CCCAGAUUUCACCAAUG | 17 | 1776 |
| myoC-1440 | - | GCCUGUGAAUUUGAAUG | 17 | 1740 |
| myoC-1416 | - | UCACAAGGUAGUAACUG | 17 | 1716 |

TABLE 9E-continued

| 5th Tier | | | | |
|---|---|---|---|---|
| gRNA Name | DNA Strand | Targeting Domain | Target Site Length | Seq ID |
| myoC-1354 | + | CCCCUCCACCUCCCCUG | 17 | 1654 |
| myoC-1291 | - | GCAACUACUCAGCCCUG | 17 | 1591 |
| myoC-1467 | + | GUGGACUAUAAUCCCUG | 17 | 1767 |
| myoC-1496 | + | CUCAUUGGUGAAAUCUG | 17 | 1796 |
| myoC-1418 | - | GGAACUCUUUUUCUCUG | 17 | 1718 |
| myoC-150 | + | GCAGUGUCUCGGGUCUG | 17 | 542 |
| myoC-1352 | + | GUCUGACGUGAUCAGUG | 17 | 1652 |
| myoC-3175 | - | GGUAAGAAUGCAGAGUG | 17 | 2921 |
| myoC-1471 | + | CACUGCUGAGCUGCGUG | 17 | 1771 |
| myoC-2615 | - | UUUUAAAGCUAGGGGUG | 17 | 2580 |
| myoC-1305 | - | CCCUGUGAUUCUCUGUG | 17 | 1605 |
| myoC-1408 | - | GGCAGGGCUAUAUUGUG | 17 | 1708 |
| myoC-1349 | + | GCUUUCCUGAAGCAUUG | 17 | 1649 |
| myoC-1406 | - | GAGGCAGGGCUAUAUUG | 17 | 1706 |
| myoC-1454 | + | UUGAGACAUUUACAAAU | 17 | 1754 |
| myoC-1479 | - | GAGGCUAACAUUGACAU | 17 | 1779 |
| myoC-1299 | - | CUUUCUGGUUCUGCCAU | 17 | 1599 |
| myoC-1493 | + | CAUGCCAAGAACCUCAU | 17 | 1793 |
| myoC-1423 | - | CUUGCUGACUAUAUGAU | 17 | 1723 |
| myoC-1452 | + | UUCUAUUCUUAUUUGAU | 17 | 1752 |
| myoC-1480 | - | AAAUCUGCCGCUUCUAU | 17 | 1780 |
| myoC-1500 | + | AUGUCUGUGAUUUCUAU | 17 | 1800 |
| myoC-1342 | + | GCAUUCUUUUUGGUUAU | 17 | 1642 |
| myoC-1435 | - | AGUUUUGGUAUAUUUAU | 17 | 1735 |
| myoC-1337 | - | CCUGGCAUUCAAAAACU | 17 | 1637 |
| myoC-1297 | - | CUUGGAAUCAGGAGACU | 17 | 1597 |
| myoC-1293 | - | CAGCCCUGUGGUGGACU | 17 | 1593 |
| myoC-1295 | - | AAGACGGUCGAAAACCU | 17 | 1595 |
| myoC-1457 | + | UAUAGUCAGCAAGACCU | 17 | 1757 |
| myoC-1304 | - | AGUGUCUCUCCUUCCCU | 17 | 1604 |
| myoC-1422 | - | CAAACAGAUUCAAGCCU | 17 | 1722 |
| myoC-1401 | - | AUAGUCCACGUGAUCCU | 17 | 1701 |
| myoC-2612 | - | ACAGUUGUUUUAAAGCU | 17 | 2577 |
| myoC-1329 | - | GAAGGCAGGCAGAAGCU | 17 | 1629 |
| myoC-275 | - | AGACCCGAGACACUGCU | 17 | 661 |
| myoC-1495 | + | CCUCAUUGGUGAAAUCU | 17 | 1795 |
| myoC-1350 | + | UGAAGCAUUGUGGCUCU | 17 | 1650 |

TABLE 9E-continued

| 5th Tier | | | | |
|---|---|---|---|---|
| gRNA Name | DNA Strand | Targeting Domain | Target Site Length | Seq ID |
| myoC-5444 | + | CUAGCUGUGCAGUCUCU | 17 | 5190 |
| myoC-278 | + | AGCAGUGUCUCGGGUCU | 17 | 664 |
| myoC-276 | + | CAGCCCGAGCAGUGUCU | 17 | 662 |
| myoC-1290 | - | UUUCUUUCAUGUCUUCU | 17 | 1590 |
| myoC-1477 | - | UUCACCAAUGAGGUUCU | 17 | 1777 |
| myoC-1402 | - | ACGUGAUCCUGGGUUCU | 17 | 1702 |
| myoC-1413 | - | AUCAGUUCAAGGGAAGU | 17 | 1713 |
| myoC-1397 | - | AUUCAUUCAAGGGCAGU | 17 | 1697 |
| myoC-3177 | - | AGGUAAGAAUGCAGAGU | 17 | 2923 |
| myoC-1302 | - | GUUGGCUGUGCGACCGU | 17 | 1602 |
| myoC-1470 | + | UCACUGCUGAGCUGCGU | 17 | 1770 |
| myoC-141 | - | GAAUCUGGCCAGGAGGU | 17 | 536 |
| myoC-1483 | - | UCUCCCUGGAGCCUGGU | 17 | 1783 |
| myoC-1300 | - | CUGGUUCUGCCAUUGGU | 17 | 1600 |
| myoC-1448 | + | CAGGCUUUCUGGACUGU | 17 | 1748 |
| myoC-1347 | + | AAGGAAAAUGUGGCUGU | 17 | 1647 |
| myoC-1407 | - | AGGCAGGGCUAUAUUGU | 17 | 1707 |
| myoC-1431 | - | AGUAUUGACACUGUUGU | 17 | 1731 |
| myoC-1417 | - | CUUAGUUUCUCCUUAUU | 17 | 1717 |
| myoC-1424 | - | AUGAGACUAGUACCCUU | 17 | 1724 |
| myoC-1343 | + | UGCCAUUGUCUAUGCUU | 17 | 1643 |
| myoC-1490 | + | AAACAACUGUGUAUCUU | 17 | 1790 |
| myoC-1459 | + | UGUUUGGCUUUACUCUU | 17 | 1759 |
| myoC-1436 | - | UUUUUGUUUUUUCUCUU | 17 | 1736 |
| myoC-1430 | - | AGUCUGCCAGGGCAGUU | 17 | 1730 |
| myoC-1348 | + | AGGAAAAUGUGGCUGUU | 17 | 1648 |
| myoC-1458 | + | CUAGGCUUGAAUCUGUU | 17 | 1758 |
| myoC-1491 | + | AACAACUGUGUAUCUUU | 17 | 1791 |
| myoC-1437 | - | UUUUGUUUUUUCUCUUU | 17 | 1737 |
| myoC-1434 | - | GUUACUUCUGACAGUUU | 17 | 1734 |
| myoC-1341 | + | AGUCUCUGCAUUCUUUU | 17 | 1641 |
| myoC-5445 | + | UCUGAGCAAAGGUUCAAAAA | 20 | 5191 |
| myoC-5446 | + | AAAAGGAUAGUUUUUCAAAA | 20 | 5192 |
| myoC-1183 | + | GAACUUGAGACAUUUACAAA | 20 | 1483 |
| myoC-1186 | + | UUUGUUUACAGCUGACCAAA | 20 | 1486 |
| myoC-1179 | + | GAGAAAAAACAAAAAGCAAA | 20 | 1479 |
| myoC-5447 | - | UUUUCACAGUCCAUAGCAAA | 20 | 5193 |

TABLE 9E-continued

| 5th Tier | | | | |
|---|---|---|---|---|
| gRNA Name | DNA Strand | Targeting Domain | Target Site Length | Seq ID |
| myoC-5448 | + | AAGGUCAUUUUAACAUCAAA | 20 | 5194 |
| myoC-5449 | + | AAAAAGGAUAGUUUUUCAAA | 20 | 5195 |
| myoC-1190 | + | UUUCUUCCUGUUAAAAGAAA | 20 | 1490 |
| myoC-5450 | + | UGUGCAGUCUCUAGGAGAAA | 20 | 5196 |
| myoC-5451 | - | AUAGCAAAAGGAGAAAUAAA | 20 | 5197 |
| myoC-1150 | - | CUGUGGAGUUAGCAGCACAA | 20 | 1450 |
| myoC-1062 | - | CCUUCCCUAAGCAUAGACAA | 20 | 1362 |
| myoC-1227 | + | AUAUAAAAUAUAGAUUACAA | 20 | 1527 |
| myoC-1094 | + | ACGGUCGCACAGCCAACCAA | 20 | 1394 |
| myoC-1185 | + | GUUUGUUUACAGCUGACCAA | 20 | 1485 |
| myoC-5452 | + | ACAAAUAACAAUCUGAGCAA | 20 | 5198 |
| myoC-1173 | + | GUUUAUGGCUCUAUUCGCAA | 20 | 1473 |
| myoC-1088 | + | ACAGAACACGAGAGCUGCAA | 20 | 1388 |
| myoC-1162 | - | AACAACAUAAAGUUGCUCAA | 20 | 1462 |
| myoC-1125 | - | AGAAAGACAGAUUCAUUCAA | 20 | 1425 |
| myoC-1142 | - | GGGGGAAAAAAUCAGUUCAA | 20 | 1442 |
| myoC-5453 | + | CUGUGCAGUCUCUAGGAGAA | 20 | 5199 |
| myoC-110 | - | GGAGGUAGCAAGGCUGAGAA | 20 | 513 |
| myoC-1193 | + | CAGAAUUACUCAGCUUGUAA | 20 | 1493 |
| myoC-1097 | + | CAUAAGCCAAGUCCACCACA | 20 | 1397 |
| myoC-1129 | - | GGCAGUGGGAAUUGACCACA | 20 | 1429 |
| myoC-1047 | - | GCUGGAGCAGCUGAGCCACA | 20 | 1347 |
| myoC-1149 | - | UCUGUGGAGUUAGCAGCACA | 20 | 1449 |
| myoC-1086 | + | CCCCCUCACAGAGAAUCACA | 20 | 1386 |
| myoC-1145 | - | GUAAUUCUGAGCAAGUCACA | 20 | 1445 |
| myoC-5454 | + | AUGGACUGUGAAAACUGACA | 20 | 5200 |
| myoC-1091 | + | GCAGAGAAGACUAUGGCCCA | 20 | 1391 |
| myoC-1093 | + | GAAGGAGAGACACUUGCCCA | 20 | 1393 |
| myoC-1159 | - | CUCUGGAGGUGAGUCUGCCA | 20 | 1459 |
| myoC-1218 | + | CAGCACCCUACCAGGCUCCA | 20 | 1518 |
| myoC-1095 | + | AACCGAGUCUCCUGAUUCCA | 20 | 1395 |
| myoC-1169 | - | GGGUUUAUUAAUGUAAAGCA | 20 | 1469 |
| myoC-1117 | - | AGCAGUGACUGCUGACAGCA | 20 | 1417 |
| myoC-109 | - | GCAGCAGCCAGGAGGUAGCA | 20 | 512 |
| myoC-1119 | - | ACGGAGUGACCUGCAGCGCA | 20 | 1419 |
| myoC-5455 | + | UCUAGGAGAAAGGGCAGGCA | 20 | 5201 |
| myoC-1135 | - | AUCCUGGGUUCUAGGAGGCA | 20 | 1435 |

TABLE 9E-continued

| 5th Tier | | | | |
|---|---|---|---|---|
| gRNA Name | DNA Strand | Targeting Domain | Target Site Length | Seq ID |
| myoC-1087 | + | CACAGAACACGAGAGCUGCA | 20 | 1387 |
| myoC-1204 | + | GCUGCGUGGGGUGCUGGUCA | 20 | 1504 |
| myoC-1124 | - | AAGAAAGACAGAUUCAUUCA | 20 | 1424 |
| myoC-1141 | - | GGGGGGAAAAAAUCAGUUCA | 20 | 1441 |
| myoC-1024 | - | UGGACUUGGCUUAUGCAAGA | 20 | 1324 |
| myoC-1123 | - | GGGAGGAGAAGAAAAAGAGA | 20 | 1423 |
| myoC-3181 | - | GUGCCACCAGGCUCCAGAGA | 20 | 2927 |
| myoC-198 | - | AGGAGGUAGCAAGGCUGAGA | 20 | 584 |
| myoC-1041 | - | UGUGAGGGGGGAUGUUGAGA | 20 | 1341 |
| myoC-1174 | + | AAAUGUUAAAUUUAGUUAGA | 20 | 1474 |
| myoC-1056 | - | GGAGGUGGAGGGGGACAGGA | 20 | 1356 |
| myoC-1092 | + | AGAAGACUAUGGCCCAGGGA | 20 | 1392 |
| myoC-1075 | + | CCAUUGUCUAUGCUUAGGGA | 20 | 1375 |
| myoC-1043 | - | GGGGGGAUGUUGAGAGGGGA | 20 | 1343 |
| myoC-5456 | + | ACUGUGAAAACUGACAUGGA | 20 | 5202 |
| myoC-1052 | - | UGAGCCACAGGGGAGGUGGA | 20 | 1352 |
| myoC-1083 | + | ACGUGAUCAGUGAGGACUGA | 20 | 1383 |
| myoC-2070 | - | UGUUUUAAAGCUAGGGGUGA | 20 | 2201 |
| myoC-1036 | - | UUCCCUGUGAUUCUCUGUGA | 20 | 1336 |
| myoC-5457 | + | AAAUUACUAGUAAUACUUGA | 20 | 5203 |
| myoC-1192 | + | GAGAAAAAGAGUUCCUAAUA | 20 | 1492 |
| myoC-5458 | - | UCUGAGUUCAGCAGGUGAUA | 20 | 5204 |
| myoC-1089 | + | CUUUAUAGCAGAGAAGACUA | 20 | 1389 |
| myoC-193 | - | AGGAAGAGAAGAAGCGACUA | 20 | 579 |
| myoC-5459 | - | ACACAGUUGUUUUAAAGCUA | 20 | 5205 |
| myoC-5460 | + | UUUUAUUUCUCCUUUUGCUA | 20 | 5206 |
| myoC-1214 | - | GCUCUCCCUGGAGCCUGGUA | 20 | 1514 |
| myoC-5461 | - | AGCACAAGACAGAUGAAUUA | 20 | 5207 |
| myoC-1074 | + | AAUGCCAUUGUCUAUGCUUA | 20 | 1374 |
| myoC-1172 | + | UUAUUACCACUUUGAGUUUA | 20 | 1472 |
| myoC-1066 | - | UUUGCCUGGCAUUCAAAAAC | 20 | 1366 |
| myoC-1191 | + | UUCUUCCUGUUAAAAGAAAC | 20 | 1491 |
| myoC-1063 | - | AAAAGAAUGCAGAGACUAAC | 20 | 1363 |
| myoC-1151 | - | GCAAUCCCGUUUCUUUUAAC | 20 | 1451 |
| myoC-206 | + | UGUCUCGGGUCUGGGGACAC | 20 | 592 |
| myoC-1096 | + | GCAUAAGCCAAGUCCACCAC | 20 | 1396 |
| myoC-1128 | - | GGGCAGUGGGAAUUGACCAC | 20 | 1428 |

TABLE 9E-continued

5th Tier

| gRNA Name | DNA Strand | Targeting Domain | Target Site Length | Seq ID |
|---|---|---|---|---|
| myoC-1046 | - | AGCUGGAGCAGCUGAGCCAC | 20 | 1346 |
| myoC-5462 | + | AUUGGUAAUGACAAAAUCAC | 20 | 5208 |
| myoC-1085 | + | CCCCCCUCACAGAGAAUCAC | 20 | 1385 |
| myoC-1176 | + | UUUUCCUCAUUCAAAUUCAC | 20 | 1476 |
| myoC-5463 | - | AAAAGGAGAAAUAAAAGGAC | 20 | 5209 |
| myoC-1055 | - | CAGGGGAGGUGGAGGGGGAC | 20 | 1355 |
| myoC-5464 | - | GGCUCGUAGUGACCUGCUAC | 20 | 5210 |
| myoC-201 | - | ACUGCUCGGGCUGUGCCACC | 20 | 587 |
| myoC-5465 | + | AUAUGCAGACACAUCUCACC | 20 | 5211 |
| myoC-5466 | - | AAAGGAGAAAUAAAAGGACC | 20 | 5212 |
| myoC-1216 | + | CACAAGGACAGCACCCUACC | 20 | 1516 |
| myoC-1195 | + | AGCCCUGCCUCCUAGAACCC | 20 | 1495 |
| myoC-1090 | + | AGCAGAGAAGACUAUGGCCC | 20 | 1390 |
| myoC-1180 | + | UAAAUAUUUCCAAACUGCCC | 20 | 1480 |
| myoC-1211 | - | UUCUAUAGGAAUGCUCUCCC | 20 | 1511 |
| myoC-1033 | - | GGCAAGUGUCUCUCCUUCCC | 20 | 1333 |
| myoC-107 | - | GAGGUUGGAAAGCAGCAGCC | 20 | 511 |
| myoC-1212 | - | GGAAUGCUCUCCCUGGAGCC | 20 | 1512 |
| myoC-3183 | + | UUCUUACCUUCUCUGGAGCC | 20 | 2929 |
| myoC-5467 | + | AAAGGGCAGGCAGGGAGGCC | 20 | 5213 |
| myoC-195 | - | AAGAAAAUGAGAAUCUGGCC | 20 | 581 |
| myoC-1070 | + | UGGCCCAGUUUUUGAAUGCC | 20 | 1370 |
| myoC-1158 | - | ACUCUGGAGGUGAGUCUGCC | 20 | 1458 |
| myoC-1065 | - | AACUGGUGGUAGCUUUUGCC | 20 | 1365 |
| myoC-1130 | - | GAUUAUAGUCCACGUGAUCC | 20 | 1430 |
| myoC-1060 | - | CACUGAUCACGUCAGACUCC | 20 | 1360 |
| myoC-113 | + | GCUGCUGCUUUCCAACCUCC | 20 | 515 |
| myoC-207 | + | UUCUCAGCCUUGCUACCUCC | 20 | 593 |
| myoC-5468 | - | UGACCUGCUACAGGCGCUCC | 20 | 5214 |
| myoC-1217 | + | ACAGCACCCUACCAGGCUCC | 20 | 1517 |
| myoC-1081 | + | AGCAUUGUGGCUCUCGGUCC | 20 | 1381 |
| myoC-1168 | - | UGGGUUUAUUAAUGUAAAGC | 20 | 1468 |
| myoC-1058 | - | ACAGGAAGGCAGGCAGAAGC | 20 | 1358 |
| myoC-1228 | + | UGUUAAAAACAAGAUCCAGC | 20 | 1528 |
| myoC-5469 | - | GGGGGGACUCUGAGUUCAGC | 20 | 5215 |
| myoC-1045 | - | AGAGGGGAAGGAGGCAGAGC | 20 | 1345 |
| myoC-5470 | + | AGGCCUGGAGCGCCUGUAGC | 20 | 5216 |
| myoC-1118 | - | CACGGAGUGACCUGCAGCGC | 20 | 1418 |
| myoC-1057 | - | GUGGAGGGGGACAGGAAGGC | 20 | 1357 |
| myoC-5471 | + | CUCUAGGAGAAAGGGCAGGC | 20 | 5217 |
| myoC-1134 | - | GAUCCUGGGUUCUAGGAGGC | 20 | 1434 |
| myoC-5472 | + | CAGUCUCUAGGAGAAAGGGC | 20 | 5218 |
| myoC-1205 | - | UUUGAAAUUAGACCUCCUGC | 20 | 1505 |
| myoC-1198 | + | CUUCUCCUCCCCUGCGCUGC | 20 | 1498 |
| myoC-1202 | + | UGCUGAGCUGCGUGGGGUGC | 20 | 1502 |
| myoC-1194 | + | AAAAUAUAGUAUUAGAAAUC | 20 | 1494 |
| myoC-1224 | + | AGAACCUCAUUGGUGAAAUC | 20 | 1524 |
| myoC-194 | - | AAGGCAAGAAAAUGAGAAUC | 20 | 580 |
| myoC-1026 | - | CGGUCGAAAACCUUGGAAUC | 20 | 1326 |
| myoC-1156 | - | CAAACUGUGUUUCUCCACUC | 20 | 1456 |
| myoC-200 | - | CCAGACCCGAGACACUGCUC | 20 | 586 |
| myoC-1069 | + | CUGGCAUUUUCCACUUGCUC | 20 | 1369 |
| myoC-5473 | + | GUGAAAAGUUUAACAAUCUC | 20 | 5219 |
| myoC-1222 | + | UAAUUUCAGUCUUGCAUCUC | 20 | 1522 |
| myoC-5474 | + | CUAAUCUAAAUGAAGCUCUC | 20 | 5220 |
| myoC-202 | + | CACAGCCCGAGCAGUGUCUC | 20 | 588 |
| myoC-3184 | + | CUCUGCAUUCUUACCUUCUC | 20 | 2930 |
| myoC-1144 | - | AAAUCAGUUCAAGGGAAGUC | 20 | 1444 |
| myoC-203 | + | CCCGAGCAGUGUCUCGGGUC | 20 | 589 |
| myoC-1203 | + | AGCUGCGUGGGGUGCUGGUC | 20 | 1503 |
| myoC-1061 | - | ACCGAGAGCCACAAUGCUUC | 20 | 1361 |
| myoC-1155 | - | UUUGUAAAUGUCUCAAGUUC | 20 | 1455 |
| myoC-1215 | - | AGGGUGCUGUCCUUGUGUUC | 20 | 1515 |
| myoC-1177 | + | AUUCAAAUUCACAGGCUUUC | 20 | 1477 |
| myoC-1028 | - | AGGAGACUCGGUUUUCUUUC | 20 | 1328 |
| myoC-1171 | - | AUAGAGCCAUAAACUCAAAG | 20 | 1471 |
| myoC-1068 | - | AAAAACUGGGCCAGAGCAAG | 20 | 1368 |
| myoC-1163 | - | AAGGCAAUCAUUAUUUCAAG | 20 | 1463 |
| myoC-111 | - | GAGGUAGCAAGGCUGAGAAG | 20 | 514 |
| myoC-1219 | + | GGAGAGCAUUCCUAUAGAAG | 20 | 1519 |
| myoC-1048 | - | CUGGAGCAGCUGAGCCACAG | 20 | 1348 |
| myoC-1120 | - | CGGAGUGACCUGCAGCGCAG | 20 | 1420 |
| myoC-1126 | - | ACAGAUUCAUUCAAGGGCAG | 20 | 1426 |
| myoC-1122 | - | GGGGAGGAGAAGAAAAAGAG | 20 | 1422 |

TABLE 9E-continued

| 5th Tier | | | | |
|---|---|---|---|---|
| gRNA Name | DNA Strand | Targeting Domain | Target Site Length | Seq ID |
| myoC-1181 | + | UGGCAGACUCACCUCCAGAG | 20 | 1481 |
| myoC-3185 | - | GAGAAGGUAAGAAUGCAGAG | 20 | 2931 |
| myoC-1042 | - | GUGAGGGGGGAUGUUGAGAG | 20 | 1342 |
| myoC-5475 | + | CUGUGAAAACUGACAUGGAG | 20 | 5221 |
| myoC-1053 | - | GAGCCACAGGGGAGGUGGAG | 20 | 1353 |
| myoC-2071 | - | GUUUUAAAGCUAGGGGUGAG | 20 | 2202 |
| myoC-1037 | - | UCCCUGUGAUUCUCUGUGAG | 20 | 1337 |
| myoC-1040 | - | CUGUGAGGGGGGAUGUUGAG | 20 | 1340 |
| myoC-5476 | - | CACAGUUGUUUUAAAGCUAG | 20 | 5222 |
| myoC-5477 | - | GAGAGCUUCAUUUAGAUUAG | 20 | 5223 |
| myoC-1208 | - | CAGAGUAAGAACUGAUUUAG | 20 | 1508 |
| myoC-1196 | + | UCCUAGAACCCAGGAUCACG | 20 | 1496 |
| myoC-1031 | - | AUUGGUUGGCUGUGCGACCG | 20 | 1331 |
| myoC-1199 | + | GCAGUCACUGCUGAGCUGCG | 20 | 1499 |
| myoC-1175 | + | UGUUAAAUUUAGUUAGAAGG | 20 | 1475 |
| myoC-1044 | - | GGGAUGUUGAGAGGGGAAGG | 20 | 1344 |
| myoC-108 | - | GUUGGAAAGCAGCAGCCAGG | 20 | 480 |
| myoC-196 | - | AAAAUGAGAAUCUGGCCAGG | 20 | 582 |
| myoC-1229 | + | UAAAAACAAGAUCCAGCAGG | 20 | 1529 |
| myoC-1050 | - | CAGCUGAGCCACAGGGGAGG | 20 | 1350 |
| myoC-1054 | - | AGCCACAGGGGAGGUGGAGG | 20 | 1354 |
| myoC-2072 | - | UUUUAAAGCUAGGGGUGAGG | 20 | 2203 |
| myoC-1038 | - | CCCUGUGAUUCUCUGUGAGG | 20 | 1338 |
| myoC-1133 | - | ACGUGAUCCUGGGUUCUAGG | 20 | 1433 |
| myoC-5478 | + | AGGAGAAAGGGCAGGCAGGG | 20 | 5224 |
| myoC-2073 | - | UUUAAAGCUAGGGGUGAGGG | 20 | 2204 |
| myoC-1039 | - | CCUGUGAUUCUCUGUGAGGG | 20 | 1339 |
| myoC-1049 | - | GAGCAGCUGAGCCACAGGGG | 20 | 1349 |
| myoC-1121 | - | AGUGACCUGCAGCGCAGGGG | 20 | 1421 |
| myoC-3186 | - | AGGUAAGAAUGCAGAGUGGG | 20 | 2932 |
| myoC-1140 | - | AGGCAGGGCUAUAUUGUGGG | 20 | 1440 |
| myoC-5479 | + | GACUGUGAAAACUGACAUGG | 20 | 5225 |
| myoC-1064 | - | AGAAUGCAGAGACUAACUGG | 20 | 1364 |
| myoC-3187 | + | UUACCUUCUCUGGAGCCUGG | 20 | 2933 |
| myoC-1157 | - | ACUGUGUUUCUCCACUCUGG | 20 | 1457 |
| myoC-3188 | - | AAGGUAAGAAUGCAGAGUGG | 20 | 2934 |
| myoC-1051 | - | CUGAGCCACAGGGGAGGUGG | 20 | 1351 |

TABLE 9E-continued

| 5th Tier | | | | |
|---|---|---|---|---|
| gRNA Name | DNA Strand | Targeting Domain | Target Site Length | Seq ID |
| myoC-1022 | - | GCAACUACUCAGCCCUGUGG | 20 | 1322 |
| myoC-1139 | - | GAGGCAGGGCUAUAUUGUGG | 20 | 1439 |
| myoC-1076 | + | AUGCUUAGGGAAGGAAAAUG | 20 | 1376 |
| myoC-1206 | - | UUCCCCAGAUUUCACCAAUG | 20 | 1506 |
| myoC-1170 | - | AAAGCCUGUGAAUUUGAAUG | 20 | 1470 |
| myoC-1146 | - | AAGUCACAAGGUAGUAACUG | 20 | 1446 |
| myoC-1084 | + | GUCCCCCUCCACCUCCCCUG | 20 | 1384 |
| myoC-1021 | - | UGGGCAACUACUCAGCCCUG | 20 | 1321 |
| myoC-1197 | + | CACGUGGACUAUAAUCCCUG | 20 | 1497 |
| myoC-1226 | + | AACCUCAUUGGUGAAAUCUG | 20 | 1526 |
| myoC-1148 | - | UUAGGAACUCUUUUUCUCUG | 20 | 1448 |
| myoC-205 | + | CGAGCAGUGUCUCGGGUCUG | 20 | 591 |
| myoC-1082 | + | GGAGUCUGACGUGAUCAGUG | 20 | 1382 |
| myoC-3189 | - | GAAGGUAAGAAUGCAGAGUG | 20 | 2935 |
| myoC-1201 | + | AGUCACUGCUGAGCUGCGUG | 20 | 1501 |
| myoC-2069 | - | UUGUUUUAAAGCUAGGGGUG | 20 | 2200 |
| myoC-1035 | - | CUUCCCUGUGAUUCUCUGUG | 20 | 1335 |
| myoC-1138 | - | GGAGGCAGGGCUAUAUUGUG | 20 | 1438 |
| myoC-1079 | + | UGAGCUUUCCUGAAGCAUUG | 20 | 1379 |
| myoC-1136 | - | UAGGAGGCAGGGCUAUAUUG | 20 | 1436 |
| myoC-1184 | + | AACUUGAGACAUUUACAAAU | 20 | 1484 |
| myoC-1209 | - | UUAGAGGCUAACAUUGACAU | 20 | 1509 |
| myoC-1029 | - | UUUCUUUCUGGUUCUGCCAU | 20 | 1329 |
| myoC-1223 | + | GUGCAUGCCAAGAACCUCAU | 20 | 1523 |
| myoC-1153 | - | GGUCUUGCUGACUAUAUGAU | 20 | 1453 |
| myoC-1182 | + | AGAUUCUAUUCUUAUUUGAU | 20 | 1482 |
| myoC-1210 | - | GGGAAAUCUGCCGCUUCUAU | 20 | 1510 |
| myoC-1230 | + | AAAAUGUCUGUGAUUUCUAU | 20 | 1530 |
| myoC-1072 | + | UCUGCAUUCUUUUUGGUUAU | 20 | 1372 |
| myoC-1165 | - | GACAGUUUUGGUAUAUUUAU | 20 | 1465 |
| myoC-1067 | - | UUGCCUGGCAUUCAAAAACU | 20 | 1367 |
| myoC-1027 | - | AACCUUGGAAUCAGGAGACU | 20 | 1327 |
| myoC-1023 | - | ACUCAGCCCUGUGGUGGACU | 20 | 1323 |
| myoC-1025 | - | UGCAAGACGGUCGAAAACCU | 20 | 1325 |
| myoC-1187 | + | UCAUAUAGUCAGCAAGACCU | 20 | 1487 |
| myoC-1034 | - | GCAAGUGUCUCUCCUUCCCU | 20 | 1334 |
| myoC-1152 | - | AGCCAAACAGAUUCAAGCCU | 20 | 1452 |

TABLE 9E-continued

| 5th Tier | | | | |
|---|---|---|---|---|
| gRNA Name | DNA Strand | Targeting Domain | Target Site Length | Seq ID |
| myoC-1131 | - | AUUAUAGUCCACGUGAUCCU | 20 | 1431 |
| myoC-2066 | - | UACACAGUUGUUUUAAAGCU | 20 | 2197 |
| myoC-1059 | - | CAGGAAGGCAGGCAGAAGCU | 20 | 1359 |
| myoC-199 | - | CCCAGACCCGAGACACUGCU | 20 | 585 |
| myoC-1225 | + | GAACCUCAUUGGUGAAAUCU | 20 | 1525 |
| myoC-1080 | + | UCCUGAAGCAUUGUGGCUCU | 20 | 1380 |
| myoC-5480 | + | GUGCUAGCUGUGCAGUCUCU | 20 | 5226 |
| myoC-204 | + | CCGAGCAGUGUCUCGGGUCU | 20 | 590 |
| myoC-112 | + | GCACAGCCCGAGCAGUGUCU | 20 | 481 |
| myoC-1207 | - | GAUUUCACCAAUGAGGUUCU | 20 | 1507 |
| myoC-1132 | - | UCCACGUGAUCCUGGGUUCU | 20 | 1432 |
| myoC-1143 | - | AAAAUCAGUUCAAGGGAAGU | 20 | 1443 |
| myoC-1127 | - | CAGAUUCAUUCAAGGGCAGU | 20 | 1427 |
| myoC-3191 | - | AGAAGGUAAGAAUGCAGAGU | 20 | 2937 |
| myoC-1032 | - | UUGGUUGGCUGUGCGACCGU | 20 | 1332 |
| myoC-1200 | + | CAGUCACUGCUGAGCUGCGU | 20 | 1500 |
| myoC-197 | - | UGAGAAUCUGGCCAGGAGGU | 20 | 583 |
| myoC-1213 | - | UGCUCUCCCUGGAGCCUGGU | 20 | 1513 |
| myoC-1030 | - | UUUCUGGUUCUGCCAUUGGU | 20 | 1330 |
| myoC-1178 | + | UCACAGGCUUUCUGGACUGU | 20 | 1478 |
| myoC-1077 | + | GGGAAGGAAAAUGUGGCUGU | 20 | 1377 |
| myoC-1137 | - | AGGAGGCAGGGCUAUAUUGU | 20 | 1437 |
| myoC-1161 | - | ACAAGUAUUGACACUGUUGU | 20 | 1461 |

TABLE 9E-continued

| 5th Tier | | | | |
|---|---|---|---|---|
| gRNA Name | DNA Strand | Targeting Domain | Target Site Length | Seq ID |
| myoC-1147 | - | UUACUUAGUUUCUCCUUAUU | 20 | 1447 |
| myoC-1154 | - | AAAAUGAGACUAGUACCCUU | 20 | 1454 |
| myoC-1073 | + | AAAUGCCAUUGUCUAUGCUU | 20 | 1373 |
| myoC-1220 | + | UUAAAACAACUGUGUAUCUU | 20 | 1520 |
| myoC-1189 | + | AUCUGUUUGGCUUUACUCUU | 20 | 1489 |
| myoC-1166 | - | UGCUUUUUGUUUUUUCUCUU | 20 | 1466 |
| myoC-1160 | - | GUGAGUCUGCCAGGGCAGUU | 20 | 1460 |
| myoC-1078 | + | GGAAGGAAAAUGUGGCUGUU | 20 | 1378 |
| myoC-1188 | + | GACCUAGGCUUGAAUCUGUU | 20 | 1488 |
| myoC-1221 | + | UAAAACAACUGUGUAUCUUU | 20 | 1521 |
| myoC-1167 | - | GCUUUUUGUUUUUUCUCUUU | 20 | 1467 |
| myoC-1164 | - | AAAGUUACUUCUGACAGUUU | 20 | 1464 |
| myoC-1071 | + | GUUAGUCUCUGCAUUCUUUU | 20 | 1371 |

Table 10A provides exemplary targeting domains for knocking down the MYOC gene selected according to the first tier parameters. The targeting domains bind within 3454-2454 bp upstream of transcription start site or 500 bp upstream and downstream of transcription start site, have a high level of orthogonality, start with a 5'G, and PAM is NNGRRT. It is contemplated herein that in an embodiment the targeting domain hybridizes to the target domain through complementary base pairing. Any of the targeting domains in the table can be used with a *S. aureus* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 10A

| 1st Tier | | | | |
|---|---|---|---|---|
| gRNA Name | DNA Strand | Targeting Domain | Target Site Length | Seq ID |
| myoC-5481 | + | GAAAGCAACAGGUCCCUA | 18 | 5227 |
| myoC-5482 | + | GAAAUAGAAAGCAACAGGUCCCUA | 24 | 5228 |
| myoC-5483 | + | GCUAGGGAGGUGGCCUUGUUA | 21 | 5229 |
| myoC-5484 | + | GCGCUAGGGAGGUGGCCUUGUUA | 23 | 5230 |
| myoC-5485 | + | GGCGCUAGGGAGGUGGCCUUGUUA | 24 | 5231 |
| myoC-5486 | + | GACUACUGGUGUGCUGAUUUCAAC | 24 | 5232 |
| myoC-5487 | + | GUUGCUCAGGACACCCAGGACC | 22 | 5233 |
| myoC-5488 | + | GGUUGCUCAGGACACCCAGGACC | 23 | 5234 |
| myoC-5489 | + | GAAAACCCAUGCACACCC | 18 | 5235 |

TABLE 10A-continued

| 1st Tier | | | | |
|---|---|---|---|---|
| gRNA Name | DNA Strand | Targeting Domain | Target Site Length | Seq ID |
| myoC-5490 | + | GGAAAACCCAUGCACACCC | 19 | 5236 |
| myoC-5491 | + | GAAGGAAAACCCAUGCACACCC | 22 | 5237 |
| myoC-5492 | + | GUGAAGGAAAACCCAUGCACACCC | 24 | 5238 |
| myoC-5493 | + | GACUCCAGUCACUUCUUCC | 19 | 5239 |
| myoC-5494 | + | GAAAAGACUCCAGUCACUUCUUCC | 24 | 5240 |
| myoC-5495 | + | GCUCUGCUGUGCUGAGAGGUGC | 22 | 5241 |
| myoC-3195 | + | GGCCUCCAGGUCUAAGCG | 18 | 2941 |
| myoC-1677 | + | GUGGCCUCCAGGUCUAAGCG | 20 | 1938 |
| myoC-3196 | + | GGUGGCCUCCAGGUCUAAGCG | 21 | 2942 |
| myoC-5496 | + | GACAGAGGUGGCCACGUGAGG | 21 | 5242 |
| myoC-5497 | + | GAAGACAGAGGUGGCCACGUGAGG | 24 | 5243 |
| myoC-5498 | + | GUGCUGAGAGGUGCCUGG | 18 | 5244 |
| myoC-5499 | + | GCUGUGCUGAGAGGUGCCUGG | 21 | 5245 |
| myoC-3197 | + | GCUGGUCCCGCUCCCGCCU | 19 | 2943 |
| myoC-3198 | + | GGCAGUCUCCAACUCUCUGGU | 21 | 2944 |
| myoC-3199 | + | GUAGGCAGUCUCCAACUCUCUGGU | 24 | 2945 |
| myoC-3200 | + | GCUGUCUCUCUGUAAGUU | 18 | 2946 |
| myoC-3201 | + | GCUGCUGUCUCUCUGUAAGUU | 21 | 2947 |
| myoC-3202 | + | GUGCUGCUGUCUCUCUGUAAGUU | 23 | 2948 |
| myoC-3203 | + | GGUGCUGCUGUCUCUCUGUAAGUU | 24 | 2949 |
| myoC-3204 | - | GACCAGCUGGAAACCCAAACCA | 22 | 2950 |
| myoC-3205 | - | GGACCAGCUGGAAACCCAAACCA | 23 | 2951 |
| myoC-3206 | - | GGGACCAGCUGGAAACCCAAACCA | 24 | 2952 |
| myoC-2083 | - | GUUCUCAAUGAGUUUGCAGA | 20 | 2212 |
| myoC-5500 | - | GGUUCUCAAUGAGUUUGCAGA | 21 | 5246 |
| myoC-5501 | - | GCAGGUUCUCAAUGAGUUUGCAGA | 24 | 5247 |
| myoC-5502 | - | GAAGAAGUCUAUUUCAUGA | 19 | 5248 |
| myoC-5503 | - | GAGAAGAAGUCUAUUUCAUGA | 21 | 5249 |
| myoC-5504 | - | GGAGAAGAAGUCUAUUUCAUGA | 22 | 5250 |
| myoC-5505 | - | GAGGAGAAGAAGUCUAUUUCAUGA | 24 | 5251 |
| myoC-5506 | - | GUGGGGACGCUGGGGCUGA | 19 | 5252 |
| myoC-5507 | - | GAGUGGGGACGCUGGGGCUGA | 21 | 5253 |
| myoC-5508 | - | GGAGUGGGGACGCUGGGGCUGA | 22 | 5254 |
| myoC-5509 | - | GGGAGUGGGGACGCUGGGGCUGA | 23 | 5255 |
| myoC-5510 | - | GCAUUCAUUGACAAUUUA | 18 | 5256 |
| myoC-5511 | - | GGCAUUCAUUGACAAUUUA | 19 | 5257 |
| myoC-3207 | - | GCUCAGGAAGGCCAAUGAC | 19 | 2953 |
| myoC-3208 | - | GCUCAGCUCAGGAAGGCCAAUGAC | 24 | 2954 |

TABLE 10A-continued

| gRNA Name | DNA Strand | Targeting Domain | Target Site Length | Seq ID |
|---|---|---|---|---|
| 1st Tier | | | | |
| myoC-5512 | - | GUUAAUUCACGGAAGAAGUGAC | 22 | 5258 |
| myoC-5513 | - | GGGAGCCCUGCAAGCACC | 18 | 5259 |
| myoC-5514 | - | GGGGAGCCCUGCAAGCACC | 19 | 5260 |
| myoC-680 | - | GGGGGAGCCCUGCAAGCACC | 20 | 1020 |
| myoC-5515 | - | GCUGGGGGAGCCCUGCAAGCACC | 23 | 5261 |
| myoC-1841 | - | GCUGGCCUGCCUCGCUUCCC | 20 | 2051 |
| myoC-5516 | - | GCAGCUGGCCUGCCUCGCUUCCC | 23 | 5262 |
| myoC-5517 | - | GCCCGGAGGCCCCCAAGC | 18 | 5263 |
| myoC-1840 | - | GUGCCCGGAGGCCCCCAAGC | 20 | 2050 |
| myoC-1908 | - | GUUAAAAUUCCAGGGUGUGC | 20 | 2091 |
| myoC-5518 | - | GCUGUUAAAAUUCCAGGGUGUGC | 23 | 5264 |
| myoC-5519 | - | GCCCUGCAAGCACCCGGGGUC | 21 | 5265 |
| myoC-5520 | - | GAGCCCUGCAAGCACCCGGGGUC | 23 | 5266 |
| myoC-5521 | - | GGAGCCCUGCAAGCACCCGGGGUC | 24 | 5267 |
| myoC-5522 | - | GAAAGGGGCCUCCACGUCCAG | 21 | 5268 |
| myoC-5523 | - | GGAAAGGGGCCUCCACGUCCAG | 22 | 5269 |
| myoC-5524 | - | GGGAAAGGGGCCUCCACGUCCAG | 23 | 5270 |
| myoC-5525 | - | GAGGGAAACUAGUCUAACG | 19 | 5271 |
| myoC-5526 | - | GAGAGGGAAACUAGUCUAACG | 21 | 5272 |
| myoC-5527 | - | GGAGAGGGAAACUAGUCUAACG | 22 | 5273 |
| myoC-3209 | - | GCUUCUGGCCUGCCUGGUG | 19 | 2955 |
| myoC-5528 | - | GAAAUAAACACCAUCUUG | 18 | 5274 |
| myoC-5529 | - | GGAAAUAAACACCAUCUUG | 19 | 5275 |
| myoC-5530 | - | GAAAGGAAAUAAACACCAUCUUG | 23 | 5276 |
| myoC-2082 | - | GCAGGUUCUCAAUGAGUUUG | 20 | 2211 |
| myoC-5531 | - | GUGCAGGUUCUCAAUGAGUUUG | 22 | 5277 |
| myoC-3210 | - | GCGACUAAGGCAAGAAAAU | 19 | 2956 |
| myoC-3211 | - | GAAGCGACUAAGGCAAGAAAAU | 22 | 2957 |
| myoC-5532 | - | GGGUAUGGGUGCAUAAAU | 18 | 5278 |
| myoC-5533 | - | GGGGUAUGGGUGCAUAAAU | 19 | 5279 |
| myoC-5534 | - | GAGAUAUAGGAACUAUUAU | 19 | 5280 |
| myoC-838 | - | GGAGAUAUAGGAACUAUUAU | 20 | 991 |
| myoC-5535 | - | GUGGAGAUAUAGGAACUAUUAU | 22 | 5281 |
| myoC-5536 | - | GGUGGAGAUAUAGGAACUAUUAU | 23 | 5282 |
| myoC-5537 | - | GUUCAGUGUUGUUCACGGGGCU | 22 | 5283 |
| myoC-5538 | - | GACUUCUGGAAGGUUAUUUUCU | 22 | 5284 |

TABLE 10A-continued

| 1st Tier | | | | |
|---|---|---|---|---|
| gRNA Name | DNA Strand | Targeting Domain | Target Site Length | Seq ID |
| myoC-5539 | - | GAUAUAGGAACUAUUAUUGGGGU | 23 | 5285 |
| myoC-5540 | - | GCUACGUCUUAAAGGACUUGU | 21 | 5286 |

Table 10B provides exemplary targeting domains for knocking down the MYOC gene selected according to the second tier parameters. The targeting domains bind within 3454-2454 bp upstream of transcription start site or 500 bp upstream and downstream of transcription start site, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 10B

| 2nd Tier | | | | |
|---|---|---|---|---|
| gRNA Name | DNA Strand | Targeting Domain | Target Site Length | Seq ID |
| myoC-5541 | + | UUCUGGAGCCUGGAGCCA | 18 | 5287 |
| myoC-5542 | + | UUUCUGGAGCCUGGAGCCA | 19 | 5288 |
| myoC-1115 | + | CUUUCUGGAGCCUGGAGCCA | 20 | 1415 |
| myoC-5543 | + | CCUUUCUGGAGCCUGGAGCCA | 21 | 5289 |
| myoC-5544 | + | UCCUUUCUGGAGCCUGGAGCCA | 22 | 5290 |
| myoC-5545 | + | UUCCUUUCUGGAGCCUGGAGCCA | 23 | 5291 |
| myoC-5546 | + | UUUCCUUUCUGGAGCCUGGAGCCA | 24 | 5292 |
| myoC-5547 | + | AGAAAGCAACAGGUCCCUA | 19 | 5293 |
| myoC-2125 | + | UAGAAAGCAACAGGUCCCUA | 20 | 2243 |
| myoC-5548 | + | AUAGAAAGCAACAGGUCCCUA | 21 | 5294 |
| myoC-5549 | + | AAUAGAAAGCAACAGGUCCCUA | 22 | 5295 |
| myoC-5550 | + | AAAUAGAAAGCAACAGGUCCCUA | 23 | 5296 |
| myoC-5551 | + | AGGGAGGUGGCCUUGUUA | 18 | 5297 |
| myoC-5552 | + | UAGGGAGGUGGCCUUGUUA | 19 | 5298 |
| myoC-721 | + | CUAGGGAGGUGGCCUUGUUA | 20 | 1106 |
| myoC-5553 | + | CGCUAGGGAGGUGGCCUUGUUA | 22 | 5299 |
| myoC-5554 | + | UACUGGUGUGCUGAUUUCAAC | 21 | 5300 |
| myoC-5555 | + | CUACUGGUGUGCUGAUUUCAAC | 22 | 5301 |
| myoC-5556 | + | ACUACUGGUGUGCUGAUUUCAAC | 23 | 5302 |
| myoC-5557 | + | UUGCUCAGGACACCCAGGACC | 21 | 5303 |
| myoC-5558 | + | AGGUUGCUCAGGACACCCAGGACC | 24 | 5304 |
| myoC-1102 | + | AGGAAAACCCAUGCACACCC | 20 | 1402 |
| myoC-5559 | + | AAGGAAAACCCAUGCACACCC | 21 | 5305 |
| myoC-5560 | + | UGAAGGAAAACCCAUGCACACCC | 23 | 5306 |
| myoC-5561 | + | ACUCCAGUCACUUCUUCC | 18 | 5307 |
| myoC-2200 | + | AGACUCCAGUCACUUCUUCC | 20 | 2295 |

TABLE 10B-continued

| 2nd Tier | | | | |
|---|---|---|---|---|
| gRNA Name | DNA Strand | Targeting Domain | Target Site Length | Seq ID |
| myoC-5562 | + | AAGACUCCAGUCACUUCUUCC | 21 | 5308 |
| myoC-5563 | + | AAAGACUCCAGUCACUUCUUCC | 22 | 5309 |
| myoC-5564 | + | AAAAGACUCCAGUCACUUCUUCC | 23 | 5310 |
| myoC-5565 | + | UGCUGUGCUGAGAGGUGC | 18 | 5311 |
| myoC-5566 | + | CUGCUGUGCUGAGAGGUGC | 19 | 5312 |
| myoC-2353 | + | UCUGCUGUGCUGAGAGGUGC | 20 | 2407 |
| myoC-5567 | + | CUCUGCUGUGCUGAGAGGUGC | 21 | 5313 |
| myoC-5568 | + | AGCUCUGCUGUGCUGAGAGGUGC | 23 | 5314 |
| myoC-5569 | + | AAGCUCUGCUGUGCUGAGAGGUGC | 24 | 5315 |
| myoC-3212 | + | UGGCCUCCAGGUCUAAGCG | 19 | 2958 |
| myoC-3213 | + | UGGUGGCCUCCAGGUCUAAGCG | 22 | 2959 |
| myoC-3214 | + | UUGGUGGCCUCCAGGUCUAAGCG | 23 | 2960 |
| myoC-3215 | + | UUUGGUGGCCUCCAGGUCUAAGCG | 24 | 2961 |
| myoC-5570 | + | AGAGGUGGCCACGUGAGG | 18 | 5316 |
| myoC-5571 | + | CAGAGGUGGCCACGUGAGG | 19 | 5317 |
| myoC-2337 | + | ACAGAGGUGGCCACGUGAGG | 20 | 2398 |
| myoC-5572 | + | AGACAGAGGUGGCCACGUGAGG | 22 | 5318 |
| myoC-5573 | + | AAGACAGAGGUGGCCACGUGAGG | 23 | 5319 |
| myoC-5574 | + | UUGUCAAUGAAUGCCUGG | 18 | 5320 |
| myoC-5575 | + | AUUGUCAAUGAAUGCCUGG | 19 | 5321 |
| myoC-2131 | + | AAUUGUCAAUGAAUGCCUGG | 20 | 2249 |
| myoC-5576 | + | AAAUUGUCAAUGAAUGCCUGG | 21 | 5322 |
| myoC-5577 | + | UAAAUUGUCAAUGAAUGCCUGG | 22 | 5323 |
| myoC-5578 | + | AUAAAUUGUCAAUGAAUGCCUGG | 23 | 5324 |
| myoC-5579 | + | AAUAAAUUGUCAAUGAAUGCCUGG | 24 | 5325 |
| myoC-5580 | + | UGUGCUGAGAGGUGCCUGG | 19 | 5326 |
| myoC-2352 | + | CUGUGCUGAGAGGUGCCUGG | 20 | 2406 |
| myoC-5581 | + | UGCUGUGCUGAGAGGUGCCUGG | 22 | 5327 |
| myoC-5582 | + | CUGCUGUGCUGAGAGGUGCCUGG | 23 | 5328 |
| myoC-5583 | + | UCUGCUGUGCUGAGAGGUGCCUGG | 24 | 5329 |
| myoC-3216 | + | CUGGUCCCGCUCCCGCCU | 18 | 2962 |
| myoC-1690 | + | AGCUGGUCCCGCUCCCGCCU | 20 | 1946 |
| myoC-3217 | + | CAGCUGGUCCCGCUCCCGCCU | 21 | 2963 |
| myoC-3218 | + | CCAGCUGGUCCCGCUCCCGCCU | 22 | 2964 |
| myoC-3219 | + | UCCAGCUGGUCCCGCUCCCGCCU | 23 | 2965 |
| myoC-3220 | + | UUCCAGCUGGUCCCGCUCCCGCCU | 24 | 2966 |
| myoC-3221 | + | AGGCAGUCUCCAACUCUCUGGU | 22 | 2967 |

TABLE 10B-continued

| 2nd Tier | | | | |
|---|---|---|---|---|
| gRNA Name | DNA Strand | Targeting Domain | Target Site Length | Seq ID |
| myoC-3222 | + | UAGGCAGUCUCCAACUCUCUGGU | 23 | 2968 |
| myoC-3223 | + | UGCUGUCUCUCUGUAAGUU | 19 | 2969 |
| myoC-1676 | + | CUGCUGUCUCUCUGUAAGUU | 20 | 1937 |
| myoC-3224 | + | UGCUGCUGUCUCUCUGUAAGUU | 22 | 2970 |
| myoC-5584 | + | ACCUUCCAGAAGUCUGUU | 18 | 5330 |
| myoC-5585 | + | AACCUUCCAGAAGUCUGUU | 19 | 5331 |
| myoC-885 | + | UAACCUUCCAGAAGUCUGUU | 20 | 1208 |
| myoC-5586 | + | AUAACCUUCCAGAAGUCUGUU | 21 | 5332 |
| myoC-5587 | + | AAUAACCUUCCAGAAGUCUGUU | 22 | 5333 |
| myoC-5588 | + | AAAUAACCUUCCAGAAGUCUGUU | 23 | 5334 |
| myoC-5589 | + | AAAAUAACCUUCCAGAAGUCUGUU | 24 | 5335 |
| myoC-3225 | - | AGCUGGAAACCCAAACCA | 18 | 2971 |
| myoC-3226 | - | CAGCUGGAAACCCAAACCA | 19 | 2972 |
| myoC-1635 | - | CCAGCUGGAAACCCAAACCA | 20 | 1904 |
| myoC-3227 | - | ACCAGCUGGAAACCCAAACCA | 21 | 2973 |
| myoC-3228 | - | UCAGUGUGGCCAGUCCCA | 18 | 2974 |
| myoC-3229 | - | UUCAGUGUGGCCAGUCCCA | 19 | 2975 |
| myoC-1604 | - | CUUCAGUGUGGCCAGUCCCA | 20 | 1884 |
| myoC-3230 | - | CCUUCAGUGUGGCCAGUCCCA | 21 | 2976 |
| myoC-3231 | - | ACCUUCAGUGUGGCCAGUCCCA | 22 | 2977 |
| myoC-3232 | - | UACCUUCAGUGUGGCCAGUCCCA | 23 | 2978 |
| myoC-3233 | - | AUACCUUCAGUGUGGCCAGUCCCA | 24 | 2979 |
| myoC-5590 | - | UCUCAAUGAGUUUGCAGA | 18 | 5336 |
| myoC-5591 | - | UUCUCAAUGAGUUUGCAGA | 19 | 5337 |
| myoC-5592 | - | AGGUUCUCAAUGAGUUUGCAGA | 22 | 5338 |
| myoC-5593 | - | CAGGUUCUCAAUGAGUUUGCAGA | 23 | 5339 |
| myoC-5594 | - | AAGAAGUCUAUUUCAUGA | 18 | 5340 |
| myoC-1006 | - | AGAAGAAGUCUAUUUCAUGA | 20 | 1306 |
| myoC-5595 | - | AGGAGAAGAAGUCUAUUUCAUGA | 23 | 5341 |
| myoC-5596 | - | UGGGGACGCUGGGGCUGA | 18 | 5342 |
| myoC-1885 | - | AGUGGGGACGCUGGGGCUGA | 20 | 2075 |
| myoC-5597 | - | AGGGAGUGGGGACGCUGGGGCUGA | 24 | 5343 |
| myoC-1823 | - | AGGCAUUCAUUGACAAUUUA | 20 | 2037 |
| myoC-3234 | - | CUCAGGAAGGCCAAUGAC | 18 | 2980 |
| myoC-1603 | - | AGCUCAGGAAGGCCAAUGAC | 20 | 1883 |
| myoC-3235 | - | CAGCUCAGGAAGGCCAAUGAC | 21 | 2981 |
| myoC-3236 | - | UCAGCUCAGGAAGGCCAAUGAC | 22 | 2982 |
| myoC-3237 | - | CUCAGCUCAGGAAGGCCAAUGAC | 23 | 2983 |

TABLE 10B-continued

| 2nd Tier | | | | |
|---|---|---|---|---|
| gRNA Name | DNA Strand | Targeting Domain | Target Site Length | Seq ID |
| myoC-5598 | - | AUUCACGGAAGAAGUGAC | 18 | 5344 |
| myoC-5599 | - | AAUUCACGGAAGAAGUGAC | 19 | 5345 |
| myoC-1018 | - | UAAUUCACGGAAGAAGUGAC | 20 | 1318 |
| myoC-5600 | - | UUAAUUCACGGAAGAAGUGAC | 21 | 5346 |
| myoC-5601 | - | CGUUAAUUCACGGAAGAAGUGAC | 23 | 5347 |
| myoC-5602 | - | CCGUUAAUUCACGGAAGAAGUGAC | 24 | 5348 |
| myoC-5603 | - | UGGGGGAGCCCUGCAAGCACC | 21 | 5349 |
| myoC-5604 | - | CUGGGGGAGCCCUGCAAGCACC | 22 | 5350 |
| myoC-5605 | - | AGCUGGGGGAGCCCUGCAAGCACC | 24 | 5351 |
| myoC-5606 | - | UGGCCUGCCUCGCUUCCC | 18 | 5352 |
| myoC-5607 | - | CUGGCCUGCCUCGCUUCCC | 19 | 5353 |
| myoC-5608 | - | AGCUGGCCUGCCUCGCUUCCC | 21 | 5354 |
| myoC-5609 | - | CAGCUGGCCUGCCUCGCUUCCC | 22 | 5355 |
| myoC-5610 | - | UGCAGCUGGCCUGCCUCGCUUCCC | 24 | 5356 |
| myoC-5611 | - | UGCCCGGAGGCCCCCAAGC | 19 | 5357 |
| myoC-5612 | - | CGUGCCCGGAGGCCCCCAAGC | 21 | 5358 |
| myoC-5613 | - | UCGUGCCCGGAGGCCCCCAAGC | 22 | 5359 |
| myoC-5614 | - | AUCGUGCCCGGAGGCCCCCAAGC | 23 | 5360 |
| myoC-5615 | - | CAUCGUGCCCGGAGGCCCCCAAGC | 24 | 5361 |
| myoC-5616 | - | UAAAAUUCCAGGGUGUGC | 18 | 5362 |
| myoC-5617 | - | UUAAAAUUCCAGGGUGUGC | 19 | 5363 |
| myoC-5618 | - | UGUUAAAAUUCCAGGGUGUGC | 21 | 5364 |
| myoC-5619 | - | CUGUUAAAAUUCCAGGGUGUGC | 22 | 5365 |
| myoC-5620 | - | AGCUGUUAAAAUUCCAGGGUGUGC | 24 | 5366 |
| myoC-5621 | - | CUGCAAGCACCCGGGGUC | 18 | 5367 |
| myoC-5622 | - | CCUGCAAGCACCCGGGGUC | 19 | 5368 |
| myoC-1819 | - | CCCUGCAAGCACCCGGGGUC | 20 | 2034 |
| myoC-5623 | - | AGCCCUGCAAGCACCCGGGGUC | 22 | 5369 |
| myoC-5624 | - | UAAAGUCAGCUGUUAAAAUUC | 21 | 5370 |
| myoC-5625 | - | AUAAAGUCAGCUGUUAAAAUUC | 22 | 5371 |
| myoC-5626 | - | CAUAAAGUCAGCUGUUAAAAUUC | 23 | 5372 |
| myoC-5627 | - | UCAUAAAGUCAGCUGUUAAAAUUC | 24 | 5373 |
| myoC-5628 | - | AGGGGCCUCCACGUCCAG | 18 | 5374 |
| myoC-5629 | - | AAGGGGCCUCCACGUCCAG | 19 | 5375 |
| myoC-1870 | - | AAAGGGGCCUCCACGUCCAG | 20 | 2068 |
| myoC-5630 | - | AGGGAAAGGGGCCUCCACGUCCAG | 24 | 5376 |
| myoC-5631 | - | AGGGAAACUAGUCUAACG | 18 | 5377 |

TABLE 10B-continued

| 2nd Tier | | | | |
|---|---|---|---|---|
| gRNA Name | DNA Strand | Targeting Domain | Target Site Length | Seq ID |
| myoC-1856 | - | AGAGGGAAACUAGUCUAACG | 20 | 2061 |
| myoC-5632 | - | UGGAGAGGGAAACUAGUCUAACG | 23 | 5378 |
| myoC-5633 | - | AUGGAGAGGGAAACUAGUCUAACG | 24 | 5379 |
| myoC-3238 | - | CUUCUGGCCUGCCUGGUG | 18 | 2984 |
| myoC-171 | - | UGCUUCUGGCCUGCCUGGUG | 20 | 557 |
| myoC-1837 | - | AGGAAAUAAACACCAUCUUG | 20 | 2048 |
| myoC-5634 | - | AAGGAAAUAAACACCAUCUUG | 21 | 5380 |
| myoC-5635 | - | AAAGGAAAUAAACACCAUCUUG | 22 | 5381 |
| myoC-5636 | - | AGAAAGGAAAUAAACACCAUCUUG | 24 | 5382 |
| myoC-5637 | - | AGGUUCUCAAUGAGUUUG | 18 | 5383 |
| myoC-5638 | - | CAGGUUCUCAAUGAGUUUG | 19 | 5384 |
| myoC-5639 | - | UGCAGGUUCUCAAUGAGUUUG | 21 | 5385 |
| myoC-5640 | - | AGUGCAGGUUCUCAAUGAGUUUG | 23 | 5386 |
| myoC-5641 | - | CAGUGCAGGUUCUCAAUGAGUUUG | 24 | 5387 |
| myoC-3239 | - | CGACUAAGGCAAGAAAAU | 18 | 2985 |
| myoC-1648 | - | AGCGACUAAGGCAAGAAAAU | 20 | 1914 |
| myoC-3240 | - | AAGCGACUAAGGCAAGAAAAU | 21 | 2986 |
| myoC-3241 | - | AGAAGCGACUAAGGCAAGAAAAU | 23 | 2987 |
| myoC-3242 | - | AAGAAGCGACUAAGGCAAGAAAAU | 24 | 2988 |
| myoC-843 | - | UGGGGUAUGGGUGCAUAAAU | 20 | 1214 |
| myoC-5642 | - | CGAAGGCCUUUAUUUAAU | 18 | 5388 |
| myoC-5643 | - | ACGAAGGCCUUUAUUUAAU | 19 | 5389 |
| myoC-1014 | - | CACGAAGGCCUUUAUUUAAU | 20 | 1314 |
| myoC-5644 | - | UCACGAAGGCCUUUAUUUAAU | 21 | 5390 |
| myoC-5645 | - | UUCACGAAGGCCUUUAUUUAAU | 22 | 5391 |
| myoC-5646 | - | CUUCACGAAGGCCUUUAUUUAAU | 23 | 5392 |
| myoC-5647 | - | CCUUCACGAAGGCCUUUAUUUAAU | 24 | 5393 |
| myoC-5648 | - | AGAUAUAGGAACUAUUAU | 18 | 5394 |
| myoC-5649 | - | UGGAGAUAUAGGAACUAUUAU | 21 | 5395 |
| myoC-5650 | - | AGGUGGAGAUAUAGGAACUAUUAU | 24 | 5396 |
| myoC-5651 | - | AGUGUUGUUCACGGGGCU | 18 | 5397 |
| myoC-5652 | - | CAGUGUUGUUCACGGGGCU | 19 | 5398 |
| myoC-1003 | - | UCAGUGUUGUUCACGGGGCU | 20 | 1303 |
| myoC-5653 | - | UUCAGUGUUGUUCACGGGGCU | 21 | 5399 |
| myoC-5654 | - | UGUUCAGUGUUGUUCACGGGGCU | 23 | 5400 |
| myoC-5655 | - | AUGUUCAGUGUUGUUCACGGGGCU | 24 | 5401 |
| myoC-5656 | - | UCUGGAAGGUUAUUUUCU | 18 | 5402 |
| myoC-5657 | - | UUCUGGAAGGUUAUUUUCU | 19 | 5403 |

TABLE 10B-continued

| 2nd Tier | | | | |
|---|---|---|---|---|
| gRNA Name | DNA Strand | Targeting Domain | Target Site Length | Seq ID |
| myoC-2100 | - | CUUCUGGAAGGUUAUUUUCU | 20 | 2223 |
| myoC-5658 | - | ACUUCUGGAAGGUUAUUUUCU | 21 | 5404 |
| myoC-5659 | - | AGACUUCUGGAAGGUUAUUUUCU | 23 | 5405 |
| myoC-5660 | - | CAGACUUCUGGAAGGUUAUUUUCU | 24 | 5406 |
| myoC-5661 | - | AGGAACUAUUAUUGGGGU | 18 | 5407 |
| myoC-5662 | - | UAGGAACUAUUAUUGGGGU | 19 | 5408 |
| myoC-2094 | - | AUAGGAACUAUUAUUGGGGU | 20 | 2219 |
| myoC-5663 | - | UAUAGGAACUAUUAUUGGGGU | 21 | 5409 |
| myoC-5664 | - | AUAUAGGAACUAUUAUUGGGGU | 22 | 5410 |
| myoC-5665 | - | AGAUAUAGGAACUAUUAUUGGGGU | 24 | 5411 |
| myoC-5666 | - | ACGUCUUAAAGGACUUGU | 18 | 5412 |
| myoC-5667 | - | UACGUCUUAAAGGACUUGU | 19 | 5413 |
| myoC-2080 | - | CUACGUCUUAAAGGACUUGU | 20 | 2209 |
| myoC-5668 | - | UGCUACGUCUUAAAGGACUUGU | 22 | 5414 |
| myoC-5669 | - | CUGCUACGUCUUAAAGGACUUGU | 23 | 5415 |
| myoC-5670 | - | CCUGCUACGUCUUAAAGGACUUGU | 24 | 5416 |

Table 10C provides exemplary targeting domains for knocking down the MYOC gene selected according to the third tier parameters. The targeting domains bind within 3454-2454 bp upstream of transcription start site or 500 bp upstream and downstream of transcription start site, and PAM is NNGRRT. It is contemplated herein that in an embodiment the targeting domain hybridizes to the target domain through complementary base pairing Any of the targeting domains in the table can be used with a *S. aureus* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 10C

| 3rd Tier | | | | |
|---|---|---|---|---|
| gRNA Name | DNA Strand | Targeting Domain | Target Site Length | Seq ID |
| myoC-5671 | + | AUUUCCUUUCUUUCAGCA | 18 | 5417 |
| myoC-5672 | + | UAUUUCCUUUCUUUCAGCA | 19 | 5418 |
| myoC-2138 | + | UUAUUUCCUUUCUUUCAGCA | 20 | 2256 |
| myoC-5673 | + | UUUAUUUCCUUUCUUUCAGCA | 21 | 5419 |
| myoC-5674 | + | GUUUAUUUCCUUUCUUUCAGCA | 22 | 5420 |
| myoC-5675 | + | UGUUUAUUUCCUUUCUUUCAGCA | 23 | 5421 |
| myoC-5676 | + | GUGUUUAUUUCCUUUCUUUCAGCA | 24 | 5422 |
| myoC-5677 | + | GUACUCAAUAAAUUGUCA | 18 | 5423 |
| myoC-5678 | + | AGUACUCAAUAAAUUGUCA | 19 | 5424 |
| myoC-2133 | + | AAGUACUCAAUAAAUUGUCA | 20 | 2251 |
| myoC-5679 | + | UAAGUACUCAAUAAAUUGUCA | 21 | 5425 |

TABLE 10C-continued

| 3rd Tier | | | | |
|---|---|---|---|---|
| gRNA Name | DNA Strand | Targeting Domain | Target Site Length | Seq ID |
| myoC-5680 | + | AUAAGUACUCAAUAAAUUGUCA | 22 | 5426 |
| myoC-5681 | + | UAUAAGUACUCAAUAAAUUGUCA | 23 | 5427 |
| myoC-5682 | + | AUAUAAGUACUCAAUAAAUUGUCA | 24 | 5428 |
| myoC-5683 | + | GAAUGCCUGGAUGAAUGA | 18 | 5429 |
| myoC-5684 | + | UGAAUGCCUGGAUGAAUGA | 19 | 5430 |
| myoC-2129 | + | AUGAAUGCCUGGAUGAAUGA | 20 | 2247 |
| myoC-5685 | + | AAUGAAUGCCUGGAUGAAUGA | 21 | 5431 |
| myoC-5686 | + | CAAUGAAUGCCUGGAUGAAUGA | 22 | 5432 |
| myoC-5687 | + | UCAAUGAAUGCCUGGAUGAAUGA | 23 | 5433 |
| myoC-5688 | + | GUCAAUGAAUGCCUGGAUGAAUGA | 24 | 5434 |
| myoC-5689 | + | UGGUGUGCUGAUUUCAAC | 18 | 5435 |
| myoC-5690 | + | CUGGUGUGCUGAUUUCAAC | 19 | 5436 |
| myoC-2324 | + | ACUGGUGUGCUGAUUUCAAC | 20 | 2390 |
| myoC-5691 | + | CUCAGGACACCCAGGACC | 18 | 5437 |
| myoC-5692 | + | GCUCAGGACACCCAGGACC | 19 | 5438 |
| myoC-2121 | + | UGCUCAGGACACCCAGGACC | 20 | 2239 |
| myoC-5693 | + | CCUGCAGUCCCCACCUCC | 18 | 5439 |
| myoC-5694 | + | CCCUGCAGUCCCCACCUCC | 19 | 5440 |
| myoC-1108 | + | UCCCUGCAGUCCCCACCUCC | 20 | 1408 |
| myoC-5695 | + | CUCCCUGCAGUCCCCACCUCC | 21 | 5441 |
| myoC-5696 | + | ACUCCCUGCAGUCCCCACCUCC | 22 | 5442 |
| myoC-5697 | + | CACUCCCUGCAGUCCCCACCUCC | 23 | 5443 |
| myoC-5698 | + | CCACUCCCUGCAGUCCCCACCUCC | 24 | 5444 |
| myoC-5699 | + | UAAAUUGUCAAUGAAUGC | 18 | 5445 |
| myoC-5700 | + | AUAAAUUGUCAAUGAAUGC | 19 | 5446 |
| myoC-2132 | + | AAUAAAUUGUCAAUGAAUGC | 20 | 2250 |
| myoC-5701 | + | CAAUAAAUUGUCAAUGAAUGC | 21 | 5447 |
| myoC-5702 | + | UCAAUAAAUUGUCAAUGAAUGC | 22 | 5448 |
| myoC-5703 | + | CUCAAUAAAUUGUCAAUGAAUGC | 23 | 5449 |
| myoC-5704 | + | ACUCAAUAAAUUGUCAAUGAAUGC | 24 | 5450 |
| myoC-3243 | + | CUCCCUCUGCAGCCCCUC | 18 | 2989 |
| myoC-3244 | + | GCUCCCUCUGCAGCCCCUC | 19 | 2990 |
| myoC-1689 | + | AGCUCCCUCUGCAGCCCCUC | 20 | 1945 |
| myoC-3245 | + | CAGCUCCCUCUGCAGCCCCUC | 21 | 2991 |
| myoC-3246 | + | CCAGCUCCCUCUGCAGCCCCUC | 22 | 2992 |
| myoC-3247 | + | CCCAGCUCCCUCUGCAGCCCCUC | 23 | 2993 |
| myoC-3248 | + | GCCCAGCUCCCUCUGCAGCCCCUC | 24 | 2994 |
| myoC-5705 | + | GGGUGGGGCUGUGCACAG | 18 | 5451 |

TABLE 10C-continued

| 3rd Tier | | | | |
|---|---|---|---|---|
| gRNA Name | DNA Strand | Targeting Domain | Target Site Length | Seq ID |
| myoC-5706 | + | UGGGUGGGGCUGUGCACAG | 19 | 5452 |
| myoC-882 | + | CUGGGUGGGGCUGUGCACAG | 20 | 1205 |
| myoC-5707 | + | GCUGGGUGGGGCUGUGCACAG | 21 | 5453 |
| myoC-5708 | + | GGCUGGGUGGGGCUGUGCACAG | 22 | 5454 |
| myoC-5709 | + | AGGCUGGGUGGGGCUGUGCACAG | 23 | 5455 |
| myoC-5710 | + | GAGGCUGGGUGGGGCUGUGCACAG | 24 | 5456 |
| myoC-3249 | + | UGGCUCUGCUCUGGGCAG | 18 | 2995 |
| myoC-3250 | + | CUGGCUCUGCUCUGGGCAG | 19 | 2996 |
| myoC-1674 | + | CCUGGCUCUGCUCUGGGCAG | 20 | 1935 |
| myoC-3251 | + | GCCUGGCUCUGCUCUGGGCAG | 21 | 2997 |
| myoC-3252 | + | GGCCUGGCUCUGCUCUGGGCAG | 22 | 2998 |
| myoC-3253 | + | UGGCCUGGCUCUGCUCUGGGCAG | 23 | 2999 |
| myoC-3254 | + | AUGGCCUGGCUCUGCUCUGGGCAG | 24 | 3000 |
| myoC-3255 | + | AGGAGGCUCUCCAGGGAG | 18 | 3001 |
| myoC-3256 | + | GAGGAGGCUCUCCAGGGAG | 19 | 3002 |
| myoC-1679 | + | GGAGGAGGCUCUCCAGGGAG | 20 | 1940 |
| myoC-3257 | + | UGGAGGAGGCUCUCCAGGGAG | 21 | 3003 |
| myoC-3258 | + | GUGGAGGAGGCUCUCCAGGGAG | 22 | 3004 |
| myoC-3259 | + | GGUGGAGGAGGCUCUCCAGGGAG | 23 | 3005 |
| myoC-3260 | + | UGGUGGAGGAGGCUCUCCAGGGAG | 24 | 3006 |
| myoC-3261 | + | AGUCUCCAACUCUCUGGU | 18 | 3007 |
| myoC-3262 | + | CAGUCUCCAACUCUCUGGU | 19 | 3008 |
| myoC-1691 | + | GCAGUCUCCAACUCUCUGGU | 20 | 1947 |
| myoC-5711 | - | CAGGAGGUGGGGACUGCA | 18 | 5457 |
| myoC-5712 | - | CCAGGAGGUGGGGACUGCA | 19 | 5458 |
| myoC-984 | - | UCCAGGAGGUGGGGACUGCA | 20 | 1284 |
| myoC-5713 | - | UUCCAGGAGGUGGGGACUGCA | 21 | 5459 |
| myoC-5714 | - | AUUCCAGGAGGUGGGGACUGCA | 22 | 5460 |
| myoC-5715 | - | AAUUCCAGGAGGUGGGGACUGCA | 23 | 5461 |
| myoC-5716 | - | GAAUUCCAGGAGGUGGGGACUGCA | 24 | 5462 |
| myoC-5717 | - | GCACAGUGCAGGUUCUCA | 18 | 5463 |
| myoC-5718 | - | GGCACAGUGCAGGUUCUCA | 19 | 5464 |
| myoC-2081 | - | UGGCACAGUGCAGGUUCUCA | 20 | 2210 |
| myoC-5719 | - | CUGGCACAGUGCAGGUUCUCA | 21 | 5465 |
| myoC-5720 | - | CCUGGCACAGUGCAGGUUCUCA | 22 | 5466 |
| myoC-5721 | - | GCCUGGCACAGUGCAGGUUCUCA | 23 | 5467 |
| myoC-5722 | - | UGCCUGGCACAGUGCAGGUUCUCA | 24 | 5468 |

TABLE 10C-continued

| 3rd Tier | | | | |
|---|---|---|---|---|
| gRNA Name | DNA Strand | Targeting Domain | Target Site Length | Seq ID |
| myoC-5723 | - | CAGGCAUUCAUUGACAAUUUA | 21 | 5469 |
| myoC-5724 | - | CCAGGCAUUCAUUGACAAUUUA | 22 | 5470 |
| myoC-5725 | - | UCCAGGCAUUCAUUGACAAUUUA | 23 | 5471 |
| myoC-5726 | - | AUCCAGGCAUUCAUUGACAAUUUA | 24 | 5472 |
| myoC-5727 | - | AGUCAGCUGUUAAAAUUC | 18 | 5473 |
| myoC-5728 | - | AAGUCAGCUGUUAAAAUUC | 19 | 5474 |
| myoC-1907 | - | AAAGUCAGCUGUUAAAAUUC | 20 | 2090 |
| myoC-3263 | - | CUGCUUCUGGCCUGCCUGGUG | 21 | 3009 |
| myoC-3264 | - | GCUGCUUCUGGCCUGCCUGGUG | 22 | 3010 |
| myoC-3265 | - | UGCUGCUUCUGGCCUGCCUGGUG | 23 | 3011 |
| myoC-3266 | - | CUGCUGCUUCUGGCCUGCCUGGUG | 24 | 3012 |
| myoC-5729 | - | UUGGGGUAUGGGUGCAUAAAU | 21 | 5475 |
| myoC-5730 | - | AUUGGGGUAUGGGUGCAUAAAU | 22 | 5476 |
| myoC-5731 | - | UAUUGGGGUAUGGGUGCAUAAAU | 23 | 5477 |
| myoC-5732 | - | UUAUUGGGGUAUGGGUGCAUAAAU | 24 | 5478 |

Table 10D provides exemplary targeting domains for knocking down the MYOC gene selected according to the fourth tier parameters. The targeting domains bind within 3454-2454 bp upstream of transcription start site or 500 bp upstream and downstream of transcription start site, and PAM is NNGRRV. It is contemplated herein that in an embodiment the targeting domain hybridizes to the target domain through complementary base pairing Any of the targeting domains in the table can be used with a *S. aureus* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 10D

| 4th Tier | | | | |
|---|---|---|---|---|
| gRNA Name | DNA Strand | Targeting Domain | Target Site Length | Seq ID |
| myoC-5733 | + | GAACGAGUCACACAGAAA | 18 | 5479 |
| myoC-5734 | + | UGAACGAGUCACACAGAAA | 19 | 5480 |
| myoC-2127 | + | AUGAACGAGUCACACAGAAA | 20 | 2245 |
| myoC-5735 | + | AAUGAACGAGUCACACAGAAA | 21 | 5481 |
| myoC-5736 | + | GAAUGAACGAGUCACACAGAAA | 22 | 5482 |
| myoC-5737 | + | UGAAUGAACGAGUCACACAGAAA | 23 | 5483 |
| myoC-5738 | + | AUGAAUGAACGAGUCACACAGAAA | 24 | 5484 |
| myoC-5739 | + | UUGGAGUUUCUUUUUAAA | 18 | 5485 |
| myoC-5740 | + | UUUGGAGUUUCUUUUUAAA | 19 | 5486 |
| myoC-2326 | + | GUUUGGAGUUUCUUUUUAAA | 20 | 2392 |
| myoC-5741 | + | UGUUUGGAGUUUCUUUUUAAA | 21 | 5487 |
| myoC-5742 | + | CUGUUUGGAGUUUCUUUUUAAA | 22 | 5488 |
| myoC-5743 | + | UCUGUUUGGAGUUUCUUUUUAAA | 23 | 5489 |

TABLE 10D-continued

| 4th Tier | | | | |
|---|---|---|---|---|
| gRNA Name | DNA Strand | Targeting Domain | Target Site Length | Seq ID |
| myoC-5744 | + | GUCUGUUUGGAGUUUCUUUUUAAA | 24 | 5490 |
| myoC-5745 | + | AAGGCUCACAGGAAGCAA | 18 | 5491 |
| myoC-5746 | + | AAAGGCUCACAGGAAGCAA | 19 | 5492 |
| myoC-1105 | + | AAAAGGCUCACAGGAAGCAA | 20 | 1405 |
| myoC-5747 | + | AAAAAGGCUCACAGGAAGCAA | 21 | 5493 |
| myoC-5748 | + | UAAAAAGGCUCACAGGAAGCAA | 22 | 5494 |
| myoC-5749 | + | AUAAAAAGGCUCACAGGAAGCAA | 23 | 5495 |
| myoC-5750 | + | GAUAAAAAGGCUCACAGGAAGCAA | 24 | 5496 |
| myoC-5751 | + | GAAUUAACGGCCUAGGAA | 18 | 5497 |
| myoC-5752 | + | UGAAUUAACGGCCUAGGAA | 19 | 5498 |
| myoC-2197 | + | GUGAAUUAACGGCCUAGGAA | 20 | 2293 |
| myoC-5753 | + | CGUGAAUUAACGGCCUAGGAA | 21 | 5499 |
| myoC-5754 | + | CCGUGAAUUAACGGCCUAGGAA | 22 | 5500 |
| myoC-5755 | + | UCCGUGAAUUAACGGCCUAGGAA | 23 | 5501 |
| myoC-5756 | + | UUCCGUGAAUUAACGGCCUAGGAA | 24 | 5502 |
| myoC-5757 | + | CAGGCACUAUGCUAGGAA | 18 | 5503 |
| myoC-5758 | + | CCAGGCACUAUGCUAGGAA | 19 | 5504 |
| myoC-2319 | + | GCCAGGCACUAUGCUAGGAA | 20 | 2386 |
| myoC-5759 | + | UGCCAGGCACUAUGCUAGGAA | 21 | 5505 |
| myoC-5760 | + | GUGCCAGGCACUAUGCUAGGAA | 22 | 5506 |
| myoC-5761 | + | UGUGCCAGGCACUAUGCUAGGAA | 23 | 5507 |
| myoC-5762 | + | CUGUGCCAGGCACUAUGCUAGGAA | 24 | 5508 |
| myoC-5763 | + | CAGGACGAUUCACGGGAA | 18 | 5509 |
| myoC-5764 | + | CCAGGACGAUUCACGGGAA | 19 | 5510 |
| myoC-2162 | + | ACCAGGACGAUUCACGGGAA | 20 | 2268 |
| myoC-5765 | + | CACCAGGACGAUUCACGGGAA | 21 | 5511 |
| myoC-5766 | + | GCACCAGGACGAUUCACGGGAA | 22 | 5512 |
| myoC-5767 | + | UGCACCAGGACGAUUCACGGGAA | 23 | 5513 |
| myoC-5768 | + | AUGCACCAGGACGAUUCACGGGAA | 24 | 5514 |
| myoC-5769 | + | CCAGCCCCGUGAACAACA | 18 | 5515 |
| myoC-5770 | + | CCCAGCCCCGUGAACAACA | 19 | 5516 |
| myoC-2182 | + | UCCCAGCCCCGUGAACAACA | 20 | 2282 |
| myoC-5771 | + | CUCCCAGCCCCGUGAACAACA | 21 | 5517 |
| myoC-5772 | + | ACUCCCAGCCCCGUGAACAACA | 22 | 5518 |
| myoC-5773 | + | AACUCCCAGCCCCGUGAACAACA | 23 | 5519 |
| myoC-5774 | + | AAACUCCCAGCCCCGUGAACAACA | 24 | 5520 |
| myoC-3267 | + | UCAUUGGGACUGGCCACA | 18 | 3013 |

TABLE 10D-continued

| 4th Tier | | | | |
|---|---|---|---|---|
| gRNA Name | DNA Strand | Targeting Domain | Target Site Length | Seq ID |
| myoC-3268 | + | UUCAUUGGGACUGGCCACA | 19 | 3014 |
| myoC-1671 | + | AUUCAUUGGGACUGGCCACA | 20 | 1933 |
| myoC-3269 | + | GAUUCAUUGGGACUGGCCACA | 21 | 3015 |
| myoC-3270 | + | GGAUUCAUUGGGACUGGCCACA | 22 | 3016 |
| myoC-3271 | + | UGGAUUCAUUGGGACUGGCCACA | 23 | 3017 |
| myoC-3272 | + | CUGGAUUCAUUGGGACUGGCCACA | 24 | 3018 |
| myoC-5775 | + | UGGGUGGGGCUGUGCACA | 18 | 5521 |
| myoC-5776 | + | CUGGGUGGGGCUGUGCACA | 19 | 5522 |
| myoC-881 | + | GCUGGGUGGGGCUGUGCACA | 20 | 1050 |
| myoC-5777 | + | GGCUGGGUGGGGCUGUGCACA | 21 | 5523 |
| myoC-5778 | + | AGGCUGGGUGGGGCUGUGCACA | 22 | 5524 |
| myoC-5779 | + | GAGGCUGGGUGGGGCUGUGCACA | 23 | 5525 |
| myoC-5780 | + | UGAGGCUGGGUGGGGCUGUGCACA | 24 | 5526 |
| myoC-5781 | + | AUGAAUGAACGAGUCACA | 18 | 5527 |
| myoC-5782 | + | GAUGAAUGAACGAGUCACA | 19 | 5528 |
| myoC-2128 | + | GGAUGAAUGAACGAGUCACA | 20 | 2246 |
| myoC-5783 | + | UGGAUGAAUGAACGAGUCACA | 21 | 5529 |
| myoC-5784 | + | CUGGAUGAAUGAACGAGUCACA | 22 | 5530 |
| myoC-5785 | + | CCUGGAUGAAUGAACGAGUCACA | 23 | 5531 |
| myoC-5786 | + | GCCUGGAUGAAUGAACGAGUCACA | 24 | 5532 |
| myoC-5787 | + | UAAGACGUAGCAGGGACA | 18 | 5533 |
| myoC-5788 | + | UUAAGACGUAGCAGGGACA | 19 | 5534 |
| myoC-2314 | + | UUUAAGACGUAGCAGGGACA | 20 | 2383 |
| myoC-5789 | + | CUUUAAGACGUAGCAGGGACA | 21 | 5535 |
| myoC-5790 | + | CCUUUAAGACGUAGCAGGGACA | 22 | 5536 |
| myoC-5791 | + | UCCUUUAAGACGUAGCAGGGACA | 23 | 5537 |
| myoC-5792 | + | GUCCUUUAAGACGUAGCAGGGACA | 24 | 5538 |
| myoC-5793 | + | GCUCAUGCCCGAGCUCCA | 18 | 5539 |
| myoC-5794 | + | GGCUCAUGCCCGAGCUCCA | 19 | 5540 |
| myoC-2349 | + | UGGCUCAUGCCCGAGCUCCA | 20 | 2403 |
| myoC-5795 | + | CUGGCUCAUGCCCGAGCUCCA | 21 | 5541 |
| myoC-5796 | + | GCUGGCUCAUGCCCGAGCUCCA | 22 | 5542 |
| myoC-5797 | + | UGCUGGCUCAUGCCCGAGCUCCA | 23 | 5543 |
| myoC-5798 | + | UUGCUGGCUCAUGCCCGAGCUCCA | 24 | 5544 |
| myoC-3273 | + | GGUGGAGGAGGCUCUCCA | 18 | 3019 |
| myoC-3274 | + | UGGUGGAGGAGGCUCUCCA | 19 | 3020 |
| myoC-223 | + | UUGGUGGAGGAGGCUCUCCA | 20 | 609 |
| myoC-3275 | + | AUUGGUGGAGGAGGCUCUCCA | 21 | 3021 |

TABLE 10D-continued

| 4th Tier | | | | |
|---|---|---|---|---|
| gRNA Name | DNA Strand | Targeting Domain | Target Site Length | Seq ID |
| myoC-3276 | + | AAUUGGUGGAGGAGGCUCUCCA | 22 | 3022 |
| myoC-3277 | + | CAAUUGGUGGAGGAGGCUCUCCA | 23 | 3023 |
| myoC-3278 | + | UCAAUUGGUGGAGGAGGCUCUCCA | 24 | 3024 |
| myoC-5799 | + | CUUCUUCUCCUCCAAGCA | 18 | 5545 |
| myoC-5800 | + | ACUUCUUCUCCUCCAAGCA | 19 | 5546 |
| myoC-2188 | + | GACUUCUUCUCCUCCAAGCA | 20 | 2286 |
| myoC-5801 | + | AGACUUCUUCUCCUCCAAGCA | 21 | 5547 |
| myoC-5802 | + | UAGACUUCUUCUCCUCCAAGCA | 22 | 5548 |
| myoC-5803 | + | AUAGACUUCUUCUCCUCCAAGCA | 23 | 5549 |
| myoC-5804 | + | AAUAGACUUCUUCUCCUCCAAGCA | 24 | 5550 |
| myoC-5805 | + | AAAGGCUCACAGGAAGCA | 18 | 5551 |
| myoC-5806 | + | AAAAGGCUCACAGGAAGCA | 19 | 5552 |
| myoC-2185 | + | AAAAAGGCUCACAGGAAGCA | 20 | 2284 |
| myoC-5807 | + | UAAAAAGGCUCACAGGAAGCA | 21 | 5553 |
| myoC-5808 | + | AUAAAAAGGCUCACAGGAAGCA | 22 | 5554 |
| myoC-5809 | + | GAUAAAAAGGCUCACAGGAAGCA | 23 | 5555 |
| myoC-5810 | + | AGAUAAAAAGGCUCACAGGAAGCA | 24 | 5556 |
| myoC-5811 | + | GGCACGAUGGAGGCAGCA | 18 | 5557 |
| myoC-5812 | + | GGGCACGAUGGAGGCAGCA | 19 | 5558 |
| myoC-714 | + | CGGGCACGAUGGAGGCAGCA | 20 | 1105 |
| myoC-5813 | + | CCGGGCACGAUGGAGGCAGCA | 21 | 5559 |
| myoC-5814 | + | UCCGGGCACGAUGGAGGCAGCA | 22 | 5560 |
| myoC-5815 | + | CUCCGGGCACGAUGGAGGCAGCA | 23 | 5561 |
| myoC-5816 | + | CCUCCGGGCACGAUGGAGGCAGCA | 24 | 5562 |
| myoC-3279 | + | AAGCUGCAGCAACGUGCA | 18 | 3025 |
| myoC-3280 | + | AAAGCUGCAGCAACGUGCA | 19 | 3026 |
| myoC-1666 | + | CAAAGCUGCAGCAACGUGCA | 20 | 1928 |
| myoC-3281 | + | CCAAAGCUGCAGCAACGUGCA | 21 | 3027 |
| myoC-3282 | + | CCCAAAGCUGCAGCAACGUGCA | 22 | 3028 |
| myoC-3283 | + | GCCCAAAGCUGCAGCAACGUGCA | 23 | 3029 |
| myoC-3284 | + | GGCCCAAAGCUGCAGCAACGUGCA | 24 | 3030 |
| myoC-5817 | + | GCUGGGUGGGGCUGUGCA | 18 | 5563 |
| myoC-5818 | + | GGCUGGGUGGGGCUGUGCA | 19 | 5564 |
| myoC-2334 | + | AGGCUGGGUGGGGCUGUGCA | 20 | 2396 |
| myoC-5819 | + | GAGGCUGGGUGGGGCUGUGCA | 21 | 5565 |
| myoC-5820 | + | UGAGGCUGGGUGGGGCUGUGCA | 22 | 5566 |
| myoC-5821 | + | GUGAGGCUGGGUGGGGCUGUGCA | 23 | 5567 |

TABLE 10D-continued

| 4th Tier | | | | |
|---|---|---|---|---|
| gRNA Name | DNA Strand | Targeting Domain | Target Site Length | Seq ID |
| myoC-5822 | + | CGUGAGGCUGGGUGGGGCUGUGCA | 24 | 5568 |
| myoC-5823 | + | AUUCACUCUGCAAACUCA | 18 | 5569 |
| myoC-5824 | + | CAUUCACUCUGCAAACUCA | 19 | 5570 |
| myoC-2323 | + | CCAUUCACUCUGCAAACUCA | 20 | 2389 |
| myoC-5825 | + | UCCAUUCACUCUGCAAACUCA | 21 | 5571 |
| myoC-5826 | + | UUCCAUUCACUCUGCAAACUCA | 22 | 5572 |
| myoC-5827 | + | UUUCCAUUCACUCUGCAAACUCA | 23 | 5573 |
| myoC-5828 | + | AUUUCCAUUCACUCUGCAAACUCA | 24 | 5574 |
| myoC-5829 | + | AAAAGAUAAAAAGGCUCA | 18 | 5575 |
| myoC-5830 | + | GAAAAGAUAAAAAGGCUCA | 19 | 5576 |
| myoC-2187 | + | AGAAAAGAUAAAAAGGCUCA | 20 | 2285 |
| myoC-5831 | + | GAGAAAAGAUAAAAAGGCUCA | 21 | 5577 |
| myoC-5832 | + | AGAGAAAAGAUAAAAAGGCUCA | 22 | 5578 |
| myoC-5833 | + | CAGAGAAAAGAUAAAAAGGCUCA | 23 | 5579 |
| myoC-5834 | + | GCAGAGAAAAGAUAAAAAGGCUCA | 24 | 5580 |
| myoC-5835 | + | AUGCACCAGGACGAUUCA | 18 | 5581 |
| myoC-5836 | + | GAUGCACCAGGACGAUUCA | 19 | 5582 |
| myoC-2164 | + | AGAUGCACCAGGACGAUUCA | 20 | 2270 |
| myoC-5837 | + | CAGAUGCACCAGGACGAUUCA | 21 | 5583 |
| myoC-5838 | + | UCAGAUGCACCAGGACGAUUCA | 22 | 5584 |
| myoC-5839 | + | CUCAGAUGCACCAGGACGAUUCA | 23 | 5585 |
| myoC-5840 | + | GCUCAGAUGCACCAGGACGAUUCA | 24 | 5586 |
| myoC-3285 | + | UCUGGGCAGCUGGAUUCA | 18 | 3031 |
| myoC-3286 | + | CUCUGGGCAGCUGGAUUCA | 19 | 3032 |
| myoC-1673 | + | GCUCUGGGCAGCUGGAUUCA | 20 | 1934 |
| myoC-3287 | + | UGCUCUGGGCAGCUGGAUUCA | 21 | 3033 |
| myoC-3288 | + | CUGCUCUGGGCAGCUGGAUUCA | 22 | 3034 |
| myoC-3289 | + | UCUGCUCUGGGCAGCUGGAUUCA | 23 | 3035 |
| myoC-3290 | + | CUCUGCUCUGGGCAGCUGGAUUCA | 24 | 3036 |
| myoC-5841 | + | UGGGGAGCCAGCCCUUCA | 18 | 5587 |
| myoC-5842 | + | CUGGGGAGCCAGCCCUUCA | 19 | 5588 |
| myoC-868 | + | ACUGGGGAGCCAGCCCUUCA | 20 | 1177 |
| myoC-5843 | + | UACUGGGGAGCCAGCCCUUCA | 21 | 5589 |
| myoC-5844 | + | AUACUGGGGAGCCAGCCCUUCA | 22 | 5590 |
| myoC-5845 | + | UAUACUGGGGAGCCAGCCCUUCA | 23 | 5591 |
| myoC-5846 | + | AUAUACUGGGGAGCCAGCCCUUCA | 24 | 5592 |
| myoC-5847 | + | GCCCUUCAUGGGGGAAGA | 18 | 5593 |
| myoC-5848 | + | AGCCCUUCAUGGGGGAAGA | 19 | 5594 |

TABLE 10D-continued

| 4th Tier | | | | |
|---|---|---|---|---|
| gRNA Name | DNA Strand | Targeting Domain | Target Site Length | Seq ID |
| myoC-2339 | + | CAGCCCUUCAUGGGGGAAGA | 20 | 2400 |
| myoC-5849 | + | CCAGCCCUUCAUGGGGGAAGA | 21 | 5595 |
| myoC-5850 | + | GCCAGCCCUUCAUGGGGGAAGA | 22 | 5596 |
| myoC-5851 | + | AGCCAGCCCUUCAUGGGGGAAGA | 23 | 5597 |
| myoC-5852 | + | GAGCCAGCCCUUCAUGGGGGAAGA | 24 | 5598 |
| myoC-5853 | + | GGGGGCCUCCGGGCACGA | 18 | 5599 |
| myoC-5854 | + | UGGGGGCCUCCGGGCACGA | 19 | 5600 |
| myoC-711 | + | UUGGGGGCCUCCGGGCACGA | 20 | 1123 |
| myoC-5855 | + | CUUGGGGGCCUCCGGGCACGA | 21 | 5601 |
| myoC-5856 | + | GCUUGGGGGCCUCCGGGCACGA | 22 | 5602 |
| myoC-5857 | + | GGCUUGGGGGCCUCCGGGCACGA | 23 | 5603 |
| myoC-5858 | + | GGGCUUGGGGGCCUCCGGGCACGA | 24 | 5604 |
| myoC-5859 | + | UUUAAGACGUAGCAGGGA | 18 | 5605 |
| myoC-5860 | + | CUUUAAGACGUAGCAGGGA | 19 | 5606 |
| myoC-2315 | + | CCUUUAAGACGUAGCAGGGA | 20 | 2384 |
| myoC-5861 | + | UCCUUUAAGACGUAGCAGGGA | 21 | 5607 |
| myoC-5862 | + | GUCCUUUAAGACGUAGCAGGGA | 22 | 5608 |
| myoC-5863 | + | AGUCCUUUAAGACGUAGCAGGGA | 23 | 5609 |
| myoC-5864 | + | AAGUCCUUUAAGACGUAGCAGGGA | 24 | 5610 |
| myoC-5865 | + | AGGGCUCCCCCAGCUGGA | 18 | 5611 |
| myoC-5866 | + | CAGGGCUCCCCCAGCUGGA | 19 | 5612 |
| myoC-2116 | + | GCAGGGCUCCCCCAGCUGGA | 20 | 2235 |
| myoC-5867 | + | UGCAGGGCUCCCCCAGCUGGA | 21 | 5613 |
| myoC-5868 | + | UUGCAGGGCUCCCCCAGCUGGA | 22 | 5614 |
| myoC-5869 | + | CUUGCAGGGCUCCCCCAGCUGGA | 23 | 5615 |
| myoC-5870 | + | GCUUGCAGGGCUCCCCCAGCUGGA | 24 | 5616 |
| myoC-5871 | + | GUUGCCCAGAAGACAUGA | 18 | 5617 |
| myoC-5872 | + | AGUUGCCCAGAAGACAUGA | 19 | 5618 |
| myoC-2201 | + | UAGUUGCCCAGAAGACAUGA | 20 | 2296 |
| myoC-5873 | + | GUAGUUGCCCAGAAGACAUGA | 21 | 5619 |
| myoC-5874 | + | AGUAGUUGCCCAGAAGACAUGA | 22 | 5620 |
| myoC-5875 | + | GAGUAGUUGCCCAGAAGACAUGA | 23 | 5621 |
| myoC-5876 | + | UGAGUAGUUGCCCAGAAGACAUGA | 24 | 5622 |
| myoC-5877 | + | CAAUGAAUGCCUGGAUGA | 18 | 5623 |
| myoC-5878 | + | UCAAUGAAUGCCUGGAUGA | 19 | 5624 |
| myoC-2130 | + | GUCAAUGAAUGCCUGGAUGA | 20 | 2248 |
| myoC-5879 | + | UGUCAAUGAAUGCCUGGAUGA | 21 | 5625 |

TABLE 10D-continued

| 4th Tier | | | | |
|---|---|---|---|---|
| gRNA Name | DNA Strand | Targeting Domain | Target Site Length | Seq ID |
| myoC-5880 | + | UUGUCAAUGAAUGCCUGGAUGA | 22 | 5626 |
| myoC-5881 | + | AUUGUCAAUGAAUGCCUGGAUGA | 23 | 5627 |
| myoC-5882 | + | AAUUGUCAAUGAAUGCCUGGAUGA | 24 | 5628 |
| myoC-5883 | + | CUGCAGCGCUGUGACUGA | 18 | 5629 |
| myoC-5884 | + | GCUGCAGCGCUGUGACUGA | 19 | 5630 |
| myoC-698 | + | AGCUGCAGCGCUGUGACUGA | 20 | 1089 |
| myoC-5885 | + | CAGCUGCAGCGCUGUGACUGA | 21 | 5631 |
| myoC-5886 | + | CCAGCUGCAGCGCUGUGACUGA | 22 | 5632 |
| myoC-5887 | + | GCCAGCUGCAGCGCUGUGACUGA | 23 | 5633 |
| myoC-5888 | + | GGCCAGCUGCAGCGCUGUGACUGA | 24 | 5634 |
| myoC-5889 | + | AAAUAAAGGCCUUCGUGA | 18 | 5635 |
| myoC-5890 | + | UAAAUAAAGGCCUUCGUGA | 19 | 5636 |
| myoC-1101 | + | UUAAAUAAAGGCCUUCGUGA | 20 | 1401 |
| myoC-5891 | + | AUUAAAUAAAGGCCUUCGUGA | 21 | 5637 |
| myoC-5892 | + | CAUUAAAUAAAGGCCUUCGUGA | 22 | 5638 |
| myoC-5893 | + | CCAUUAAAUAAAGGCCUUCGUGA | 23 | 5639 |
| myoC-5894 | + | CCCAUUAAAUAAAGGCCUUCGUGA | 24 | 5640 |
| myoC-5895 | + | CAGAGAGGUUUAUAUAUA | 18 | 5641 |
| myoC-5896 | + | CCAGAGAGGUUUAUAUAUA | 19 | 5642 |
| myoC-2348 | + | UCCAGAGAGGUUUAUAUAUA | 20 | 2402 |
| myoC-5897 | + | CUCCAGAGAGGUUUAUAUAUA | 21 | 5643 |
| myoC-5898 | + | GCUCCAGAGAGGUUUAUAUAUA | 22 | 5644 |
| myoC-5899 | + | AGCUCCAGAGAGGUUUAUAUAUA | 23 | 5645 |
| myoC-5900 | + | GAGCUCCAGAGAGGUUUAUAUAUA | 24 | 5646 |
| myoC-5901 | + | AGGCAGCAGGGGGCGCUA | 18 | 5647 |
| myoC-5902 | + | GAGGCAGCAGGGGGCGCUA | 19 | 5648 |
| myoC-718 | + | GGAGGCAGCAGGGGGCGCUA | 20 | 1015 |
| myoC-5903 | + | UGGAGGCAGCAGGGGGCGCUA | 21 | 5649 |
| myoC-5904 | + | AUGGAGGCAGCAGGGGGCGCUA | 22 | 5650 |
| myoC-5905 | + | GAUGGAGGCAGCAGGGGGCGCUA | 23 | 5651 |
| myoC-5906 | + | CGAUGGAGGCAGCAGGGGGCGCUA | 24 | 5652 |
| myoC-5907 | + | AGGCACUAUGCUAGGAAC | 18 | 5653 |
| myoC-5908 | + | CAGGCACUAUGCUAGGAAC | 19 | 5654 |
| myoC-892 | + | CCAGGCACUAUGCUAGGAAC | 20 | 1196 |
| myoC-5909 | + | GCCAGGCACUAUGCUAGGAAC | 21 | 5655 |
| myoC-5910 | + | UGCCAGGCACUAUGCUAGGAAC | 22 | 5656 |
| myoC-5911 | + | GUGCCAGGCACUAUGCUAGGAAC | 23 | 5657 |
| myoC-5912 | + | UGUGCCAGGCACUAUGCUAGGAAC | 24 | 5658 |

TABLE 10D-continued

| gRNA Name | DNA Strand | Targeting Domain | Target Site Length | Seq ID |
|---|---|---|---|---|
| 4th Tier | | | | |
| myoC-5913 | + | AACAGCCAGCCAGAACAC | 18 | 5659 |
| myoC-5914 | + | UAACAGCCAGCCAGAACAC | 19 | 5660 |
| myoC-2312 | + | AUAACAGCCAGCCAGAACAC | 20 | 2381 |
| myoC-5915 | + | AAUAACAGCCAGCCAGAACAC | 21 | 5661 |
| myoC-5916 | + | AAAUAACAGCCAGCCAGAACAC | 22 | 5662 |
| myoC-5917 | + | AAAAUAACAGCCAGCCAGAACAC | 23 | 5663 |
| myoC-5918 | + | AAAAAUAACAGCCAGCCAGAACAC | 24 | 5664 |
| myoC-5919 | + | ACGUACACACACUUACAC | 18 | 5665 |
| myoC-5920 | + | CACGUACACACACUUACAC | 19 | 5666 |
| myoC-2325 | + | ACACGUACACACACUUACAC | 20 | 2391 |
| myoC-5921 | + | CACACGUACACACACUUACAC | 21 | 5667 |
| myoC-5922 | + | ACACACGUACACACACUUACAC | 22 | 5668 |
| myoC-5923 | + | CACACACGUACACACACUUACAC | 23 | 5669 |
| myoC-5924 | + | ACACACACGUACACACACUUACAC | 24 | 5670 |
| myoC-5925 | + | GAAGACAGAGGUGGCCAC | 18 | 5671 |
| myoC-5926 | + | GGAAGACAGAGGUGGCCAC | 19 | 5672 |
| myoC-2338 | + | GGGAAGACAGAGGUGGCCAC | 20 | 2399 |
| myoC-5927 | + | GGGGAAGACAGAGGUGGCCAC | 21 | 5673 |
| myoC-5928 | + | GGGGGAAGACAGAGGUGGCCAC | 22 | 5674 |
| myoC-5929 | + | UGGGGGAAGACAGAGGUGGCCAC | 23 | 5675 |
| myoC-5930 | + | AUGGGGGAAGACAGAGGUGGCCAC | 24 | 5676 |
| myoC-5931 | + | UCUCCAGCUCAGAUGCAC | 18 | 5677 |
| myoC-5932 | + | GUCUCCAGCUCAGAUGCAC | 19 | 5678 |
| myoC-2166 | + | AGUCUCCAGCUCAGAUGCAC | 20 | 2272 |
| myoC-5933 | + | GAGUCUCCAGCUCAGAUGCAC | 21 | 5679 |
| myoC-5934 | + | GGAGUCUCCAGCUCAGAUGCAC | 22 | 5680 |
| myoC-5935 | + | AGGAGUCUCCAGCUCAGAUGCAC | 23 | 5681 |
| myoC-5936 | + | AAGGAGUCUCCAGCUCAGAUGCAC | 24 | 5682 |
| myoC-5937 | + | CUGGGUGGGGCUGUGCAC | 18 | 5683 |
| myoC-5938 | + | GCUGGGUGGGGCUGUGCAC | 19 | 5684 |
| myoC-880 | + | GGCUGGGUGGGGCUGUGCAC | 20 | 1051 |
| myoC-5939 | + | AGGCUGGGUGGGGCUGUGCAC | 21 | 5685 |
| myoC-5940 | + | GAGGCUGGGUGGGGCUGUGCAC | 22 | 5686 |
| myoC-5941 | + | UGAGGCUGGGUGGGGCUGUGCAC | 23 | 5687 |
| myoC-5942 | + | GUGAGGCUGGGUGGGGCUGUGCAC | 24 | 5688 |
| myoC-5943 | + | AAAGAUAAAAAGGCUCAC | 18 | 5689 |
| myoC-5944 | + | AAAAGAUAAAAAGGCUCAC | 19 | 5690 |

TABLE 10D-continued

| 4th Tier | | | | |
|---|---|---|---|---|
| gRNA Name | DNA Strand | Targeting Domain | Target Site Length | Seq ID |
| myoC-1104 | + | GAAAAGAUAAAAAGGCUCAC | 20 | 1404 |
| myoC-5945 | + | AGAAAAGAUAAAAAGGCUCAC | 21 | 5691 |
| myoC-5946 | + | GAGAAAAGAUAAAAAGGCUCAC | 22 | 5692 |
| myoC-5947 | + | AGAGAAAAGAUAAAAAGGCUCAC | 23 | 5693 |
| myoC-5948 | + | CAGAGAAAAGAUAAAAAGGCUCAC | 24 | 5694 |
| myoC-5949 | + | UGCACCAGGACGAUUCAC | 18 | 5695 |
| myoC-5950 | + | AUGCACCAGGACGAUUCAC | 19 | 5696 |
| myoC-2163 | + | GAUGCACCAGGACGAUUCAC | 20 | 2269 |
| myoC-5951 | + | AGAUGCACCAGGACGAUUCAC | 21 | 5697 |
| myoC-5952 | + | CAGAUGCACCAGGACGAUUCAC | 22 | 5698 |
| myoC-5953 | + | UCAGAUGCACCAGGACGAUUCAC | 23 | 5699 |
| myoC-5954 | + | CUCAGAUGCACCAGGACGAUUCAC | 24 | 5700 |
| myoC-5955 | + | AGUAGUUGCCCAGAAGAC | 18 | 5701 |
| myoC-5956 | + | GAGUAGUUGCCCAGAAGAC | 19 | 5702 |
| myoC-2202 | + | UGAGUAGUUGCCCAGAAGAC | 20 | 2297 |
| myoC-5957 | + | GGAGGAGGCUUGGAAGAC | 18 | 5703 |
| myoC-5958 | + | AGGAGGAGGCUUGGAAGAC | 19 | 5704 |
| myoC-2153 | + | GAGGAGGAGGCUUGGAAGAC | 20 | 2263 |
| myoC-5959 | + | GGAGGAGGAGGCUUGGAAGAC | 21 | 5705 |
| myoC-5960 | + | UGGAGGAGGAGGCUUGGAAGAC | 22 | 5706 |
| myoC-5961 | + | AUGGAGGAGGAGGCUUGGAAGAC | 23 | 5707 |
| myoC-5962 | + | GAUGGAGGAGGAGGCUUGGAAGAC | 24 | 5708 |
| myoC-5963 | + | CCUGGAAUUCUCCUGGAC | 18 | 5709 |
| myoC-5964 | + | UCCUGGAAUUCUCCUGGAC | 19 | 5710 |
| myoC-2177 | + | CUCCUGGAAUUCUCCUGGAC | 20 | 2278 |
| myoC-5965 | + | CCUCCUGGAAUUCUCCUGGAC | 21 | 5711 |
| myoC-5966 | + | ACCUCCUGGAAUUCUCCUGGAC | 22 | 5712 |
| myoC-5967 | + | CACCUCCUGGAAUUCUCCUGGAC | 23 | 5713 |
| myoC-5968 | + | CCACCUCCUGGAAUUCUCCUGGAC | 24 | 5714 |
| myoC-5969 | + | AGAGAGGUUUAUAUAUAC | 18 | 5715 |
| myoC-5970 | + | CAGAGAGGUUUAUAUAUAC | 19 | 5716 |
| myoC-865 | + | CCAGAGAGGUUUAUAUAUAC | 20 | 1195 |
| myoC-5971 | + | UCCAGAGAGGUUUAUAUAUAC | 21 | 5717 |
| myoC-5972 | + | CUCCAGAGAGGUUUAUAUAUAC | 22 | 5718 |
| myoC-5973 | + | GCUCCAGAGAGGUUUAUAUAUAC | 23 | 5719 |
| myoC-5974 | + | AGCUCCAGAGAGGUUUAUAUAUAC | 24 | 5720 |
| myoC-5975 | + | GGAAAACCCAUGCACACC | 18 | 5721 |
| myoC-5976 | + | AGGAAAACCCAUGCACACC | 19 | 5722 |

TABLE 10D-continued

| 4th Tier | | | | |
|---|---|---|---|---|
| gRNA Name | DNA Strand | Targeting Domain | Target Site Length | Seq ID |
| myoC-2193 | + | AAGGAAAACCCAUGCACACC | 20 | 2290 |
| myoC-5977 | + | GAAGGAAAACCCAUGCACACC | 21 | 5723 |
| myoC-5978 | + | UGAAGGAAAACCCAUGCACACC | 22 | 5724 |
| myoC-5979 | + | GUGAAGGAAAACCCAUGCACACC | 23 | 5725 |
| myoC-5980 | + | CGUGAAGGAAAACCCAUGCACACC | 24 | 5726 |
| myoC-5981 | + | CAGGUUGCUCAGGACACC | 18 | 5727 |
| myoC-5982 | + | GCAGGUUGCUCAGGACACC | 19 | 5728 |
| myoC-2122 | + | GGCAGGUUGCUCAGGACACC | 20 | 2240 |
| myoC-5983 | + | UGGCAGGUUGCUCAGGACACC | 21 | 5729 |
| myoC-5984 | + | CUGGCAGGUUGCUCAGGACACC | 22 | 5730 |
| myoC-5985 | + | GCUGGCAGGUUGCUCAGGACACC | 23 | 5731 |
| myoC-5986 | + | GGCUGGCAGGUUGCUCAGGACACC | 24 | 5732 |
| myoC-5987 | + | CGGAAAACUCCCAGCCCC | 18 | 5733 |
| myoC-5988 | + | ACGGAAAACUCCCAGCCCC | 19 | 5734 |
| myoC-2183 | + | AACGGAAAACUCCCAGCCCC | 20 | 2283 |
| myoC-5989 | + | CAACGGAAAACUCCCAGCCCC | 21 | 5735 |
| myoC-5990 | + | GCAACGGAAAACUCCCAGCCCC | 22 | 5736 |
| myoC-5991 | + | AGCAACGGAAAACUCCCAGCCCC | 23 | 5737 |
| myoC-5992 | + | AAGCAACGGAAAACUCCCAGCCCC | 24 | 5738 |
| myoC-5993 | + | UAGAAAGCAACAGGUCCC | 18 | 5739 |
| myoC-5994 | + | AUAGAAAGCAACAGGUCCC | 19 | 5740 |
| myoC-2126 | + | AAUAGAAAGCAACAGGUCCC | 20 | 2244 |
| myoC-5995 | + | AAAUAGAAAGCAACAGGUCCC | 21 | 5741 |
| myoC-5996 | + | GAAAUAGAAAGCAACAGGUCCC | 22 | 5742 |
| myoC-5997 | + | AGAAAUAGAAAGCAACAGGUCCC | 23 | 5743 |
| myoC-5998 | + | CAGAAAUAGAAAGCAACAGGUCCC | 24 | 5744 |
| myoC-5999 | + | UUUCUGGAGCCUGGAGCC | 18 | 5745 |
| myoC-6000 | + | CUUUCUGGAGCCUGGAGCC | 19 | 5746 |
| myoC-2168 | + | CCUUUCUGGAGCCUGGAGCC | 20 | 2273 |
| myoC-6001 | + | UCCUUUCUGGAGCCUGGAGCC | 21 | 5747 |
| myoC-6002 | + | UUCCUUUCUGGAGCCUGGAGCC | 22 | 5748 |
| myoC-6003 | + | UUUCCUUUCUGGAGCCUGGAGCC | 23 | 5749 |
| myoC-6004 | + | AUUUCCUUUCUGGAGCCUGGAGCC | 24 | 5750 |
| myoC-6005 | + | CAUUUCCUUUCUGGAGCC | 18 | 5751 |
| myoC-6006 | + | CCAUUUCCUUUCUGGAGCC | 19 | 5752 |
| myoC-1114 | + | UCCAUUUCCUUUCUGGAGCC | 20 | 1414 |
| myoC-6007 | + | CUCCAUUUCCUUUCUGGAGCC | 21 | 5753 |

TABLE 10D-continued

| 4th Tier | | | | |
|---|---|---|---|---|
| gRNA Name | DNA Strand | Targeting Domain | Target Site Length | Seq ID |
| myoC-6008 | + | UCUCCAUUUCCUUUCUGGAGCC | 22 | 5754 |
| myoC-6009 | + | CUCUCCAUUUCCUUUCUGGAGCC | 23 | 5755 |
| myoC-6010 | + | CCUCUCCAUUUCCUUUCUGGAGCC | 24 | 5756 |
| myoC-6011 | + | UUCCGUGAAUUAACGGCC | 18 | 5757 |
| myoC-6012 | + | CUUCCGUGAAUUAACGGCC | 19 | 5758 |
| myoC-2199 | + | UCUUCCGUGAAUUAACGGCC | 20 | 2294 |
| myoC-6013 | + | UUCUUCCGUGAAUUAACGGCC | 21 | 5759 |
| myoC-6014 | + | CUUCUUCCGUGAAUUAACGGCC | 22 | 5760 |
| myoC-6015 | + | ACUUCUUCCGUGAAUUAACGGCC | 23 | 5761 |
| myoC-6016 | + | CACUUCUUCCGUGAAUUAACGGCC | 24 | 5762 |
| myoC-6017 | + | GGAGAGGAAACCUCUGCC | 18 | 5763 |
| myoC-6018 | + | UGGAGAGGAAACCUCUGCC | 19 | 5764 |
| myoC-749 | + | CUGGAGAGGAAACCUCUGCC | 20 | 1110 |
| myoC-6019 | + | GCUGGAGAGGAAACCUCUGCC | 21 | 5765 |
| myoC-6020 | + | AGCUGGAGAGGAAACCUCUGCC | 22 | 5766 |
| myoC-6021 | + | CAGCUGGAGAGGAAACCUCUGCC | 23 | 5767 |
| myoC-6022 | + | CCAGCUGGAGAGGAAACCUCUGCC | 24 | 5768 |
| myoC-6023 | + | UGAGAAACUGUCACCUCC | 18 | 5769 |
| myoC-6024 | + | AUGAGAAACUGUCACCUCC | 19 | 5770 |
| myoC-2135 | + | CAUGAGAAACUGUCACCUCC | 20 | 2253 |
| myoC-6025 | + | CCAUGAGAAACUGUCACCUCC | 21 | 5771 |
| myoC-6026 | + | UCCAUGAGAAACUGUCACCUCC | 22 | 5772 |
| myoC-6027 | + | UUCCAUGAGAAACUGUCACCUCC | 23 | 5773 |
| myoC-6028 | + | CUUCCAUGAGAAACUGUCACCUCC | 24 | 5774 |
| myoC-3291 | + | UGGUGGAGGAGGCUCUCC | 18 | 3037 |
| myoC-3292 | + | UUGGUGGAGGAGGCUCUCC | 19 | 3038 |
| myoC-222 | + | AUUGGUGGAGGAGGCUCUCC | 20 | 608 |
| myoC-3293 | + | AAUUGGUGGAGGAGGCUCUCC | 21 | 3039 |
| myoC-3294 | + | CAAUUGGUGGAGGAGGCUCUCC | 22 | 3040 |
| myoC-3295 | + | UCAAUUGGUGGAGGAGGCUCUCC | 23 | 3041 |
| myoC-3296 | + | GUCAAUUGGUGGAGGAGGCUCUCC | 24 | 3042 |
| myoC-3297 | + | AGCCCCUCCUGGGUCUCC | 18 | 3043 |
| myoC-3298 | + | CAGCCCCUCCUGGGUCUCC | 19 | 3044 |
| myoC-119 | + | GCAGCCCCUCCUGGGUCUCC | 20 | 518 |
| myoC-3299 | + | UGCAGCCCCUCCUGGGUCUCC | 21 | 3045 |
| myoC-3300 | + | CUGCAGCCCCUCCUGGGUCUCC | 22 | 3046 |
| myoC-3301 | + | UCUGCAGCCCCUCCUGGGUCUCC | 23 | 3047 |
| myoC-3302 | + | CUCUGCAGCCCCUCCUGGGUCUCC | 24 | 3048 |

TABLE 10D-continued

| 4th Tier | | | | |
|---|---|---|---|---|
| gRNA Name | DNA Strand | Targeting Domain | Target Site Length | Seq ID |
| myoC-6029 | + | UUCUUCUGCACGUCUUCC | 18 | 5775 |
| myoC-6030 | + | UUUCUUCUGCACGUCUUCC | 19 | 5776 |
| myoC-2137 | + | UUUUCUUCUGCACGUCUUCC | 20 | 2255 |
| myoC-6031 | + | AUUUUCUUCUGCACGUCUUCC | 21 | 5777 |
| myoC-6032 | + | AAUUUUCUUCUGCACGUCUUCC | 22 | 5778 |
| myoC-6033 | + | UAAUUUUCUUCUGCACGUCUUCC | 23 | 5779 |
| myoC-6034 | + | UUAAUUUUCUUCUGCACGUCUUCC | 24 | 5780 |
| myoC-6035 | + | UUGCAGGGCUCCCCCAGC | 18 | 5781 |
| myoC-6036 | + | CUUGCAGGGCUCCCCCAGC | 19 | 5782 |
| myoC-746 | + | GCUUGCAGGGCUCCCCCAGC | 20 | 1012 |
| myoC-6037 | + | UGCUUGCAGGGCUCCCCCAGC | 21 | 5783 |
| myoC-6038 | + | GUGCUUGCAGGGCUCCCCCAGC | 22 | 5784 |
| myoC-6039 | + | GGUGCUUGCAGGGCUCCCCCAGC | 23 | 5785 |
| myoC-6040 | + | GGGUGCUUGCAGGGCUCCCCCAGC | 24 | 5786 |
| myoC-6041 | + | AGAAAAAUAACAGCCAGC | 18 | 5787 |
| myoC-6042 | + | GAGAAAAAUAACAGCCAGC | 19 | 5788 |
| myoC-2313 | + | AGAGAAAAAUAACAGCCAGC | 20 | 2382 |
| myoC-6043 | + | CAGAGAAAAAUAACAGCCAGC | 21 | 5789 |
| myoC-6044 | + | ACAGAGAAAAAUAACAGCCAGC | 22 | 5790 |
| myoC-6045 | + | GACAGAGAAAAAUAACAGCCAGC | 23 | 5791 |
| myoC-6046 | + | GGACAGAGAAAAAUAACAGCCAGC | 24 | 5792 |
| myoC-6047 | + | GGGCACGAUGGAGGCAGC | 18 | 5793 |
| myoC-6048 | + | CGGGCACGAUGGAGGCAGC | 19 | 5794 |
| myoC-713 | + | CCGGGCACGAUGGAGGCAGC | 20 | 1102 |
| myoC-6049 | + | UCCGGGCACGAUGGAGGCAGC | 21 | 5795 |
| myoC-6050 | + | CUCCGGGCACGAUGGAGGCAGC | 22 | 5796 |
| myoC-6051 | + | CCUCCGGGCACGAUGGAGGCAGC | 23 | 5797 |
| myoC-6052 | + | GCCUCCGGGCACGAUGGAGGCAGC | 24 | 5798 |
| myoC-6053 | + | CCAUUUCCUUUCUGGAGC | 18 | 5799 |
| myoC-6054 | + | UCCAUUUCCUUUCUGGAGC | 19 | 5800 |
| myoC-2170 | + | CUCCAUUUCCUUUCUGGAGC | 20 | 2274 |
| myoC-6055 | + | UCUCCAUUUCCUUUCUGGAGC | 21 | 5801 |
| myoC-6056 | + | CUCUCCAUUUCCUUUCUGGAGC | 22 | 5802 |
| myoC-6057 | + | CCUCUCCAUUUCCUUUCUGGAGC | 23 | 5803 |
| myoC-6058 | + | CCCUCUCCAUUUCCUUUCUGGAGC | 24 | 5804 |
| myoC-6059 | + | AGUCCUUUAAGACGUAGC | 18 | 5805 |
| myoC-6060 | + | AAGUCCUUUAAGACGUAGC | 19 | 5806 |

TABLE 10D-continued

| 4th Tier | | | | |
|---|---|---|---|---|
| gRNA Name | DNA Strand | Targeting Domain | Target Site Length | Seq ID |
| myoC-893 | + | CAAGUCCUUUAAGACGUAGC | 20 | 1187 |
| myoC-6061 | + | ACAAGUCCUUUAAGACGUAGC | 21 | 5807 |
| myoC-6062 | + | AACAAGUCCUUUAAGACGUAGC | 22 | 5808 |
| myoC-6063 | + | AAACAAGUCCUUUAAGACGUAGC | 23 | 5809 |
| myoC-6064 | + | CAAACAAGUCCUUUAAGACGUAGC | 24 | 5810 |
| myoC-6065 | + | GGAGGCAGCAGGGGGCGC | 18 | 5811 |
| myoC-6066 | + | UGGAGGCAGCAGGGGGCGC | 19 | 5812 |
| myoC-2143 | + | AUGGAGGCAGCAGGGGGCGC | 20 | 2258 |
| myoC-6067 | + | GAUGGAGGCAGCAGGGGGCGC | 21 | 5813 |
| myoC-6068 | + | CGAUGGAGGCAGCAGGGGGCGC | 22 | 5814 |
| myoC-6069 | + | ACGAUGGAGGCAGCAGGGGGCGC | 23 | 5815 |
| myoC-6070 | + | CACGAUGGAGGCAGCAGGGGGCGC | 24 | 5816 |
| myoC-3303 | + | AUCCCACACCAGGCAGGC | 18 | 3049 |
| myoC-3304 | + | CAUCCCACACCAGGCAGGC | 19 | 3050 |
| myoC-1668 | + | ACAUCCCACACCAGGCAGGC | 20 | 1930 |
| myoC-3305 | + | CACAUCCCACACCAGGCAGGC | 21 | 3051 |
| myoC-3306 | + | CCACAUCCCACACCAGGCAGGC | 22 | 3052 |
| myoC-3307 | + | CCCACAUCCCACACCAGGCAGGC | 23 | 3053 |
| myoC-3308 | + | CCCCACAUCCCACACCAGGCAGGC | 24 | 3054 |
| myoC-6071 | + | ACUGAUGGAGGAGGAGGC | 18 | 5817 |
| myoC-6072 | + | GACUGAUGGAGGAGGAGGC | 19 | 5818 |
| myoC-2155 | + | UGACUGAUGGAGGAGGAGGC | 20 | 2264 |
| myoC-6073 | + | GUGACUGAUGGAGGAGGAGGC | 21 | 5819 |
| myoC-6074 | + | UGUGACUGAUGGAGGAGGAGGC | 22 | 5820 |
| myoC-6075 | + | CUGUGACUGAUGGAGGAGGAGGC | 23 | 5821 |
| myoC-6076 | + | GCUGUGACUGAUGGAGGAGGAGGC | 24 | 5822 |
| myoC-6077 | + | GGCUUGGAAGACUCGGGC | 18 | 5823 |
| myoC-6078 | + | AGGCUUGGAAGACUCGGGC | 19 | 5824 |
| myoC-2152 | + | GAGGCUUGGAAGACUCGGGC | 20 | 2262 |
| myoC-6079 | + | GGAGGCUUGGAAGACUCGGGC | 21 | 5825 |
| myoC-6080 | + | AGGAGGCUUGGAAGACUCGGGC | 22 | 5826 |
| myoC-6081 | + | GAGGAGGCUUGGAAGACUCGGGC | 23 | 5827 |
| myoC-6082 | + | GGAGGAGGCUUGGAAGACUCGGGC | 24 | 5828 |
| myoC-6083 | + | AACAAAACAACCAGUGGC | 18 | 5829 |
| myoC-6084 | + | UAACAAAACAACCAGUGGC | 19 | 5830 |
| myoC-2124 | + | AUAACAAAACAACCAGUGGC | 20 | 2242 |
| myoC-6085 | + | GAUAACAAAACAACCAGUGGC | 21 | 5831 |
| myoC-6086 | + | UGAUAACAAAACAACCAGUGGC | 22 | 5832 |

TABLE 10D-continued

| 4th Tier | | | | |
|---|---|---|---|---|
| gRNA Name | DNA Strand | Targeting Domain | Target Site Length | Seq ID |
| myoC-6087 | + | GUGAUAACAAAACAACCAGUGGC | 23 | 5833 |
| myoC-6088 | + | AGUGAUAACAAAACAACCAGUGGC | 24 | 5834 |
| myoC-6089 | + | GGCCUUGCUGGCUCAUGC | 18 | 5835 |
| myoC-6090 | + | UGGCCUUGCUGGCUCAUGC | 19 | 5836 |
| myoC-2351 | + | GUGGCCUUGCUGGCUCAUGC | 20 | 2405 |
| myoC-6091 | + | GGUGGCCUUGCUGGCUCAUGC | 21 | 5837 |
| myoC-6092 | + | GGGUGGCCUUGCUGGCUCAUGC | 22 | 5838 |
| myoC-6093 | + | UGGGUGGCCUUGCUGGCUCAUGC | 23 | 5839 |
| myoC-6094 | + | AUGGGUGGCCUUGCUGGCUCAUGC | 24 | 5840 |
| myoC-6095 | + | CUGUGCCAGGCACUAUGC | 18 | 5841 |
| myoC-6096 | + | ACUGUGCCAGGCACUAUGC | 19 | 5842 |
| myoC-2321 | + | CACUGUGCCAGGCACUAUGC | 20 | 2387 |
| myoC-6097 | + | GCACUGUGCCAGGCACUAUGC | 21 | 5843 |
| myoC-6098 | + | UGCACUGUGCCAGGCACUAUGC | 22 | 5844 |
| myoC-6099 | + | CUGCACUGUGCCAGGCACUAUGC | 23 | 5845 |
| myoC-6100 | + | CCUGCACUGUGCCAGGCACUAUGC | 24 | 5846 |
| myoC-6101 | + | UGGAGAGGAAACCUCUGC | 18 | 5847 |
| myoC-6102 | + | CUGGAGAGGAAACCUCUGC | 19 | 5848 |
| myoC-748 | + | GCUGGAGAGGAAACCUCUGC | 20 | 1010 |
| myoC-6103 | + | AGCUGGAGAGGAAACCUCUGC | 21 | 5849 |
| myoC-6104 | + | CAGCUGGAGAGGAAACCUCUGC | 22 | 5850 |
| myoC-6105 | + | CCAGCUGGAGAGGAAACCUCUGC | 23 | 5851 |
| myoC-6106 | + | CCCAGCUGGAGAGGAAACCUCUGC | 24 | 5852 |
| myoC-6107 | + | CCCUGCAGUCCCCACCUC | 18 | 5853 |
| myoC-6108 | + | UCCCUGCAGUCCCCACCUC | 19 | 5854 |
| myoC-2180 | + | CUCCCUGCAGUCCCCACCUC | 20 | 2280 |
| myoC-6109 | + | ACUCCCUGCAGUCCCCACCUC | 21 | 5855 |
| myoC-6110 | + | CACUCCCUGCAGUCCCCACCUC | 22 | 5856 |
| myoC-6111 | + | CCACUCCCUGCAGUCCCCACCUC | 23 | 5857 |
| myoC-6112 | + | CCCACUCCCUGCAGUCCCCACCUC | 24 | 5858 |
| myoC-3309 | + | GCUUGGUGAGGCUUCCUC | 18 | 3055 |
| myoC-3310 | + | GGCUUGGUGAGGCUUCCUC | 19 | 3056 |
| myoC-2356 | + | AGGCUUGGUGAGGCUUCCUC | 20 | 2410 |
| myoC-3311 | + | GAGGCUUGGUGAGGCUUCCUC | 21 | 3057 |
| myoC-3312 | + | AGAGGCUUGGUGAGGCUUCCUC | 22 | 3058 |
| myoC-3313 | + | CAGAGGCUUGGUGAGGCUUCCUC | 23 | 3059 |
| myoC-3314 | + | GCAGAGGCUUGGUGAGGCUUCCUC | 24 | 3060 |

TABLE 10D-continued

| 4th Tier | | | | |
|---|---|---|---|---|
| gRNA Name | DNA Strand | Targeting Domain | Target Site Length | Seq ID |
| myoC-3315 | + | UCGCUUCUUCUCUUCCUC | 18 | 3061 |
| myoC-3316 | + | GUCGCUUCUUCUCUUCCUC | 19 | 3062 |
| myoC-1696 | + | AGUCGCUUCUUCUCUUCCUC | 20 | 1950 |
| myoC-3317 | + | UAGUCGCUUCUUCUCUUCCUC | 21 | 3063 |
| myoC-3318 | + | UUAGUCGCUUCUUCUCUUCCUC | 22 | 3064 |
| myoC-3319 | + | CUUAGUCGCUUCUUCUCUUCCUC | 23 | 3065 |
| myoC-3320 | + | CCUUAGUCGCUUCUUCUCUUCCUC | 24 | 3066 |
| myoC-6113 | + | UGGCUCAUGCCCGAGCUC | 18 | 5859 |
| myoC-6114 | + | CUGGCUCAUGCCCGAGCUC | 19 | 5860 |
| myoC-2350 | + | GCUGGCUCAUGCCCGAGCUC | 20 | 2404 |
| myoC-6115 | + | UGCUGGCUCAUGCCCGAGCUC | 21 | 5861 |
| myoC-6116 | + | UUGCUGGCUCAUGCCCGAGCUC | 22 | 5862 |
| myoC-6117 | + | CUUGCUGGCUCAUGCCCGAGCUC | 23 | 5863 |
| myoC-6118 | + | CCUUGCUGGCUCAUGCCCGAGCUC | 24 | 5864 |
| myoC-3321 | + | UUGGUGGAGGAGGCUCUC | 18 | 3067 |
| myoC-3322 | + | AUUGGUGGAGGAGGCUCUC | 19 | 3068 |
| myoC-1682 | + | AAUUGGUGGAGGAGGCUCUC | 20 | 1941 |
| myoC-3323 | + | CAAUUGGUGGAGGAGGCUCUC | 21 | 3069 |
| myoC-3324 | + | UCAAUUGGUGGAGGAGGCUCUC | 22 | 3070 |
| myoC-3325 | + | GUCAAUUGGUGGAGGAGGCUCUC | 23 | 3071 |
| myoC-3326 | + | GGUCAAUUGGUGGAGGAGGCUCUC | 24 | 3072 |
| myoC-3327 | + | CAGCCCCUCCUGGGUCUC | 18 | 3073 |
| myoC-3328 | + | GCAGCCCCUCCUGGGUCUC | 19 | 3074 |
| myoC-1688 | + | UGCAGCCCCUCCUGGGUCUC | 20 | 1944 |
| myoC-3329 | + | CUGCAGCCCCUCCUGGGUCUC | 21 | 3075 |
| myoC-3330 | + | UCUGCAGCCCCUCCUGGGUCUC | 22 | 3076 |
| myoC-3331 | + | CUCUGCAGCCCCUCCUGGGUCUC | 23 | 3077 |
| myoC-3332 | + | CCUCUGCAGCCCCUCCUGGGUCUC | 24 | 3078 |
| myoC-6119 | + | CCACCUCCUGGAAUUCUC | 18 | 5865 |
| myoC-6120 | + | CCCACCUCCUGGAAUUCUC | 19 | 5866 |
| myoC-2178 | + | CCCCACCUCCUGGAAUUCUC | 20 | 2279 |
| myoC-6121 | + | UCCCCACCUCCUGGAAUUCUC | 21 | 5867 |
| myoC-6122 | + | GUCCCCACCUCCUGGAAUUCUC | 22 | 5868 |
| myoC-6123 | + | AGUCCCCACCUCCUGGAAUUCUC | 23 | 5869 |
| myoC-6124 | + | CAGUCCCCACCUCCUGGAAUUCUC | 24 | 5870 |
| myoC-3333 | + | CUCCAGAACUGACUUGUC | 18 | 3079 |
| myoC-3334 | + | CCUCCAGAACUGACUUGUC | 19 | 3080 |
| myoC-1695 | + | UCCUCCAGAACUGACUUGUC | 20 | 1949 |

TABLE 10D-continued

| 4th Tier | | | | |
|---|---|---|---|---|
| gRNA Name | DNA Strand | Targeting Domain | Target Site Length | Seq ID |
| myoC-3335 | + | UUCCUCCAGAACUGACUUGUC | 21 | 3081 |
| myoC-3336 | + | CUUCCUCCAGAACUGACUUGUC | 22 | 3082 |
| myoC-3337 | + | UCUUCCUCCAGAACUGACUUGUC | 23 | 3083 |
| myoC-3338 | + | CUCUUCCUCCAGAACUGACUUGUC | 24 | 3084 |
| myoC-6125 | + | GAUGCACCAGGACGAUUC | 18 | 5871 |
| myoC-6126 | + | AGAUGCACCAGGACGAUUC | 19 | 5872 |
| myoC-2165 | + | CAGAUGCACCAGGACGAUUC | 20 | 2271 |
| myoC-6127 | + | UCAGAUGCACCAGGACGAUUC | 21 | 5873 |
| myoC-6128 | + | CUCAGAUGCACCAGGACGAUUC | 22 | 5874 |
| myoC-6129 | + | GCUCAGAUGCACCAGGACGAUUC | 23 | 5875 |
| myoC-6130 | + | AGCUCAGAUGCACCAGGACGAUUC | 24 | 5876 |
| myoC-6131 | + | UCUUAGAAAAUAACCUUC | 18 | 5877 |
| myoC-6132 | + | UUCUUAGAAAAUAACCUUC | 19 | 5878 |
| myoC-2329 | + | AUUCUUAGAAAAUAACCUUC | 20 | 2394 |
| myoC-6133 | + | GAUUCUUAGAAAAUAACCUUC | 21 | 5879 |
| myoC-6134 | + | AGAUUCUUAGAAAAUAACCUUC | 22 | 5880 |
| myoC-6135 | + | AAGAUUCUUAGAAAAUAACCUUC | 23 | 5881 |
| myoC-6136 | + | CAAGAUUCUUAGAAAAUAACCUUC | 24 | 5882 |
| myoC-6137 | + | CUGGGGAGCCAGCCCUUC | 18 | 5883 |
| myoC-6138 | + | ACUGGGGAGCCAGCCCUUC | 19 | 5884 |
| myoC-2344 | + | UACUGGGGAGCCAGCCCUUC | 20 | 2401 |
| myoC-6139 | + | AUACUGGGGAGCCAGCCCUUC | 21 | 5885 |
| myoC-6140 | + | UAUACUGGGGAGCCAGCCCUUC | 22 | 5886 |
| myoC-6141 | + | AUAUACUGGGGAGCCAGCCCUUC | 23 | 5887 |
| myoC-6142 | + | UAUAUACUGGGGAGCCAGCCCUUC | 24 | 5888 |
| myoC-6143 | + | AUGAAACUGCAUCCCUUC | 18 | 5889 |
| myoC-6144 | + | UAUGAAACUGCAUCCCUUC | 19 | 5890 |
| myoC-2190 | + | UUAUGAAACUGCAUCCCUUC | 20 | 2288 |
| myoC-6145 | + | UUUAUGAAACUGCAUCCCUUC | 21 | 5891 |
| myoC-6146 | + | CUUUAUGAAACUGCAUCCCUUC | 22 | 5892 |
| myoC-6147 | + | ACUUUAUGAAACUGCAUCCCUUC | 23 | 5893 |
| myoC-6148 | + | GACUUUAUGAAACUGCAUCCCUUC | 24 | 5894 |
| myoC-6149 | + | CAUUAAAUAAAGGCCUUC | 18 | 5895 |
| myoC-6150 | + | CCAUUAAAUAAAGGCCUUC | 19 | 5896 |
| myoC-2196 | + | CCCAUUAAAUAAAGGCCUUC | 20 | 2292 |
| myoC-6151 | + | UCCCAUUAAAUAAAGGCCUUC | 21 | 5897 |
| myoC-6152 | + | UUCCCAUUAAAUAAAGGCCUUC | 22 | 5898 |

TABLE 10D-continued

| 4th Tier | | | | |
|---|---|---|---|---|
| gRNA Name | DNA Strand | Targeting Domain | Target Site Length | Seq ID |
| myoC-6153 | + | AUUCCCAUUAAAUAAAGGCCUUC | 23 | 5899 |
| myoC-6154 | + | UAUUCCCAUUAAAUAAAGGCCUUC | 24 | 5900 |
| myoC-3339 | + | CUCUGGUCAUUGGCCUUC | 18 | 3085 |
| myoC-3340 | + | ACUCUGGUCAUUGGCCUUC | 19 | 3086 |
| myoC-1670 | + | CACUCUGGUCAUUGGCCUUC | 20 | 1932 |
| myoC-3341 | + | CCACUCUGGUCAUUGGCCUUC | 21 | 3087 |
| myoC-3342 | + | GCCACUCUGGUCAUUGGCCUUC | 22 | 3088 |
| myoC-3343 | + | GGCCACUCUGGUCAUUGGCCUUC | 23 | 3089 |
| myoC-3344 | + | CGGCCACUCUGGUCAUUGGCCUUC | 24 | 3090 |
| myoC-6155 | + | CCCUCUCCAUUUCCUUUC | 18 | 5901 |
| myoC-6156 | + | UCCCUCUCCAUUUCCUUUC | 19 | 5902 |
| myoC-1113 | + | UUCCCUCUCCAUUUCCUUUC | 20 | 1413 |
| myoC-6157 | + | UUUCCCUCUCCAUUUCCUUUC | 21 | 5903 |
| myoC-6158 | + | GUUUCCCUCUCCAUUUCCUUUC | 22 | 5904 |
| myoC-6159 | + | AGUUUCCCUCUCCAUUUCCUUUC | 23 | 5905 |
| myoC-6160 | + | UAGUUUCCCUCUCCAUUUCCUUUC | 24 | 5906 |
| myoC-6161 | + | GACUUCUUCUCCUCCAAG | 18 | 5907 |
| myoC-6162 | + | AGACUUCUUCUCCUCCAAG | 19 | 5908 |
| myoC-2189 | + | UAGACUUCUUCUCCUCCAAG | 20 | 2287 |
| myoC-6163 | + | AUAGACUUCUUCUCCUCCAAG | 21 | 5909 |
| myoC-6164 | + | AAUAGACUUCUUCUCCUCCAAG | 22 | 5910 |
| myoC-6165 | + | AAAUAGACUUCUUCUCCUCCAAG | 23 | 5911 |
| myoC-6166 | + | GAAAUAGACUUCUUCUCCUCCAAG | 24 | 5912 |
| myoC-3345 | + | CUGCAGCAACGUGCACAG | 18 | 3091 |
| myoC-3346 | + | GCUGCAGCAACGUGCACAG | 19 | 3092 |
| myoC-1665 | + | AGCUGCAGCAACGUGCACAG | 20 | 1927 |
| myoC-3347 | + | AAGCUGCAGCAACGUGCACAG | 21 | 3093 |
| myoC-3348 | + | AAAGCUGCAGCAACGUGCACAG | 22 | 3094 |
| myoC-3349 | + | CAAAGCUGCAGCAACGUGCACAG | 23 | 3095 |
| myoC-3350 | + | CCAAAGCUGCAGCAACGUGCACAG | 24 | 3096 |
| myoC-6167 | + | CUUGCAGGGCUCCCCCAG | 18 | 5913 |
| myoC-6168 | + | GCUUGCAGGGCUCCCCCAG | 19 | 5914 |
| myoC-2119 | + | UGCUUGCAGGGCUCCCCCAG | 20 | 2237 |
| myoC-6169 | + | GUGCUUGCAGGGCUCCCCCAG | 21 | 5915 |
| myoC-6170 | + | GGUGCUUGCAGGGCUCCCCCAG | 22 | 5916 |
| myoC-6171 | + | GGGUGCUUGCAGGGCUCCCCCAG | 23 | 5917 |
| myoC-6172 | + | CGGGUGCUUGCAGGGCUCCCCCAG | 24 | 5918 |
| myoC-3351 | + | GCAGGCCAGAAGCAGCAG | 18 | 3097 |

TABLE 10D-continued

| 4th Tier | | | | |
|---|---|---|---|---|
| gRNA Name | DNA Strand | Targeting Domain | Target Site Length | Seq ID |
| myoC-3352 | + | GGCAGGCCAGAAGCAGCAG | 19 | 3098 |
| myoC-1667 | + | AGGCAGGCCAGAAGCAGCAG | 20 | 1929 |
| myoC-3353 | + | CAGGCAGGCCAGAAGCAGCAG | 21 | 3099 |
| myoC-3354 | + | CCAGGCAGGCCAGAAGCAGCAG | 22 | 3100 |
| myoC-3355 | + | ACCAGGCAGGCCAGAAGCAGCAG | 23 | 3101 |
| myoC-3356 | + | CACCAGGCAGGCCAGAAGCAGCAG | 24 | 3102 |
| myoC-6173 | + | CGGGCACGAUGGAGGCAG | 18 | 5919 |
| myoC-6174 | + | CCGGGCACGAUGGAGGCAG | 19 | 5920 |
| myoC-2146 | + | UCCGGGCACGAUGGAGGCAG | 20 | 2259 |
| myoC-6175 | + | CUCCGGGCACGAUGGAGGCAG | 21 | 5921 |
| myoC-6176 | + | CCUCCGGGCACGAUGGAGGCAG | 22 | 5922 |
| myoC-6177 | + | GCCUCCGGGCACGAUGGAGGCAG | 23 | 5923 |
| myoC-6178 | + | GGCCUCCGGGCACGAUGGAGGCAG | 24 | 5924 |
| myoC-6179 | + | GCGCUGUGACUGAUGGAG | 18 | 5925 |
| myoC-6180 | + | AGCGCUGUGACUGAUGGAG | 19 | 5926 |
| myoC-2157 | + | CAGCGCUGUGACUGAUGGAG | 20 | 2265 |
| myoC-6181 | + | GCAGCGCUGUGACUGAUGGAG | 21 | 5927 |
| myoC-6182 | + | UGCAGCGCUGUGACUGAUGGAG | 22 | 5928 |
| myoC-6183 | + | CUGCAGCGCUGUGACUGAUGGAG | 23 | 5929 |
| myoC-6184 | + | GCUGCAGCGCUGUGACUGAUGGAG | 24 | 5930 |
| myoC-6185 | + | GGGCUCCCCCAGCUGGAG | 18 | 5931 |
| myoC-6186 | + | AGGGCUCCCCCAGCUGGAG | 19 | 5932 |
| myoC-747 | + | CAGGGCUCCCCCAGCUGGAG | 20 | 1099 |
| myoC-6187 | + | GCAGGGCUCCCCCAGCUGGAG | 21 | 5933 |
| myoC-6188 | + | UGCAGGGCUCCCCCAGCUGGAG | 22 | 5934 |
| myoC-6189 | + | UUGCAGGGCUCCCCCAGCUGGAG | 23 | 5935 |
| myoC-6190 | + | CUUGCAGGGCUCCCCCAGCUGGAG | 24 | 5936 |
| myoC-3357 | + | GUCAUUGGCCUUCCUGAG | 18 | 3103 |
| myoC-3358 | + | GGUCAUUGGCCUUCCUGAG | 19 | 3104 |
| myoC-1669 | + | UGGUCAUUGGCCUUCCUGAG | 20 | 1931 |
| myoC-3359 | + | CUGGUCAUUGGCCUUCCUGAG | 21 | 3105 |
| myoC-3360 | + | UCUGGUCAUUGGCCUUCCUGAG | 22 | 3106 |
| myoC-3361 | + | CUCUGGUCAUUGGCCUUCCUGAG | 23 | 3107 |
| myoC-3362 | + | ACUCUGGUCAUUGGCCUUCCUGAG | 24 | 3108 |
| myoC-3363 | + | GCUCUCCAGGGAGCUGAG | 18 | 3109 |
| myoC-3364 | + | GGCUCUCCAGGGAGCUGAG | 19 | 3110 |
| myoC-1678 | + | AGGCUCUCCAGGGAGCUGAG | 20 | 1939 |

TABLE 10D-continued

| 4th Tier | | | | |
|---|---|---|---|---|
| gRNA Name | DNA Strand | Targeting Domain | Target Site Length | Seq ID |
| myoC-3365 | + | GAGGCUCUCCAGGGAGCUGAG | 21 | 3111 |
| myoC-3366 | + | GGAGGCUCUCCAGGGAGCUGAG | 22 | 3112 |
| myoC-3367 | + | AGGAGGCUCUCCAGGGAGCUGAG | 23 | 3113 |
| myoC-3368 | + | GAGGAGGCUCUCCAGGGAGCUGAG | 24 | 3114 |
| myoC-6191 | + | AAGUCCUUUAAGACGUAG | 18 | 5937 |
| myoC-6192 | + | CAAGUCCUUUAAGACGUAG | 19 | 5938 |
| myoC-2317 | + | ACAAGUCCUUUAAGACGUAG | 20 | 2385 |
| myoC-6193 | + | AACAAGUCCUUUAAGACGUAG | 21 | 5939 |
| myoC-6194 | + | AAACAAGUCCUUUAAGACGUAG | 22 | 5940 |
| myoC-6195 | + | CAAACAAGUCCUUUAAGACGUAG | 23 | 5941 |
| myoC-6196 | + | CCAAACAAGUCCUUUAAGACGUAG | 24 | 5942 |
| myoC-6197 | + | UGGGGGCCUCCGGGCACG | 18 | 5943 |
| myoC-6198 | + | UUGGGGGCCUCCGGGCACG | 19 | 5944 |
| myoC-2148 | + | CUUGGGGGCCUCCGGGCACG | 20 | 2260 |
| myoC-6199 | + | GCUUGGGGGCCUCCGGGCACG | 21 | 5945 |
| myoC-6200 | + | GGCUUGGGGGCCUCCGGGCACG | 22 | 5946 |
| myoC-6201 | + | GGGCUUGGGGGCCUCCGGGCACG | 23 | 5947 |
| myoC-6202 | + | CGGGCUUGGGGGCCUCCGGGCACG | 24 | 5948 |
| myoC-6203 | + | CUGGAAUUCUCCUGGACG | 18 | 5949 |
| myoC-6204 | + | CCUGGAAUUCUCCUGGACG | 19 | 5950 |
| myoC-1110 | + | UCCUGGAAUUCUCCUGGACG | 20 | 1410 |
| myoC-6205 | + | CUCCUGGAAUUCUCCUGGACG | 21 | 5951 |
| myoC-6206 | + | CCUCCUGGAAUUCUCCUGGACG | 22 | 5952 |
| myoC-6207 | + | ACCUCCUGGAAUUCUCCUGGACG | 23 | 5953 |
| myoC-6208 | + | CACCUCCUGGAAUUCUCCUGGACG | 24 | 5954 |
| myoC-3369 | + | CAGAACUGACUUGUCUCG | 18 | 3115 |
| myoC-3370 | + | CCAGAACUGACUUGUCUCG | 19 | 3116 |
| myoC-1693 | + | UCCAGAACUGACUUGUCUCG | 20 | 1948 |
| myoC-3371 | + | CUCCAGAACUGACUUGUCUCG | 21 | 3117 |
| myoC-3372 | + | CCUCCAGAACUGACUUGUCUCG | 22 | 3118 |
| myoC-3373 | + | UCCUCCAGAACUGACUUGUCUCG | 23 | 3119 |
| myoC-3374 | + | UUCCUCCAGAACUGACUUGUCUCG | 24 | 3120 |
| myoC-6209 | + | CUGUCACCUCCACGAAGG | 18 | 5955 |
| myoC-6210 | + | ACUGUCACCUCCACGAAGG | 19 | 5956 |
| myoC-2134 | + | AACUGUCACCUCCACGAAGG | 20 | 2252 |
| myoC-6211 | + | AAACUGUCACCUCCACGAAGG | 21 | 5957 |
| myoC-6212 | + | GAAACUGUCACCUCCACGAAGG | 22 | 5958 |
| myoC-6213 | + | AGAAACUGUCACCUCCACGAAGG | 23 | 5959 |

TABLE 10D-continued

| 4th Tier | | | | |
|---|---|---|---|---|
| gRNA Name | DNA Strand | Targeting Domain | Target Site Length | Seq ID |
| myoC-6214 | + | GAGAAACUGUCACCUCCACGAAGG | 24 | 5960 |
| myoC-6215 | + | CGCUGUGACUGAUGGAGG | 18 | 5961 |
| myoC-6216 | + | GCGCUGUGACUGAUGGAGG | 19 | 5962 |
| myoC-700 | + | AGCGCUGUGACUGAUGGAGG | 20 | 1088 |
| myoC-6217 | + | CAGCGCUGUGACUGAUGGAGG | 21 | 5963 |
| myoC-6218 | + | GCAGCGCUGUGACUGAUGGAGG | 22 | 5964 |
| myoC-6219 | + | UGCAGCGCUGUGACUGAUGGAGG | 23 | 5965 |
| myoC-6220 | + | CUGCAGCGCUGUGACUGAUGGAGG | 24 | 5966 |
| myoC-3375 | + | AGAACUGACUUGUCUCGG | 18 | 3121 |
| myoC-3376 | + | CAGAACUGACUUGUCUCGG | 19 | 3122 |
| myoC-209 | + | CCAGAACUGACUUGUCUCGG | 20 | 595 |
| myoC-3377 | + | UCCAGAACUGACUUGUCUCGG | 21 | 3123 |
| myoC-3378 | + | CUCCAGAACUGACUUGUCUCGG | 22 | 3124 |
| myoC-3379 | + | CCUCCAGAACUGACUUGUCUCGG | 23 | 3125 |
| myoC-3380 | + | UCCUCCAGAACUGACUUGUCUCGG | 24 | 3126 |
| myoC-6221 | + | UGGCCACGUGAGGCUGGG | 18 | 5967 |
| myoC-6222 | + | GUGGCCACGUGAGGCUGGG | 19 | 5968 |
| myoC-877 | + | GGUGGCCACGUGAGGCUGGG | 20 | 1053 |
| myoC-6223 | + | AGGUGGCCACGUGAGGCUGGG | 21 | 5969 |
| myoC-6224 | + | GAGGUGGCCACGUGAGGCUGGG | 22 | 5970 |
| myoC-6225 | + | AGAGGUGGCCACGUGAGGCUGGG | 23 | 5971 |
| myoC-6226 | + | CAGAGGUGGCCACGUGAGGCUGGG | 24 | 5972 |
| myoC-6227 | + | GGAGCCAGCCCUUCAUGG | 18 | 5973 |
| myoC-6228 | + | GGGAGCCAGCCCUUCAUGG | 19 | 5974 |
| myoC-871 | + | GGGGAGCCAGCCCUUCAUGG | 20 | 992 |
| myoC-6229 | + | UGGGGAGCCAGCCCUUCAUGG | 21 | 5975 |
| myoC-6230 | + | CUGGGGAGCCAGCCCUUCAUGG | 22 | 5976 |
| myoC-6231 | + | ACUGGGGAGCCAGCCCUUCAUGG | 23 | 5977 |
| myoC-6232 | + | UACUGGGGAGCCAGCCCUUCAUGG | 24 | 5978 |
| myoC-6233 | + | CAGCGCUGUGACUGAUGG | 18 | 5979 |
| myoC-6234 | + | GCAGCGCUGUGACUGAUGG | 19 | 5980 |
| myoC-699 | + | UGCAGCGCUGUGACUGAUGG | 20 | 1118 |
| myoC-6235 | + | CUGCAGCGCUGUGACUGAUGG | 21 | 5981 |
| myoC-6236 | + | GCUGCAGCGCUGUGACUGAUGG | 22 | 5982 |
| myoC-6237 | + | AGCUGCAGCGCUGUGACUGAUGG | 23 | 5983 |
| myoC-6238 | + | CAGCUGCAGCGCUGUGACUGAUGG | 24 | 5984 |
| myoC-6239 | + | GUGGCCACGUGAGGCUGG | 18 | 5985 |

TABLE 10D-continued

4th Tier

| gRNA Name | DNA Strand | Targeting Domain | Target Site Length | Seq ID |
|---|---|---|---|---|
| myoC-6240 | + | GGUGGCCACGUGAGGCUGG | 19 | 5986 |
| myoC-2336 | + | AGGUGGCCACGUGAGGCUGG | 20 | 2397 |
| myoC-6241 | + | GAGGUGGCCACGUGAGGCUGG | 21 | 5987 |
| myoC-6242 | + | AGAGGUGGCCACGUGAGGCUGG | 22 | 5988 |
| myoC-6243 | + | CAGAGGUGGCCACGUGAGGCUGG | 23 | 5989 |
| myoC-6244 | + | ACAGAGGUGGCCACGUGAGGCUGG | 24 | 5990 |
| myoC-3381 | + | UCCAAGGUCAAUUGGUGG | 18 | 3127 |
| myoC-3382 | + | GUCCAAGGUCAAUUGGUGG | 19 | 3128 |
| myoC-121 | + | GGUCCAAGGUCAAUUGGUGG | 20 | 520 |
| myoC-3383 | + | UGGUCCAAGGUCAAUUGGUGG | 21 | 3129 |
| myoC-3384 | + | CUGGUCCAAGGUCAAUUGGUGG | 22 | 3130 |
| myoC-3385 | + | CCUGGUCCAAGGUCAAUUGGUGG | 23 | 3131 |
| myoC-3386 | + | GCCUGGUCCAAGGUCAAUUGGUGG | 24 | 3132 |
| myoC-3387 | + | UGGUCCAAGGUCAAUUGG | 18 | 3133 |
| myoC-3388 | + | CUGGUCCAAGGUCAAUUGG | 19 | 3134 |
| myoC-220 | + | CCUGGUCCAAGGUCAAUUGG | 20 | 606 |
| myoC-3389 | + | GCCUGGUCCAAGGUCAAUUGG | 21 | 3135 |
| myoC-3390 | + | AGCCUGGUCCAAGGUCAAUUGG | 22 | 3136 |
| myoC-3391 | + | CAGCCUGGUCCAAGGUCAAUUGG | 23 | 3137 |
| myoC-3392 | + | GCAGCCUGGUCCAAGGUCAAUUGG | 24 | 3138 |
| myoC-6245 | + | GGGAGCCAGCCCUUCAUG | 18 | 5991 |
| myoC-6246 | + | GGGGAGCCAGCCCUUCAUG | 19 | 5992 |
| myoC-870 | + | UGGGGAGCCAGCCCUUCAUG | 20 | 1213 |
| myoC-6247 | + | CUGGGGAGCCAGCCCUUCAUG | 21 | 5993 |
| myoC-6248 | + | ACUGGGGAGCCAGCCCUUCAUG | 22 | 5994 |
| myoC-6249 | + | UACUGGGGAGCCAGCCCUUCAUG | 23 | 5995 |
| myoC-6250 | + | AUACUGGGGAGCCAGCCCUUCAUG | 24 | 5996 |
| myoC-6251 | + | GCAGCGCUGUGACUGAUG | 18 | 5997 |
| myoC-6252 | + | UGCAGCGCUGUGACUGAUG | 19 | 5998 |
| myoC-2159 | + | CUGCAGCGCUGUGACUGAUG | 20 | 2266 |
| myoC-6253 | + | GCUGCAGCGCUGUGACUGAUG | 21 | 5999 |
| myoC-6254 | + | AGCUGCAGCGCUGUGACUGAUG | 22 | 6000 |
| myoC-6255 | + | CAGCUGCAGCGCUGUGACUGAUG | 23 | 6001 |
| myoC-6256 | + | CCAGCUGCAGCGCUGUGACUGAUG | 24 | 6002 |
| myoC-6257 | + | GCUGCAGCGCUGUGACUG | 18 | 6003 |
| myoC-6258 | + | AGCUGCAGCGCUGUGACUG | 19 | 6004 |
| myoC-2161 | + | CAGCUGCAGCGCUGUGACUG | 20 | 2267 |
| myoC-6259 | + | CCAGCUGCAGCGCUGUGACUG | 21 | 6005 |

TABLE 10D-continued

| 4th Tier | | | | |
|---|---|---|---|---|
| gRNA Name | DNA Strand | Targeting Domain | Target Site Length | Seq ID |
| myoC-6260 | + | GCCAGCUGCAGCGCUGUGACUG | 22 | 6006 |
| myoC-6261 | + | GGCCAGCUGCAGCGCUGUGACUG | 23 | 6007 |
| myoC-6262 | + | AGGCCAGCUGCAGCGCUGUGACUG | 24 | 6008 |
| myoC-6263 | + | AGAGGUUUAUAUAUACUG | 18 | 6009 |
| myoC-6264 | + | GAGAGGUUUAUAUAUACUG | 19 | 6010 |
| myoC-867 | + | AGAGAGGUUUAUAUAUACUG | 20 | 1180 |
| myoC-6265 | + | CAGAGAGGUUUAUAUAUACUG | 21 | 6011 |
| myoC-6266 | + | CCAGAGAGGUUUAUAUAUACUG | 22 | 6012 |
| myoC-6267 | + | UCCAGAGAGGUUUAUAUAUACUG | 23 | 6013 |
| myoC-6268 | + | CUCCAGAGAGGUUUAUAUAUACUG | 24 | 6014 |
| myoC-6269 | + | GCAGGGCUCCCCCAGCUG | 18 | 6015 |
| myoC-6270 | + | UGCAGGGCUCCCCCAGCUG | 19 | 6016 |
| myoC-2117 | + | UUGCAGGGCUCCCCCAGCUG | 20 | 2236 |
| myoC-6271 | + | CUUGCAGGGCUCCCCCAGCUG | 21 | 6017 |
| myoC-6272 | + | GCUUGCAGGGCUCCCCCAGCUG | 22 | 6018 |
| myoC-6273 | + | UGCUUGCAGGGCUCCCCCAGCUG | 23 | 6019 |
| myoC-6274 | + | GUGCUUGCAGGGCUCCCCCAGCUG | 24 | 6020 |
| myoC-6275 | + | CUGGAGAGGAAACCUCUG | 18 | 6021 |
| myoC-6276 | + | GCUGGAGAGGAAACCUCUG | 19 | 6022 |
| myoC-2114 | + | AGCUGGAGAGGAAACCUCUG | 20 | 2234 |
| myoC-6277 | + | CAGCUGGAGAGGAAACCUCUG | 21 | 6023 |
| myoC-6278 | + | CCAGCUGGAGAGGAAACCUCUG | 22 | 6024 |
| myoC-6279 | + | CCCAGCUGGAGAGGAAACCUCUG | 23 | 6025 |
| myoC-6280 | + | CCCCAGCUGGAGAGGAAACCUCUG | 24 | 6026 |
| myoC-6281 | + | GAGGCCCCUUUCCCUCUG | 18 | 6027 |
| myoC-6282 | + | GGAGGCCCCUUUCCCUCUG | 19 | 6028 |
| myoC-1112 | + | UGGAGGCCCCUUUCCCUCUG | 20 | 1412 |
| myoC-6283 | + | GUGGAGGCCCCUUUCCCUCUG | 21 | 6029 |
| myoC-6284 | + | CGUGGAGGCCCCUUUCCCUCUG | 22 | 6030 |
| myoC-6285 | + | ACGUGGAGGCCCCUUUCCCUCUG | 23 | 6031 |
| myoC-6286 | + | GACGUGGAGGCCCCUUUCCCUCUG | 24 | 6032 |
| myoC-6287 | + | UAAAUAAAGGCCUUCGUG | 18 | 6033 |
| myoC-6288 | + | UUAAAUAAAGGCCUUCGUG | 19 | 6034 |
| myoC-2195 | + | AUUAAAUAAAGGCCUUCGUG | 20 | 2291 |
| myoC-6289 | + | CAUUAAAUAAAGGCCUUCGUG | 21 | 6035 |
| myoC-6290 | + | CCAUUAAAUAAAGGCCUUCGUG | 22 | 6036 |
| myoC-6291 | + | CCCAUUAAAUAAAGGCCUUCGUG | 23 | 6037 |

TABLE 10D-continued

| 4th Tier | | | | |
|---|---|---|---|---|
| gRNA Name | DNA Strand | Targeting Domain | Target Site Length | Seq ID |
| myoC-6292 | + | UCCCAUUAAAUAAAGGCCUUCGUG | 24 | 6038 |
| myoC-3393 | + | GUCCAAGGUCAAUUGGUG | 18 | 3139 |
| myoC-3394 | + | GGUCCAAGGUCAAUUGGUG | 19 | 3140 |
| myoC-1684 | + | UGGUCCAAGGUCAAUUGGUG | 20 | 1942 |
| myoC-3395 | + | CUGGUCCAAGGUCAAUUGGUG | 21 | 3141 |
| myoC-3396 | + | CCUGGUCCAAGGUCAAUUGGUG | 22 | 3142 |
| myoC-3397 | + | GCCUGGUCCAAGGUCAAUUGGUG | 23 | 3143 |
| myoC-3398 | + | AGCCUGGUCCAAGGUCAAUUGGUG | 24 | 3144 |
| myoC-6293 | + | CUGGAAAGCUCUGCUGUG | 18 | 6039 |
| myoC-6294 | + | UCUGGAAAGCUCUGCUGUG | 19 | 6040 |
| myoC-2355 | + | CUCUGGAAAGCUCUGCUGUG | 20 | 2409 |
| myoC-6295 | + | CCUCUGGAAAGCUCUGCUGUG | 21 | 6041 |
| myoC-6296 | + | UCCUCUGGAAAGCUCUGCUGUG | 22 | 6042 |
| myoC-6297 | + | UUCCUCUGGAAAGCUCUGCUGUG | 23 | 6043 |
| myoC-6298 | + | CUUCCUCUGGAAAGCUCUGCUGUG | 24 | 6044 |
| myoC-3399 | + | CUGGUCCAAGGUCAAUUG | 18 | 3145 |
| myoC-3400 | + | CCUGGUCCAAGGUCAAUUG | 19 | 3146 |
| myoC-1686 | + | GCCUGGUCCAAGGUCAAUUG | 20 | 1943 |
| myoC-3401 | + | AGCCUGGUCCAAGGUCAAUUG | 21 | 3147 |
| myoC-3402 | + | CAGCCUGGUCCAAGGUCAAUUG | 22 | 3148 |
| myoC-3403 | + | GCAGCCUGGUCCAAGGUCAAUUG | 23 | 3149 |
| myoC-3404 | + | GGCAGCCUGGUCCAAGGUCAAUUG | 24 | 3150 |
| myoC-3405 | + | CACAGAAGAACCUCAUUG | 18 | 3151 |
| myoC-3406 | + | GCACAGAAGAACCUCAUUG | 19 | 3152 |
| myoC-1664 | + | UGCACAGAAGAACCUCAUUG | 20 | 1926 |
| myoC-3407 | + | GUGCACAGAAGAACCUCAUUG | 21 | 3153 |
| myoC-3408 | + | CGUGCACAGAAGAACCUCAUUG | 22 | 3154 |
| myoC-3409 | + | ACGUGCACAGAAGAACCUCAUUG | 23 | 3155 |
| myoC-3410 | + | AACGUGCACAGAAGAACCUCAUUG | 24 | 3156 |
| myoC-3411 | + | CCUCAUUGCAGAGGCUUG | 18 | 3157 |
| myoC-3412 | + | ACCUCAUUGCAGAGGCUUG | 19 | 3158 |
| myoC-1663 | + | AACCUCAUUGCAGAGGCUUG | 20 | 1925 |
| myoC-3413 | + | GAACCUCAUUGCAGAGGCUUG | 21 | 3159 |
| myoC-3414 | + | AGAACCUCAUUGCAGAGGCUUG | 22 | 3160 |
| myoC-3415 | + | AAGAACCUCAUUGCAGAGGCUUG | 23 | 3161 |
| myoC-3416 | + | GAAGAACCUCAUUGCAGAGGCUUG | 24 | 3162 |
| myoC-6299 | + | CAGGACCCCGGGUGCUUG | 18 | 6045 |
| myoC-6300 | + | CCAGGACCCCGGGUGCUUG | 19 | 6046 |

TABLE 10D-continued

4th Tier

| gRNA Name | DNA Strand | Targeting Domain | Target Site Length | Seq ID |
|---|---|---|---|---|
| myoC-2120 | + | CCCAGGACCCCGGGUGCUUG | 20 | 2238 |
| myoC-6301 | + | ACCCAGGACCCCGGGUGCUUG | 21 | 6047 |
| myoC-6302 | + | CACCCAGGACCCCGGGUGCUUG | 22 | 6048 |
| myoC-6303 | + | ACACCCAGGACCCCGGGUGCUUG | 23 | 6049 |
| myoC-6304 | + | GACACCCAGGACCCCGGGUGCUUG | 24 | 6050 |
| myoC-6305 | + | GUGAACAACACUGAACAU | 18 | 6051 |
| myoC-6306 | + | CGUGAACAACACUGAACAU | 19 | 6052 |
| myoC-2181 | + | CCGUGAACAACACUGAACAU | 20 | 2281 |
| myoC-6307 | + | CCCGUGAACAACACUGAACAU | 21 | 6053 |
| myoC-6308 | + | CCCCGUGAACAACACUGAACAU | 22 | 6054 |
| myoC-6309 | + | GCCCCGUGAACAACACUGAACAU | 23 | 6055 |
| myoC-6310 | + | AGCCCCGUGAACAACACUGAACAU | 24 | 6056 |
| myoC-6311 | + | CUUCUGCACGUCUUCCAU | 18 | 6057 |
| myoC-6312 | + | UCUUCUGCACGUCUUCCAU | 19 | 6058 |
| myoC-2136 | + | UUCUUCUGCACGUCUUCCAU | 20 | 2254 |
| myoC-6313 | + | UUUCUUCUGCACGUCUUCCAU | 21 | 6059 |
| myoC-6314 | + | UUUUCUUCUGCACGUCUUCCAU | 22 | 6060 |
| myoC-6315 | + | AUUUUCUUCUGCACGUCUUCCAU | 23 | 6061 |
| myoC-6316 | + | AAUUUUCUUCUGCACGUCUUCCAU | 24 | 6062 |
| myoC-3417 | + | CUGGGCAGCUGGAUUCAU | 18 | 3163 |
| myoC-3418 | + | UCUGGGCAGCUGGAUUCAU | 19 | 3164 |
| myoC-231 | + | CUCUGGGCAGCUGGAUUCAU | 20 | 617 |
| myoC-3419 | + | GCUCUGGGCAGCUGGAUUCAU | 21 | 3165 |
| myoC-3420 | + | UGCUCUGGGCAGCUGGAUUCAU | 22 | 3166 |
| myoC-3421 | + | CUGCUCUGGGCAGCUGGAUUCAU | 23 | 3167 |
| myoC-3422 | + | UCUGCUCUGGGCAGCUGGAUUCAU | 24 | 3168 |
| myoC-6317 | + | GGGGAGCCAGCCCUUCAU | 18 | 6063 |
| myoC-6318 | + | UGGGGAGCCAGCCCUUCAU | 19 | 6064 |
| myoC-869 | + | CUGGGGAGCCAGCCCUUCAU | 20 | 1204 |
| myoC-6319 | + | ACUGGGGAGCCAGCCCUUCAU | 21 | 6065 |
| myoC-6320 | + | UACUGGGGAGCCAGCCCUUCAU | 22 | 6066 |
| myoC-6321 | + | AUACUGGGGAGCCAGCCCUUCAU | 23 | 6067 |
| myoC-6322 | + | UAUACUGGGGAGCCAGCCCUUCAU | 24 | 6068 |
| myoC-6323 | + | GAGAGGUUUAUAUAUACU | 18 | 6069 |
| myoC-6324 | + | AGAGAGGUUUAUAUAUACU | 19 | 6070 |
| myoC-866 | + | CAGAGAGGUUUAUAUAUACU | 20 | 1191 |
| myoC-6325 | + | CCAGAGAGGUUUAUAUAUACU | 21 | 6071 |

TABLE 10D-continued

| 4th Tier | | | | |
|---|---|---|---|---|
| gRNA Name | DNA Strand | Targeting Domain | Target Site Length | Seq ID |
| myoC-6326 | + | UCCAGAGAGGUUUAUAUAUACU | 22 | 6072 |
| myoC-6327 | + | CUCCAGAGAGGUUUAUAUAUACU | 23 | 6073 |
| myoC-6328 | + | GCUCCAGAGAGGUUUAUAUAUACU | 24 | 6074 |
| myoC-6329 | + | GUGGAGGCCCCUUUCCCU | 18 | 6075 |
| myoC-6330 | + | CGUGGAGGCCCCUUUCCCU | 19 | 6076 |
| myoC-2175 | + | ACGUGGAGGCCCCUUUCCCU | 20 | 2277 |
| myoC-6331 | + | GACGUGGAGGCCCCUUUCCCU | 21 | 6077 |
| myoC-6332 | + | GGACGUGGAGGCCCCUUUCCCU | 22 | 6078 |
| myoC-6333 | + | UGGACGUGGAGGCCCCUUUCCCU | 23 | 6079 |
| myoC-6334 | + | CUGGACGUGGAGGCCCCUUUCCCU | 24 | 6080 |
| myoC-6335 | + | UCCGUGAAUUAACGGCCU | 18 | 6081 |
| myoC-6336 | + | UUCCGUGAAUUAACGGCCU | 19 | 6082 |
| myoC-1099 | + | CUUCCGUGAAUUAACGGCCU | 20 | 1399 |
| myoC-6337 | + | UCUUCCGUGAAUUAACGGCCU | 21 | 6083 |
| myoC-6338 | + | UUCUUCCGUGAAUUAACGGCCU | 22 | 6084 |
| myoC-6339 | + | CUUCUUCCGUGAAUUAACGGCCU | 23 | 6085 |
| myoC-6340 | + | ACUUCUUCCGUGAAUUAACGGCCU | 24 | 6086 |
| myoC-6341 | + | ACUCGGGCUUGGGGGCCU | 18 | 6087 |
| myoC-6342 | + | GACUCGGGCUUGGGGGCCU | 19 | 6088 |
| myoC-2149 | + | AGACUCGGGCUUGGGGGCCU | 20 | 2261 |
| myoC-6343 | + | AAGACUCGGGCUUGGGGGCCU | 21 | 6089 |
| myoC-6344 | + | GAAGACUCGGGCUUGGGGGCCU | 22 | 6090 |
| myoC-6345 | + | GGAAGACUCGGGCUUGGGGGCCU | 23 | 6091 |
| myoC-6346 | + | UGGAAGACUCGGGCUUGGGGGCCU | 24 | 6092 |
| myoC-3423 | + | GGCUUGGUGAGGCUUCCU | 18 | 3169 |
| myoC-3424 | + | AGGCUUGGUGAGGCUUCCU | 19 | 3170 |
| myoC-2357 | + | GAGGCUUGGUGAGGCUUCCU | 20 | 2411 |
| myoC-3425 | + | AGAGGCUUGGUGAGGCUUCCU | 21 | 3171 |
| myoC-3426 | + | CAGAGGCUUGGUGAGGCUUCCU | 22 | 3172 |
| myoC-3427 | + | GCAGAGGCUUGGUGAGGCUUCCU | 23 | 3173 |
| myoC-3428 | + | UGCAGAGGCUUGGUGAGGCUUCCU | 24 | 3174 |
| myoC-6347 | + | GAGGCAGCAGGGGGCGCU | 18 | 6093 |
| myoC-6348 | + | GGAGGCAGCAGGGGGCGCU | 19 | 6094 |
| myoC-717 | + | UGGAGGCAGCAGGGGGCGCU | 20 | 1120 |
| myoC-6349 | + | AUGGAGGCAGCAGGGGGCGCU | 21 | 6095 |
| myoC-6350 | + | GAUGGAGGCAGCAGGGGGCGCU | 22 | 6096 |
| myoC-6351 | + | CGAUGGAGGCAGCAGGGGGCGCU | 23 | 6097 |
| myoC-6352 | + | ACGAUGGAGGCAGCAGGGGGCGCU | 24 | 6098 |

TABLE 10D-continued

| 4th Tier | | | | |
|---|---|---|---|---|
| gRNA Name | DNA Strand | Targeting Domain | Target Site Length | Seq ID |
| myoC-6353 | + | CUGAUGGAGGAGGAGGCU | 18 | 6099 |
| myoC-6354 | + | ACUGAUGGAGGAGGAGGCU | 19 | 6100 |
| myoC-702 | + | GACUGAUGGAGGAGGAGGCU | 20 | 1004 |
| myoC-6355 | + | UGACUGAUGGAGGAGGAGGCU | 21 | 6101 |
| myoC-6356 | + | GUGACUGAUGGAGGAGGAGGCU | 22 | 6102 |
| myoC-6357 | + | UGUGACUGAUGGAGGAGGAGGCU | 23 | 6103 |
| myoC-6358 | + | CUGUGACUGAUGGAGGAGGAGGCU | 24 | 6104 |
| myoC-6359 | + | GCUUGGAAGACUCGGGCU | 18 | 6105 |
| myoC-6360 | + | GGCUUGGAAGACUCGGGCU | 19 | 6106 |
| myoC-705 | + | AGGCUUGGAAGACUCGGGCU | 20 | 1091 |
| myoC-6361 | + | GAGGCUUGGAAGACUCGGGCU | 21 | 6107 |
| myoC-6362 | + | GGAGGCUUGGAAGACUCGGGCU | 22 | 6108 |
| myoC-6363 | + | AGGAGGCUUGGAAGACUCGGGCU | 23 | 6109 |
| myoC-6364 | + | GAGGAGGCUUGGAAGACUCGGGCU | 24 | 6110 |
| myoC-6365 | + | UGUGCCAGGCACUAUGCU | 18 | 6111 |
| myoC-6366 | + | CUGUGCCAGGCACUAUGCU | 19 | 6112 |
| myoC-891 | + | ACUGUGCCAGGCACUAUGCU | 20 | 1178 |
| myoC-6367 | + | CACUGUGCCAGGCACUAUGCU | 21 | 6113 |
| myoC-6368 | + | GCACUGUGCCAGGCACUAUGCU | 22 | 6114 |
| myoC-6369 | + | UGCACUGUGCCAGGCACUAUGCU | 23 | 6115 |
| myoC-6370 | + | CUGCACUGUGCCAGGCACUAUGCU | 24 | 6116 |
| myoC-3429 | + | ACAUGGCCUGGCUCUGCU | 18 | 3175 |
| myoC-3430 | + | GACAUGGCCUGGCUCUGCU | 19 | 3176 |
| myoC-1675 | + | UGACAUGGCCUGGCUCUGCU | 20 | 1936 |
| myoC-3431 | + | CUGACAUGGCCUGGCUCUGCU | 21 | 3177 |
| myoC-3432 | + | ACUGACAUGGCCUGGCUCUGCU | 22 | 3178 |
| myoC-3433 | + | GACUGACAUGGCCUGGCUCUGCU | 23 | 3179 |
| myoC-3434 | + | UGACUGACAUGGCCUGGCUCUGCU | 24 | 3180 |
| myoC-6371 | + | GGAAAGCUCUGCUGUGCU | 18 | 6117 |
| myoC-6372 | + | UGGAAAGCUCUGCUGUGCU | 19 | 6118 |
| myoC-2354 | + | CUGGAAAGCUCUGCUGUGCU | 20 | 2408 |
| myoC-6373 | + | UCUGGAAAGCUCUGCUGUGCU | 21 | 6119 |
| myoC-6374 | + | CUCUGGAAAGCUCUGCUGUGCU | 22 | 6120 |
| myoC-6375 | + | CCUCUGGAAAGCUCUGCUGUGCU | 23 | 6121 |
| myoC-6376 | + | UCCUCUGGAAAGCUCUGCUGUGCU | 24 | 6122 |
| myoC-6377 | + | ACGGGCUGGCAGGUUGCU | 18 | 6123 |
| myoC-6378 | + | CACGGGCUGGCAGGUUGCU | 19 | 6124 |

TABLE 10D-continued

| 4th Tier | | | | |
|---|---|---|---|---|
| gRNA Name | DNA Strand | Targeting Domain | Target Site Length | Seq ID |
| myoC-2123 | + | GCACGGGCUGGCAGGUUGCU | 20 | 2241 |
| myoC-6379 | + | GGCACGGGCUGGCAGGUUGCU | 21 | 6125 |
| myoC-6380 | + | UGGCACGGGCUGGCAGGUUGCU | 22 | 6126 |
| myoC-6381 | + | GUGGCACGGGCUGGCAGGUUGCU | 23 | 6127 |
| myoC-6382 | + | AGUGGCACGGGCUGGCAGGUUGCU | 24 | 6128 |
| myoC-6383 | + | GGAGGCCCCUUUCCCUCU | 18 | 6129 |
| myoC-6384 | + | UGGAGGCCCCUUUCCCUCU | 19 | 6130 |
| myoC-2174 | + | GUGGAGGCCCCUUUCCCUCU | 20 | 2276 |
| myoC-6385 | + | CGUGGAGGCCCCUUUCCCUCU | 21 | 6131 |
| myoC-6386 | + | ACGUGGAGGCCCCUUUCCCUCU | 22 | 6132 |
| myoC-6387 | + | GACGUGGAGGCCCCUUUCCCUCU | 23 | 6133 |
| myoC-6388 | + | GGACGUGGAGGCCCCUUUCCCUCU | 24 | 6134 |
| myoC-3435 | + | UCCAGAACUGACUUGUCU | 18 | 3181 |
| myoC-3436 | + | CUCCAGAACUGACUUGUCU | 19 | 3182 |
| myoC-208 | + | CCUCCAGAACUGACUUGUCU | 20 | 594 |
| myoC-3437 | + | UCCUCCAGAACUGACUUGUCU | 21 | 3183 |
| myoC-3438 | + | UUCCUCCAGAACUGACUUGUCU | 22 | 3184 |
| myoC-3439 | + | CUUCCUCCAGAACUGACUUGUCU | 23 | 3185 |
| myoC-3440 | + | UCUUCCUCCAGAACUGACUUGUCU | 24 | 3186 |
| myoC-6389 | + | CGCUGCCAGCAAGAUUCU | 18 | 6135 |
| myoC-6390 | + | ACGCUGCCAGCAAGAUUCU | 19 | 6136 |
| myoC-2330 | + | CACGCUGCCAGCAAGAUUCU | 20 | 2395 |
| myoC-6391 | + | UCACGCUGCCAGCAAGAUUCU | 21 | 6137 |
| myoC-6392 | + | UUCACGCUGCCAGCAAGAUUCU | 22 | 6138 |
| myoC-6393 | + | CUUCACGCUGCCAGCAAGAUUCU | 23 | 6139 |
| myoC-6394 | + | CCUUCACGCUGCCAGCAAGAUUCU | 24 | 6140 |
| myoC-6395 | + | AACCUUCCAGAAGUCUGU | 18 | 6141 |
| myoC-6396 | + | UAACCUUCCAGAAGUCUGU | 19 | 6142 |
| myoC-2328 | + | AUAACCUUCCAGAAGUCUGU | 20 | 2393 |
| myoC-6397 | + | AAUAACCUUCCAGAAGUCUGU | 21 | 6143 |
| myoC-6398 | + | AAAUAACCUUCCAGAAGUCUGU | 22 | 6144 |
| myoC-6399 | + | AAAAUAACCUUCCAGAAGUCUGU | 23 | 6145 |
| myoC-6400 | + | GAAAAUAACCUUCCAGAAGUCUGU | 24 | 6146 |
| myoC-6401 | + | UCACUCUGCAAACUCAUU | 18 | 6147 |
| myoC-6402 | + | UUCACUCUGCAAACUCAUU | 19 | 6148 |
| myoC-2322 | + | AUUCACUCUGCAAACUCAUU | 20 | 2388 |
| myoC-6403 | + | CAUUCACUCUGCAAACUCAUU | 21 | 6149 |
| myoC-6404 | + | CCAUUCACUCUGCAAACUCAUU | 22 | 6150 |

TABLE 10D-continued

| 4th Tier | | | | |
|---|---|---|---|---|
| gRNA Name | DNA Strand | Targeting Domain | Target Site Length | Seq ID |
| myoC-6405 | + | UCCAUUCACUCUGCAAACUCAUU | 23 | 6151 |
| myoC-6406 | + | UUCCAUUCACUCUGCAAACUCAUU | 24 | 6152 |
| myoC-6407 | + | CUUGGAAGACUCGGGCUU | 18 | 6153 |
| myoC-6408 | + | GCUUGGAAGACUCGGGCUU | 19 | 6154 |
| myoC-706 | + | GGCUUGGAAGACUCGGGCUU | 20 | 978 |
| myoC-6409 | + | AGGCUUGGAAGACUCGGGCUU | 21 | 6155 |
| myoC-6410 | + | GAGGCUUGGAAGACUCGGGCUU | 22 | 6156 |
| myoC-6411 | + | GGAGGCUUGGAAGACUCGGGCUU | 23 | 6157 |
| myoC-6412 | + | AGGAGGCUUGGAAGACUCGGGCUU | 24 | 6158 |
| myoC-6413 | + | UAGGGAGGUGGCCUUGUU | 18 | 6159 |
| myoC-6414 | + | CUAGGGAGGUGGCCUUGUU | 19 | 6160 |
| myoC-2140 | + | GCUAGGGAGGUGGCCUUGUU | 20 | 2257 |
| myoC-6415 | + | CGCUAGGGAGGUGGCCUUGUU | 21 | 6161 |
| myoC-6416 | + | GCGCUAGGGAGGUGGCCUUGUU | 22 | 6162 |
| myoC-6417 | + | GGCGCUAGGGAGGUGGCCUUGUU | 23 | 6163 |
| myoC-6418 | + | GGGCGCUAGGGAGGUGGCCUUGUU | 24 | 6164 |
| myoC-6419 | + | AUUUUAACAGCUGACUUU | 18 | 6165 |
| myoC-6420 | + | AAUUUUAACAGCUGACUUU | 19 | 6166 |
| myoC-2191 | + | GAAUUUUAACAGCUGACUUU | 20 | 2289 |
| myoC-6421 | + | GGAAUUUUAACAGCUGACUUU | 21 | 6167 |
| myoC-6422 | + | UGGAAUUUUAACAGCUGACUUU | 22 | 6168 |
| myoC-6423 | + | CUGGAAUUUUAACAGCUGACUUU | 23 | 6169 |
| myoC-6424 | + | CCUGGAAUUUUAACAGCUGACUUU | 24 | 6170 |
| myoC-6425 | + | UCCCUCUCCAUUUCCUUU | 18 | 6171 |
| myoC-6426 | + | UUCCCUCUCCAUUUCCUUU | 19 | 6172 |
| myoC-2172 | + | UUUCCCUCUCCAUUUCCUUU | 20 | 2275 |
| myoC-6427 | + | GUUUCCCUCUCCAUUUCCUUU | 21 | 6173 |
| myoC-6428 | + | AGUUUCCCUCUCCAUUUCCUUU | 22 | 6174 |
| myoC-6429 | + | UAGUUUCCCUCUCCAUUUCCUUU | 23 | 6175 |
| myoC-6430 | + | CUAGUUUCCCUCUCCAUUUCCUUU | 24 | 6176 |
| myoC-3441 | - | AGCGACUAAGGCAAGAAA | 18 | 3187 |
| myoC-3442 | - | AAGCGACUAAGGCAAGAAA | 19 | 3188 |
| myoC-1647 | - | GAAGCGACUAAGGCAAGAAA | 20 | 1913 |
| myoC-3443 | - | AGAAGCGACUAAGGCAAGAAA | 21 | 3189 |
| myoC-3444 | - | AAGAAGCGACUAAGGCAAGAAA | 22 | 3190 |
| myoC-3445 | - | GAAGAAGCGACUAAGGCAAGAAA | 23 | 3191 |
| myoC-3446 | - | AGAAGAAGCGACUAAGGCAAGAAA | 24 | 3192 |

TABLE 10D-continued

| 4th Tier | | | | |
|---|---|---|---|---|
| gRNA Name | DNA Strand | Targeting Domain | Target Site Length | Seq ID |
| myoC-6431 | - | CAGGCUCCAGAAAGGAAA | 18 | 6177 |
| myoC-6432 | - | CCAGGCUCCAGAAAGGAAA | 19 | 6178 |
| myoC-964 | - | UCCAGGCUCCAGAAAGGAAA | 20 | 1264 |
| myoC-6433 | - | CUCCAGGCUCCAGAAAGGAAA | 21 | 6179 |
| myoC-6434 | - | GCUCCAGGCUCCAGAAAGGAAA | 22 | 6180 |
| myoC-6435 | - | GGCUCCAGGCUCCAGAAAGGAAA | 23 | 6181 |
| myoC-6436 | - | UGGCUCCAGGCUCCAGAAAGGAAA | 24 | 6182 |
| myoC-6437 | - | GGGGUAUGGGUGCAUAAA | 18 | 6183 |
| myoC-6438 | - | UGGGGUAUGGGUGCAUAAA | 19 | 6184 |
| myoC-2095 | - | UUGGGGUAUGGGUGCAUAAA | 20 | 2220 |
| myoC-6439 | - | AUUGGGGUAUGGGUGCAUAAA | 21 | 6185 |
| myoC-6440 | - | UAUUGGGGUAUGGGUGCAUAAA | 22 | 6186 |
| myoC-6441 | - | UUAUUGGGGUAUGGGUGCAUAAA | 23 | 6187 |
| myoC-6442 | - | AUUAUUGGGGUAUGGGUGCAUAAA | 24 | 6188 |
| myoC-6443 | - | UGGGAUGUUCUUUUUAAA | 18 | 6189 |
| myoC-6444 | - | UUGGGAUGUUCUUUUUAAA | 19 | 6190 |
| myoC-2097 | - | AUUGGGAUGUUCUUUUUAAA | 20 | 2221 |
| myoC-6445 | - | AAUUGGGAUGUUCUUUUUAAA | 21 | 6191 |
| myoC-6446 | - | AAAUUGGGAUGUUCUUUUUAAA | 22 | 6192 |
| myoC-6447 | - | UAAAUUGGGAUGUUCUUUUUAAA | 23 | 6193 |
| myoC-6448 | - | AUAAAUUGGGAUGUUCUUUUUAAA | 24 | 6194 |
| myoC-6449 | - | AACCCAGUGCUGAAAGAA | 18 | 6195 |
| myoC-6450 | - | AAACCCAGUGCUGAAAGAA | 19 | 6196 |
| myoC-693 | - | UAAACCCAGUGCUGAAAGAA | 20 | 1113 |
| myoC-6451 | - | UUAAACCCAGUGCUGAAAGAA | 21 | 6197 |
| myoC-6452 | - | CUUAAACCCAGUGCUGAAAGAA | 22 | 6198 |
| myoC-6453 | - | ACUUAAACCCAGUGCUGAAAGAA | 23 | 6199 |
| myoC-6454 | - | AACUUAAACCCAGUGCUGAAAGAA | 24 | 6200 |
| myoC-6455 | - | UGGCUCCAGGCUCCAGAA | 18 | 6201 |
| myoC-6456 | - | UUGGCUCCAGGCUCCAGAA | 19 | 6202 |
| myoC-963 | - | CUUGGCUCCAGGCUCCAGAA | 20 | 1263 |
| myoC-6457 | - | CCUUGGCUCCAGGCUCCAGAA | 21 | 6203 |
| myoC-6458 | - | UCCUUGGCUCCAGGCUCCAGAA | 22 | 6204 |
| myoC-6459 | - | CUCCUUGGCUCCAGGCUCCAGAA | 23 | 6205 |
| myoC-6460 | - | ACUCCUUGGCUCCAGGCUCCAGAA | 24 | 6206 |
| myoC-6461 | - | CCAGGCUCCAGAAAGGAA | 18 | 6207 |
| myoC-6462 | - | UCCAGGCUCCAGAAAGGAA | 19 | 6208 |
| myoC-1848 | - | CUCCAGGCUCCAGAAAGGAA | 20 | 2057 |

TABLE 10D-continued

| 4th Tier | | | | |
|---|---|---|---|---|
| gRNA Name | DNA Strand | Targeting Domain | Target Site Length | Seq ID |
| myoC-6463 | - | GCUCCAGGCUCCAGAAAGGAA | 21 | 6209 |
| myoC-6464 | - | GGCUCCAGGCUCCAGAAAGGAA | 22 | 6210 |
| myoC-6465 | - | UGGCUCCAGGCUCCAGAAAGGAA | 23 | 6211 |
| myoC-6466 | - | UUGGCUCCAGGCUCCAGAAAGGAA | 24 | 6212 |
| myoC-3447 | - | AAGUCAGUUCUGGAGGAA | 18 | 3193 |
| myoC-3448 | - | CAAGUCAGUUCUGGAGGAA | 19 | 3194 |
| myoC-1644 | - | ACAAGUCAGUUCUGGAGGAA | 20 | 1910 |
| myoC-3449 | - | GACAAGUCAGUUCUGGAGGAA | 21 | 3195 |
| myoC-3450 | - | AGACAAGUCAGUUCUGGAGGAA | 22 | 3196 |
| myoC-3451 | - | GAGACAAGUCAGUUCUGGAGGAA | 23 | 3197 |
| myoC-3452 | - | CGAGACAAGUCAGUUCUGGAGGAA | 24 | 3198 |
| myoC-6467 | - | UUAAUGGGAAUAUAGGAA | 18 | 6213 |
| myoC-6468 | - | UUUAAUGGGAAUAUAGGAA | 19 | 6214 |
| myoC-1915 | - | AUUUAAUGGGAAUAUAGGAA | 20 | 2095 |
| myoC-6469 | - | UAUUUAAUGGGAAUAUAGGAA | 21 | 6215 |
| myoC-6470 | - | UUAUUUAAUGGGAAUAUAGGAA | 22 | 6216 |
| myoC-6471 | - | UUUAUUUAAUGGGAAUAUAGGAA | 23 | 6217 |
| myoC-6472 | - | CUUUAUUUAAUGGGAAUAUAGGAA | 24 | 6218 |
| myoC-6473 | - | GUGUUUCCUCAGAGGGAA | 18 | 6219 |
| myoC-6474 | - | AGUGUUUCCUCAGAGGGAA | 19 | 6220 |
| myoC-974 | - | CAGUGUUUCCUCAGAGGGAA | 20 | 1274 |
| myoC-6475 | - | ACAGUGUUUCCUCAGAGGGAA | 21 | 6221 |
| myoC-6476 | - | GACAGUGUUUCCUCAGAGGGAA | 22 | 6222 |
| myoC-6477 | - | GGACAGUGUUUCCUCAGAGGGAA | 23 | 6223 |
| myoC-6478 | - | GGGACAGUGUUUCCUCAGAGGGAA | 24 | 6224 |
| myoC-6479 | - | AUGAGUUUGCAGAGUGAA | 18 | 6225 |
| myoC-6480 | - | AAUGAGUUUGCAGAGUGAA | 19 | 6226 |
| myoC-833 | - | CAAUGAGUUUGCAGAGUGAA | 20 | 1188 |
| myoC-6481 | - | UCAAUGAGUUUGCAGAGUGAA | 21 | 6227 |
| myoC-6482 | - | CUCAAUGAGUUUGCAGAGUGAA | 22 | 6228 |
| myoC-6483 | - | UCUCAAUGAGUUUGCAGAGUGAA | 23 | 6229 |
| myoC-6484 | - | UUCUCAAUGAGUUUGCAGAGUGAA | 24 | 6230 |
| myoC-6485 | - | GAAAGGCAGGAAGGUGAA | 18 | 6231 |
| myoC-6486 | - | UGAAAGGCAGGAAGGUGAA | 19 | 6232 |
| myoC-1890 | - | CUGAAAGGCAGGAAGGUGAA | 20 | 2079 |
| myoC-6487 | - | GCUGAAAGGCAGGAAGGUGAA | 21 | 6233 |
| myoC-6488 | - | UGCUGAAAGGCAGGAAGGUGAA | 22 | 6234 |

TABLE 10D-continued

| 4th Tier | | | | |
|---|---|---|---|---|
| gRNA Name | DNA Strand | Targeting Domain | Target Site Length | Seq ID |
| myoC-6489 | - | GUGCUGAAAGGCAGGAAGGUGAA | 23 | 6235 |
| myoC-6490 | - | GGUGCUGAAAGGCAGGAAGGUGAA | 24 | 6236 |
| myoC-6491 | - | AGAGGGAAACUAGUCUAA | 18 | 6237 |
| myoC-6492 | - | GAGAGGGAAACUAGUCUAA | 19 | 6238 |
| myoC-967 | - | GGAGAGGGAAACUAGUCUAA | 20 | 1267 |
| myoC-6493 | - | UGGAGAGGGAAACUAGUCUAA | 21 | 6239 |
| myoC-6494 | - | AUGGAGAGGGAAACUAGUCUAA | 22 | 6240 |
| myoC-6495 | - | AAUGGAGAGGGAAACUAGUCUAA | 23 | 6241 |
| myoC-6496 | - | AAAUGGAGAGGGAAACUAGUCUAA | 24 | 6242 |
| myoC-6497 | - | ACGAAGGCCUUUAUUUAA | 18 | 6243 |
| myoC-6498 | - | CACGAAGGCCUUUAUUUAA | 19 | 6244 |
| myoC-1013 | - | UCACGAAGGCCUUUAUUUAA | 20 | 1313 |
| myoC-6499 | - | UUCACGAAGGCCUUUAUUUAA | 21 | 6245 |
| myoC-6500 | - | CUUCACGAAGGCCUUUAUUUAA | 22 | 6246 |
| myoC-6501 | - | CCUUCACGAAGGCCUUUAUUUAA | 23 | 6247 |
| myoC-6502 | - | UCCUUCACGAAGGCCUUUAUUUAA | 24 | 6248 |
| myoC-3453 | - | AGUCAUCCAUAACUUACA | 18 | 3199 |
| myoC-3454 | - | CAGUCAUCCAUAACUUACA | 19 | 3200 |
| myoC-1608 | - | UCAGUCAUCCAUAACUUACA | 20 | 1888 |
| myoC-3455 | - | GUCAGUCAUCCAUAACUUACA | 21 | 3201 |
| myoC-3456 | - | UGUCAGUCAUCCAUAACUUACA | 22 | 3202 |
| myoC-3457 | - | AUGUCAGUCAUCCAUAACUUACA | 23 | 3203 |
| myoC-3458 | - | CAUGUCAGUCAUCCAUAACUUACA | 24 | 3204 |
| myoC-6503 | - | GCACAGCAGAGCUUUCCA | 18 | 6249 |
| myoC-6504 | - | AGCACAGCAGAGCUUUCCA | 19 | 6250 |
| myoC-2110 | - | CAGCACAGCAGAGCUUUCCA | 20 | 2232 |
| myoC-6505 | - | UCAGCACAGCAGAGCUUUCCA | 21 | 6251 |
| myoC-6506 | - | CUCAGCACAGCAGAGCUUUCCA | 22 | 6252 |
| myoC-6507 | - | UCUCAGCACAGCAGAGCUUUCCA | 23 | 6253 |
| myoC-6508 | - | CUCUCAGCACAGCAGAGCUUUCCA | 24 | 6254 |
| myoC-3459 | - | GACCCAGGAGGGGCUGCA | 18 | 3205 |
| myoC-3460 | - | AGACCCAGGAGGGGCUGCA | 19 | 3206 |
| myoC-1622 | - | GAGACCCAGGAGGGGCUGCA | 20 | 1897 |
| myoC-3461 | - | GGAGACCCAGGAGGGGCUGCA | 21 | 3207 |
| myoC-3462 | - | AGGAGACCCAGGAGGGGCUGCA | 22 | 3208 |
| myoC-3463 | - | CAGGAGACCCAGGAGGGGCUGCA | 23 | 3209 |
| myoC-3464 | - | CCAGGAGACCCAGGAGGGGCUGCA | 24 | 3210 |
| myoC-3465 | - | CCUCACCAAGCCUCUGCA | 18 | 3211 |

TABLE 10D-continued

| 4th Tier | | | | |
|---|---|---|---|---|
| gRNA Name | DNA Strand | Targeting Domain | Target Site Length | Seq ID |
| myoC-3466 | - | GCCUCACCAAGCCUCUGCA | 19 | 3212 |
| myoC-1592 | - | AGCCUCACCAAGCCUCUGCA | 20 | 1876 |
| myoC-3467 | - | AAGCCUCACCAAGCCUCUGCA | 21 | 3213 |
| myoC-3468 | - | GAAGCCUCACCAAGCCUCUGCA | 22 | 3214 |
| myoC-3469 | - | GGAAGCCUCACCAAGCCUCUGCA | 23 | 3215 |
| myoC-3470 | - | AGGAAGCCUCACCAAGCCUCUGCA | 24 | 3216 |
| myoC-6509 | - | GGGGACAGUGUUUCCUCA | 18 | 6255 |
| myoC-6510 | - | AGGGGACAGUGUUUCCUCA | 19 | 6256 |
| myoC-1863 | - | GAGGGGACAGUGUUUCCUCA | 20 | 2065 |
| myoC-6511 | - | GGAGGGGACAGUGUUUCCUCA | 21 | 6257 |
| myoC-6512 | - | UGGAGGGGACAGUGUUUCCUCA | 22 | 6258 |
| myoC-6513 | - | CUGGAGGGGACAGUGUUUCCUCA | 23 | 6259 |
| myoC-6514 | - | UCUGGAGGGGACAGUGUUUCCUCA | 24 | 6260 |
| myoC-6515 | - | GGAGGUGACAGUUUCUCA | 18 | 6261 |
| myoC-6516 | - | UGGAGGUGACAGUUUCUCA | 19 | 6262 |
| myoC-692 | - | GUGGAGGUGACAGUUUCUCA | 20 | 1021 |
| myoC-6517 | - | CGUGGAGGUGACAGUUUCUCA | 21 | 6263 |
| myoC-6518 | - | UCGUGGAGGUGACAGUUUCUCA | 22 | 6264 |
| myoC-6519 | - | UUCGUGGAGGUGACAGUUUCUCA | 23 | 6265 |
| myoC-6520 | - | CUUCGUGGAGGUGACAGUUUCUCA | 24 | 6266 |
| myoC-6521 | - | UCCUAGGCCGUUAAUUCA | 18 | 6267 |
| myoC-6522 | - | UUCCUAGGCCGUUAAUUCA | 19 | 6268 |
| myoC-1017 | - | UUUCCUAGGCCGUUAAUUCA | 20 | 1317 |
| myoC-6523 | - | AUUUCCUAGGCCGUUAAUUCA | 21 | 6269 |
| myoC-6524 | - | CAUUUCCUAGGCCGUUAAUUCA | 22 | 6270 |
| myoC-6525 | - | UCAUUUCCUAGGCCGUUAAUUCA | 23 | 6271 |
| myoC-6526 | - | CUCAUUUCCUAGGCCGUUAAUUCA | 24 | 6272 |
| myoC-6527 | - | GAUGUUCAGUGUUGUUCA | 18 | 6273 |
| myoC-6528 | - | AGAUGUUCAGUGUUGUUCA | 19 | 6274 |
| myoC-999 | - | CAGAUGUUCAGUGUUGUUCA | 20 | 1299 |
| myoC-6529 | - | CCAGAUGUUCAGUGUUGUUCA | 21 | 6275 |
| myoC-6530 | - | CCCAGAUGUUCAGUGUUGUUCA | 22 | 6276 |
| myoC-6531 | - | GCCCAGAUGUUCAGUGUUGUUCA | 23 | 6277 |
| myoC-6532 | - | UGCCCAGAUGUUCAGUGUUGUUCA | 24 | 6278 |
| myoC-6533 | - | AAACCCAGUGCUGAAAGA | 18 | 6279 |
| myoC-6534 | - | UAAACCCAGUGCUGAAAGA | 19 | 6280 |
| myoC-1834 | - | UUAAACCCAGUGCUGAAAGA | 20 | 2046 |

TABLE 10D-continued

| 4th Tier | | | | |
|---|---|---|---|---|
| gRNA Name | DNA Strand | Targeting Domain | Target Site Length | Seq ID |
| myoC-6535 | - | CUUAAACCCAGUGCUGAAAGA | 21 | 6281 |
| myoC-6536 | - | ACUUAAACCCAGUGCUGAAAGA | 22 | 6282 |
| myoC-6537 | - | AACUUAAACCCAGUGCUGAAAGA | 23 | 6283 |
| myoC-6538 | - | CAACUUAAACCCAGUGCUGAAAGA | 24 | 6284 |
| myoC-6539 | - | UUGGCUCCAGGCUCCAGA | 18 | 6285 |
| myoC-6540 | - | CUUGGCUCCAGGCUCCAGA | 19 | 6286 |
| myoC-1846 | - | CCUUGGCUCCAGGCUCCAGA | 20 | 2056 |
| myoC-6541 | - | UCCUUGGCUCCAGGCUCCAGA | 21 | 6287 |
| myoC-6542 | - | CUCCUUGGCUCCAGGCUCCAGA | 22 | 6288 |
| myoC-6543 | - | ACUCCUUGGCUCCAGGCUCCAGA | 23 | 6289 |
| myoC-6544 | - | GACUCCUUGGCUCCAGGCUCCAGA | 24 | 6290 |
| myoC-3471 | - | CCCAGGAGGGGCUGCAGA | 18 | 3217 |
| myoC-3472 | - | ACCCAGGAGGGGCUGCAGA | 19 | 3218 |
| myoC-99 | - | GACCCAGGAGGGGCUGCAGA | 20 | 504 |
| myoC-3473 | - | AGACCCAGGAGGGGCUGCAGA | 21 | 3219 |
| myoC-3474 | - | GAGACCCAGGAGGGGCUGCAGA | 22 | 3220 |
| myoC-3475 | - | GGAGACCCAGGAGGGGCUGCAGA | 23 | 3221 |
| myoC-3476 | - | AGGAGACCCAGGAGGGGCUGCAGA | 24 | 3222 |
| myoC-6545 | - | GGACAGUGUUUCCUCAGA | 18 | 6291 |
| myoC-6546 | - | GGGACAGUGUUUCCUCAGA | 19 | 6292 |
| myoC-973 | - | GGGGACAGUGUUUCCUCAGA | 20 | 1273 |
| myoC-6547 | - | AGGGGACAGUGUUUCCUCAGA | 21 | 6293 |
| myoC-6548 | - | GAGGGGACAGUGUUUCCUCAGA | 22 | 6294 |
| myoC-6549 | - | GGAGGGGACAGUGUUUCCUCAGA | 23 | 6295 |
| myoC-6550 | - | UGGAGGGGACAGUGUUUCCUCAGA | 24 | 6296 |
| myoC-6551 | - | CCAGAAAGGAAAUGGAGA | 18 | 6297 |
| myoC-6552 | - | UCCAGAAAGGAAAUGGAGA | 19 | 6298 |
| myoC-966 | - | CUCCAGAAAGGAAAUGGAGA | 20 | 1266 |
| myoC-6553 | - | GCUCCAGAAAGGAAAUGGAGA | 21 | 6299 |
| myoC-6554 | - | GGCUCCAGAAAGGAAAUGGAGA | 22 | 6300 |
| myoC-6555 | - | AGGCUCCAGAAAGGAAAUGGAGA | 23 | 6301 |
| myoC-6556 | - | CAGGCUCCAGAAAGGAAAUGGAGA | 24 | 6302 |
| myoC-6557 | - | AGGUGGGGACUGCAGGGA | 18 | 6303 |
| myoC-6558 | - | GAGGUGGGGACUGCAGGGA | 19 | 6304 |
| myoC-1879 | - | GGAGGUGGGGACUGCAGGGA | 20 | 2072 |
| myoC-6559 | - | AGGAGGUGGGGACUGCAGGGA | 21 | 6305 |
| myoC-6560 | - | CAGGAGGUGGGGACUGCAGGGA | 22 | 6306 |
| myoC-6561 | - | CCAGGAGGUGGGGACUGCAGGGA | 23 | 6307 |

TABLE 10D-continued

| 4th Tier | | | | |
|---|---|---|---|---|
| gRNA Name | DNA Strand | Targeting Domain | Target Site Length | Seq ID |
| myoC-6562 | - | UCCAGGAGGUGGGGACUGCAGGGA | 24 | 6308 |
| myoC-6563 | - | AGUGUUUCCUCAGAGGGA | 18 | 6309 |
| myoC-6564 | - | CAGUGUUUCCUCAGAGGGA | 19 | 6310 |
| myoC-1866 | - | ACAGUGUUUCCUCAGAGGGA | 20 | 2066 |
| myoC-6565 | - | GACAGUGUUUCCUCAGAGGGA | 21 | 6311 |
| myoC-6566 | - | GGACAGUGUUUCCUCAGAGGGA | 22 | 6312 |
| myoC-6567 | - | GGGACAGUGUUUCCUCAGAGGGA | 23 | 6313 |
| myoC-6568 | - | GGGGACAGUGUUUCCUCAGAGGGA | 24 | 6314 |
| myoC-3477 | - | GGGCACCCUGAGGCGGGA | 18 | 3223 |
| myoC-3478 | - | UGGGCACCCUGAGGCGGGA | 19 | 3224 |
| myoC-1630 | - | CUGGGCACCCUGAGGCGGGA | 20 | 1901 |
| myoC-3479 | - | GCUGGGCACCCUGAGGCGGGA | 21 | 3225 |
| myoC-3480 | - | AGCUGGGCACCCUGAGGCGGGA | 22 | 3226 |
| myoC-3481 | - | GAGCUGGGCACCCUGAGGCGGGA | 23 | 3227 |
| myoC-3482 | - | GGAGCUGGGCACCCUGAGGCGGGA | 24 | 3228 |
| myoC-6569 | - | CUCCAGAAAGGAAAUGGA | 18 | 6315 |
| myoC-6570 | - | GCUCCAGAAAGGAAAUGGA | 19 | 6316 |
| myoC-1851 | - | GGCUCCAGAAAGGAAAUGGA | 20 | 2059 |
| myoC-6571 | - | AGGCUCCAGAAAGGAAAUGGA | 21 | 6317 |
| myoC-6572 | - | CAGGCUCCAGAAAGGAAAUGGA | 22 | 6318 |
| myoC-6573 | - | CCAGGCUCCAGAAAGGAAAUGGA | 23 | 6319 |
| myoC-6574 | - | UCCAGGCUCCAGAAAGGAAAUGGA | 24 | 6320 |
| myoC-6575 | - | UCUAACGGAGAAUCUGGA | 18 | 6321 |
| myoC-6576 | - | GUCUAACGGAGAAUCUGGA | 19 | 6322 |
| myoC-970 | - | AGUCUAACGGAGAAUCUGGA | 20 | 1270 |
| myoC-6577 | - | UAGUCUAACGGAGAAUCUGGA | 21 | 6323 |
| myoC-6578 | - | CUAGUCUAACGGAGAAUCUGGA | 22 | 6324 |
| myoC-6579 | - | ACUAGUCUAACGGAGAAUCUGGA | 23 | 6325 |
| myoC-6580 | - | AACUAGUCUAACGGAGAAUCUGGA | 24 | 6326 |
| myoC-6581 | - | ACUUAAACCCAGUGCUGA | 18 | 6327 |
| myoC-6582 | - | AACUUAAACCCAGUGCUGA | 19 | 6328 |
| myoC-1833 | - | CAACUUAAACCCAGUGCUGA | 20 | 2045 |
| myoC-6583 | - | CCAACUUAAACCCAGUGCUGA | 21 | 6329 |
| myoC-6584 | - | GCCAACUUAAACCCAGUGCUGA | 22 | 6330 |
| myoC-6585 | - | AGCCAACUUAAACCCAGUGCUGA | 23 | 6331 |
| myoC-6586 | - | CAGCCAACUUAAACCCAGUGCUGA | 24 | 6332 |
| myoC-6587 | - | AAUUCACGGAAGAAGUGA | 18 | 6333 |

TABLE 10D-continued

| 4th Tier | | | | |
|---|---|---|---|---|
| gRNA Name | DNA Strand | Targeting Domain | Target Site Length | Seq ID |
| myoC-6588 | - | UAAUUCACGGAAGAAGUGA | 19 | 6334 |
| myoC-1919 | - | UUAAUUCACGGAAGAAGUGA | 20 | 2098 |
| myoC-6589 | - | GUUAAUUCACGGAAGAAGUGA | 21 | 6335 |
| myoC-6590 | - | CGUUAAUUCACGGAAGAAGUGA | 22 | 6336 |
| myoC-6591 | - | CCGUUAAUUCACGGAAGAAGUGA | 23 | 6337 |
| myoC-6592 | - | GCCGUUAAUUCACGGAAGAAGUGA | 24 | 6338 |
| myoC-6593 | - | AAUGAGUUUGCAGAGUGA | 18 | 6339 |
| myoC-6594 | - | CAAUGAGUUUGCAGAGUGA | 19 | 6340 |
| myoC-2084 | - | UCAAUGAGUUUGCAGAGUGA | 20 | 2213 |
| myoC-6595 | - | CUCAAUGAGUUUGCAGAGUGA | 21 | 6341 |
| myoC-6596 | - | UCUCAAUGAGUUUGCAGAGUGA | 22 | 6342 |
| myoC-6597 | - | UUCUCAAUGAGUUUGCAGAGUGA | 23 | 6343 |
| myoC-6598 | - | GUUCUCAAUGAGUUUGCAGAGUGA | 24 | 6344 |
| myoC-6599 | - | CUUUAUUUAAUGGGAAUA | 18 | 6345 |
| myoC-6600 | - | CCUUUAUUUAAUGGGAAUA | 19 | 6346 |
| myoC-1913 | - | GCCUUUAUUUAAUGGGAAUA | 20 | 2094 |
| myoC-6601 | - | GGCCUUUAUUUAAUGGGAAUA | 21 | 6347 |
| myoC-6602 | - | AGGCCUUUAUUUAAUGGGAAUA | 22 | 6348 |
| myoC-6603 | - | AAGGCCUUUAUUUAAUGGGAAUA | 23 | 6349 |
| myoC-6604 | - | GAAGGCCUUUAUUUAAUGGGAAUA | 24 | 6350 |
| myoC-6605 | - | UAAAACCAGGUGGAGAUA | 18 | 6351 |
| myoC-6606 | - | GUAAAACCAGGUGGAGAUA | 19 | 6352 |
| myoC-2090 | - | UGUAAAACCAGGUGGAGAUA | 20 | 2217 |
| myoC-6607 | - | GUGUAAAACCAGGUGGAGAUA | 21 | 6353 |
| myoC-6608 | - | UGUGUAAAACCAGGUGGAGAUA | 22 | 6354 |
| myoC-6609 | - | GUGUGUAAAACCAGGUGGAGAUA | 23 | 6355 |
| myoC-6610 | - | UGUGUGUAAAACCAGGUGGAGAUA | 24 | 6356 |
| myoC-6611 | - | GAGAGGGAAACUAGUCUA | 18 | 6357 |
| myoC-6612 | - | GGAGAGGGAAACUAGUCUA | 19 | 6358 |
| myoC-1854 | - | UGGAGAGGGAAACUAGUCUA | 20 | 2060 |
| myoC-6613 | - | AUGGAGAGGGAAACUAGUCUA | 21 | 6359 |
| myoC-6614 | - | AAUGGAGAGGGAAACUAGUCUA | 22 | 6360 |
| myoC-6615 | - | AAAUGGAGAGGGAAACUAGUCUA | 23 | 6361 |
| myoC-6616 | - | GAAAUGGAGAGGGAAACUAGUCUA | 24 | 6362 |
| myoC-6617 | - | GAGAUAUAGGAACUAUUA | 18 | 6363 |
| myoC-6618 | - | GGAGAUAUAGGAACUAUUA | 19 | 6364 |
| myoC-2092 | - | UGGAGAUAUAGGAACUAUUA | 20 | 2218 |
| myoC-6619 | - | GUGGAGAUAUAGGAACUAUUA | 21 | 6365 |

TABLE 10D-continued

| 4th Tier | | | | |
|---|---|---|---|---|
| gRNA Name | DNA Strand | Targeting Domain | Target Site Length | Seq ID |
| myoC-6620 | - | GGUGGAGAUAUAGGAACUAUUA | 22 | 6366 |
| myoC-6621 | - | AGGUGGAGAUAUAGGAACUAUUA | 23 | 6367 |
| myoC-6622 | - | CAGGUGGAGAUAUAGGAACUAUUA | 24 | 6368 |
| myoC-3483 | - | UCAGUCAUCCAUAACUUA | 18 | 3229 |
| myoC-3484 | - | GUCAGUCAUCCAUAACUUA | 19 | 3230 |
| myoC-1607 | - | UGUCAGUCAUCCAUAACUUA | 20 | 1887 |
| myoC-3485 | - | AUGUCAGUCAUCCAUAACUUA | 21 | 3231 |
| myoC-3486 | - | CAUGUCAGUCAUCCAUAACUUA | 22 | 3232 |
| myoC-3487 | - | CCAUGUCAGUCAUCCAUAACUUA | 23 | 3233 |
| myoC-3488 | - | GCCAUGUCAGUCAUCCAUAACUUA | 24 | 3234 |
| myoC-6623 | - | UGUCCCUGCUACGUCUUA | 18 | 6369 |
| myoC-6624 | - | CUGUCCCUGCUACGUCUUA | 19 | 6370 |
| myoC-2079 | - | UCUGUCCCUGCUACGUCUUA | 20 | 2208 |
| myoC-6625 | - | CUCUGUCCCUGCUACGUCUUA | 21 | 6371 |
| myoC-6626 | - | UCUCUGUCCCUGCUACGUCUUA | 22 | 6372 |
| myoC-6627 | - | UUCUCUGUCCCUGCUACGUCUUA | 23 | 6373 |
| myoC-6628 | - | UUUCUCUGUCCCUGCUACGUCUUA | 24 | 6374 |
| myoC-6629 | - | CACGAAGGCCUUUAUUUA | 18 | 6375 |
| myoC-6630 | - | UCACGAAGGCCUUUAUUUA | 19 | 6376 |
| myoC-1910 | - | UUCACGAAGGCCUUUAUUUA | 20 | 2093 |
| myoC-6631 | - | CUUCACGAAGGCCUUUAUUUA | 21 | 6377 |
| myoC-6632 | - | CCUUCACGAAGGCCUUUAUUUA | 22 | 6378 |
| myoC-6633 | - | UCCUUCACGAAGGCCUUUAUUUA | 23 | 6379 |
| myoC-6634 | - | UUCCUUCACGAAGGCCUUUAUUUA | 24 | 6380 |
| myoC-3489 | - | CCAGCUGGAAACCCAAAC | 18 | 3235 |
| myoC-3490 | - | ACCAGCUGGAAACCCAAAC | 19 | 3236 |
| myoC-1634 | - | GACCAGCUGGAAACCCAAAC | 20 | 1903 |
| myoC-3491 | - | GGACCAGCUGGAAACCCAAAC | 21 | 3237 |
| myoC-3492 | - | GGGACCAGCUGGAAACCCAAAC | 22 | 3238 |
| myoC-3493 | - | CGGGACCAGCUGGAAACCCAAAC | 23 | 3239 |
| myoC-3494 | - | GCGGGACCAGCUGGAAACCCAAAC | 24 | 3240 |
| myoC-6635 | - | GUGAAUGGAAAUAUAAAC | 18 | 6381 |
| myoC-6636 | - | AGUGAAUGGAAAUAUAAAC | 19 | 6382 |
| myoC-2086 | - | GAGUGAAUGGAAAUAUAAAC | 20 | 2214 |
| myoC-6637 | - | AGAGUGAAUGGAAAUAUAAAC | 21 | 6383 |
| myoC-6638 | - | CAGAGUGAAUGGAAAUAUAAAC | 22 | 6384 |
| myoC-6639 | - | GCAGAGUGAAUGGAAAUAUAAAC | 23 | 6385 |

TABLE 10D-continued

| 4th Tier | | | | |
|---|---|---|---|---|
| gRNA Name | DNA Strand | Targeting Domain | Target Site Length | Seq ID |
| myoC-6640 | - | UGCAGAGUGAAUGGAAAUAUAAAC | 24 | 6386 |
| myoC-6641 | - | CUUAUAUCUGCCAGACAC | 18 | 6387 |
| myoC-6642 | - | ACUUAUAUCUGCCAGACAC | 19 | 6388 |
| myoC-1824 | - | UACUUAUAUCUGCCAGACAC | 20 | 2038 |
| myoC-6643 | - | GUACUUAUAUCUGCCAGACAC | 21 | 6389 |
| myoC-6644 | - | AGUACUUAUAUCUGCCAGACAC | 22 | 6390 |
| myoC-6645 | - | GAGUACUUAUAUCUGCCAGACAC | 23 | 6391 |
| myoC-6646 | - | UGAGUACUUAUAUCUGCCAGACAC | 24 | 6392 |
| myoC-6647 | - | GGGGAGCCCUGCAAGCAC | 18 | 6393 |
| myoC-6648 | - | GGGGGAGCCCUGCAAGCAC | 19 | 6394 |
| myoC-1817 | - | UGGGGGAGCCCUGCAAGCAC | 20 | 2033 |
| myoC-6649 | - | CUGGGGGAGCCCUGCAAGCAC | 21 | 6395 |
| myoC-6650 | - | GCUGGGGGAGCCCUGCAAGCAC | 22 | 6396 |
| myoC-6651 | - | AGCUGGGGGAGCCCUGCAAGCAC | 23 | 6397 |
| myoC-6652 | - | CAGCUGGGGGAGCCCUGCAAGCAC | 24 | 6398 |
| myoC-3495 | - | AGCACCCAACGCUUAGAC | 18 | 3241 |
| myoC-3496 | - | CAGCACCCAACGCUUAGAC | 19 | 3242 |
| myoC-1609 | - | GCAGCACCCAACGCUUAGAC | 20 | 1889 |
| myoC-3497 | - | AGCAGCACCCAACGCUUAGAC | 21 | 3243 |
| myoC-3498 | - | CAGCAGCACCCAACGCUUAGAC | 22 | 3244 |
| myoC-3499 | - | ACAGCAGCACCCAACGCUUAGAC | 23 | 3245 |
| myoC-3500 | - | GACAGCAGCACCCAACGCUUAGAC | 24 | 3246 |
| myoC-3501 | - | CAGAGGGAGCUGGGCACC | 18 | 3247 |
| myoC-3502 | - | GCAGAGGGAGCUGGGCACC | 19 | 3248 |
| myoC-1626 | - | UGCAGAGGGAGCUGGGCACC | 20 | 1899 |
| myoC-3503 | - | CUGCAGAGGGAGCUGGGCACC | 21 | 3249 |
| myoC-3504 | - | GCUGCAGAGGGAGCUGGGCACC | 22 | 3250 |
| myoC-3505 | - | GGCUGCAGAGGGAGCUGGGCACC | 23 | 3251 |
| myoC-3506 | - | GGGCUGCAGAGGGAGCUGGGCACC | 24 | 3252 |
| myoC-3507 | - | GCCAGGCCCCAGGAGACC | 18 | 3253 |
| myoC-3508 | - | UGCCAGGCCCCAGGAGACC | 19 | 3254 |
| myoC-1617 | - | CUGCCAGGCCCCAGGAGACC | 20 | 1894 |
| myoC-3509 | - | GCUGCCAGGCCCCAGGAGACC | 21 | 3255 |
| myoC-3510 | - | GGCUGCCAGGCCCCAGGAGACC | 22 | 3256 |
| myoC-3511 | - | AGGCUGCCAGGCCCCAGGAGACC | 23 | 3257 |
| myoC-3512 | - | CAGGCUGCCAGGCCCCAGGAGACC | 24 | 3258 |
| myoC-3513 | - | GCACCCAACGCUUAGACC | 18 | 3259 |
| myoC-3514 | - | AGCACCCAACGCUUAGACC | 19 | 3260 |

TABLE 10D-continued

| 4th Tier | | | | |
|---|---|---|---|---|
| gRNA Name | DNA Strand | Targeting Domain | Target Site Length | Seq ID |
| myoC-179 | – | CAGCACCCAACGCUUAGACC | 20 | 565 |
| myoC-3515 | – | GCAGCACCCAACGCUUAGACC | 21 | 3261 |
| myoC-3516 | – | AGCAGCACCCAACGCUUAGACC | 22 | 3262 |
| myoC-3517 | – | CAGCAGCACCCAACGCUUAGACC | 23 | 3263 |
| myoC-3518 | – | ACAGCAGCACCCAACGCUUAGACC | 24 | 3264 |
| myoC-3519 | – | CUCCUCCACCAAUUGACC | 18 | 3265 |
| myoC-3520 | – | CCUCCUCCACCAAUUGACC | 19 | 3266 |
| myoC-1614 | – | GCCUCCUCCACCAAUUGACC | 20 | 1892 |
| myoC-3521 | – | AGCCUCCUCCACCAAUUGACC | 21 | 3267 |
| myoC-3522 | – | GAGCCUCCUCCACCAAUUGACC | 22 | 3268 |
| myoC-3523 | – | AGAGCCUCCUCCACCAAUUGACC | 23 | 3269 |
| myoC-3524 | – | GAGAGCCUCCUCCACCAAUUGACC | 24 | 3270 |
| myoC-3525 | – | CCAGGCCCCAGGAGACCC | 18 | 3271 |
| myoC-3526 | – | GCCAGGCCCCAGGAGACCC | 19 | 3272 |
| myoC-185 | – | UGCCAGGCCCCAGGAGACCC | 20 | 571 |
| myoC-3527 | – | CUGCCAGGCCCCAGGAGACCC | 21 | 3273 |
| myoC-3528 | – | GCUGCCAGGCCCCAGGAGACCC | 22 | 3274 |
| myoC-3529 | – | GGCUGCCAGGCCCCAGGAGACCC | 23 | 3275 |
| myoC-3530 | – | AGGCUGCCAGGCCCCAGGAGACCC | 24 | 3276 |
| myoC-6653 | – | CCACCUCUGUCUUCCCCC | 18 | 6399 |
| myoC-6654 | – | GCCACCUCUGUCUUCCCCC | 19 | 6400 |
| myoC-2102 | – | GGCCACCUCUGUCUUCCCCC | 20 | 2225 |
| myoC-6655 | – | UGGCCACCUCUGUCUUCCCCC | 21 | 6401 |
| myoC-6656 | – | GUGGCCACCUCUGUCUUCCCCC | 22 | 6402 |
| myoC-6657 | – | CGUGGCCACCUCUGUCUUCCCCC | 23 | 6403 |
| myoC-6658 | – | ACGUGGCCACCUCUGUCUUCCCCC | 24 | 6404 |
| myoC-3531 | – | ACCAGGCUGCCAGGCCCC | 18 | 3277 |
| myoC-3532 | – | GACCAGGCUGCCAGGCCCC | 19 | 3278 |
| myoC-97 | – | GGACCAGGCUGCCAGGCCCC | 20 | 502 |
| myoC-3533 | – | UGGACCAGGCUGCCAGGCCCC | 21 | 3279 |
| myoC-3534 | – | UUGGACCAGGCUGCCAGGCCCC | 22 | 3280 |
| myoC-3535 | – | CUUGGACCAGGCUGCCAGGCCCC | 23 | 3281 |
| myoC-3536 | – | CCUUGGACCAGGCUGCCAGGCCCC | 24 | 3282 |
| myoC-3537 | – | GACCAGGCUGCCAGGCCC | 18 | 3283 |
| myoC-3538 | – | GGACCAGGCUGCCAGGCCC | 19 | 3284 |
| myoC-1615 | – | UGGACCAGGCUGCCAGGCCC | 20 | 1893 |
| myoC-3539 | – | UUGGACCAGGCUGCCAGGCCC | 21 | 3285 |

TABLE 10D-continued

| 4th Tier | | | | |
|---|---|---|---|---|
| gRNA Name | DNA Strand | Targeting Domain | Target Site Length | Seq ID |
| myoC-3540 | - | CUUGGACCAGGCUGCCAGGCCC | 22 | 3286 |
| myoC-3541 | - | CCUUGGACCAGGCUGCCAGGCCC | 23 | 3287 |
| myoC-3542 | - | ACCUUGGACCAGGCUGCCAGGCCC | 24 | 3288 |
| myoC-3543 | - | AAGCUCGACUCAGCUCCC | 18 | 3289 |
| myoC-3544 | - | AAAGCUCGACUCAGCUCCC | 19 | 3290 |
| myoC-181 | - | CAAAGCUCGACUCAGCUCCC | 20 | 567 |
| myoC-3545 | - | CCAAAGCUCGACUCAGCUCCC | 21 | 3291 |
| myoC-3546 | - | ACCAAAGCUCGACUCAGCUCCC | 22 | 3292 |
| myoC-3547 | - | CACCAAAGCUCGACUCAGCUCCC | 23 | 3293 |
| myoC-3548 | - | CCACCAAAGCUCGACUCAGCUCCC | 24 | 3294 |
| myoC-3555 | - | GAAAAUGAGAAUCUGGCC | 18 | 3301 |
| myoC-3556 | - | AGAAAAUGAGAAUCUGGCC | 19 | 3302 |
| myoC-195 | - | AAGAAAAUGAGAAUCUGGCC | 20 | 581 |
| myoC-3557 | - | CAAGAAAAUGAGAAUCUGGCC | 21 | 3303 |
| myoC-3558 | - | GCAAGAAAAUGAGAAUCUGGCC | 22 | 3304 |
| myoC-3559 | - | GGCAAGAAAAUGAGAAUCUGGCC | 23 | 3305 |
| myoC-3560 | - | AGGCAAGAAAAUGAGAAUCUGGCC | 24 | 3306 |
| myoC-3561 | - | CCAAUGAAUCCAGCUGCC | 18 | 3307 |
| myoC-3562 | - | CCCAAUGAAUCCAGCUGCC | 19 | 3308 |
| myoC-1605 | - | UCCCAAUGAAUCCAGCUGCC | 20 | 1885 |
| myoC-3563 | - | GUCCCAAUGAAUCCAGCUGCC | 21 | 3309 |
| myoC-3564 | - | AGUCCCAAUGAAUCCAGCUGCC | 22 | 3310 |
| myoC-3565 | - | CAGUCCCAAUGAAUCCAGCUGCC | 23 | 3311 |
| myoC-3566 | - | CCAGUCCCAAUGAAUCCAGCUGCC | 24 | 3312 |
| myoC-6659 | - | UGCUGCCUCCAUCGUGCC | 18 | 6405 |
| myoC-6660 | - | CUGCUGCCUCCAUCGUGCC | 19 | 6406 |
| myoC-695 | - | CCUGCUGCCUCCAUCGUGCC | 20 | 1104 |
| myoC-6661 | - | CCCUGCUGCCUCCAUCGUGCC | 21 | 6407 |
| myoC-6662 | - | CCCCUGCUGCCUCCAUCGUGCC | 22 | 6408 |
| myoC-6663 | - | CCCCCUGCUGCCUCCAUCGUGCC | 23 | 6409 |
| myoC-6664 | - | GCCCCCUGCUGCCUCCAUCGUGCC | 24 | 6410 |
| myoC-3567 | - | AAAGCUCGACUCAGCUCC | 18 | 3313 |
| myoC-3568 | - | CAAAGCUCGACUCAGCUCC | 19 | 3314 |
| myoC-1611 | - | CCAAAGCUCGACUCAGCUCC | 20 | 1890 |
| myoC-3569 | - | ACCAAAGCUCGACUCAGCUCC | 21 | 3315 |
| myoC-3570 | - | CACCAAAGCUCGACUCAGCUCC | 22 | 3316 |
| myoC-3571 | - | CCACCAAAGCUCGACUCAGCUCC | 23 | 3317 |
| myoC-3572 | - | GCCACCAAAGCUCGACUCAGCUCC | 24 | 3318 |

TABLE 10D-continued

| 4th Tier | | | | |
|---|---|---|---|---|
| gRNA Name | DNA Strand | Targeting Domain | Target Site Length | Seq ID |
| myoC-6665 | - | AAAGGGGCCUCCACGUCC | 18 | 6411 |
| myoC-6666 | - | GAAAGGGGCCUCCACGUCC | 19 | 6412 |
| myoC-977 | - | GGAAAGGGGCCUCCACGUCC | 20 | 1277 |
| myoC-6667 | - | GGGAAAGGGGCCUCCACGUCC | 21 | 6413 |
| myoC-6668 | - | AGGGAAAGGGGCCUCCACGUCC | 22 | 6414 |
| myoC-6669 | - | GAGGGAAAGGGGCCUCCACGUCC | 23 | 6415 |
| myoC-6670 | - | AGAGGGAAAGGGGCCUCCACGUCC | 24 | 6416 |
| myoC-6671 | - | CACGUCCAGGAGAAUUCC | 18 | 6417 |
| myoC-6672 | - | CCACGUCCAGGAGAAUUCC | 19 | 6418 |
| myoC-978 | - | UCCACGUCCAGGAGAAUUCC | 20 | 1278 |
| myoC-6673 | - | CUCCACGUCCAGGAGAAUUCC | 21 | 6419 |
| myoC-6674 | - | CCUCCACGUCCAGGAGAAUUCC | 22 | 6420 |
| myoC-6675 | - | GCCUCCACGUCCAGGAGAAUUCC | 23 | 6421 |
| myoC-6676 | - | GGCCUCCACGUCCAGGAGAAUUCC | 24 | 6422 |
| myoC-3573 | - | GGCGGGAGCGGGACCAGC | 18 | 3319 |
| myoC-3574 | - | AGGCGGGAGCGGGACCAGC | 19 | 3320 |
| myoC-105 | - | GAGGCGGGAGCGGGACCAGC | 20 | 510 |
| myoC-3575 | - | UGAGGCGGGAGCGGGACCAGC | 21 | 3321 |
| myoC-3576 | - | CUGAGGCGGGAGCGGGACCAGC | 22 | 3322 |
| myoC-3577 | - | CCUGAGGCGGGAGCGGGACCAGC | 23 | 3323 |
| myoC-3578 | - | CCCUGAGGCGGGAGCGGGACCAGC | 24 | 3324 |
| myoC-6677 | - | AGAGGUUUCCUCUCCAGC | 18 | 6423 |
| myoC-6678 | - | CAGAGGUUUCCUCUCCAGC | 19 | 6424 |
| myoC-676 | - | GCAGAGGUUUCCUCUCCAGC | 20 | 1006 |
| myoC-6679 | - | GGCAGAGGUUUCCUCUCCAGC | 21 | 6425 |
| myoC-6680 | - | CGGCAGAGGUUUCCUCUCCAGC | 22 | 6426 |
| myoC-6681 | - | CCGGCAGAGGUUUCCUCUCCAGC | 23 | 6427 |
| myoC-6682 | - | CCCGGCAGAGGUUUCCUCUCCAGC | 24 | 6428 |
| myoC-6683 | - | AAGAAUCUUGCUGGCAGC | 18 | 6429 |
| myoC-6684 | - | UAAGAAUCUUGCUGGCAGC | 19 | 6430 |
| myoC-2101 | - | CUAAGAAUCUUGCUGGCAGC | 20 | 2224 |
| myoC-6685 | - | UCUAAGAAUCUUGCUGGCAGC | 21 | 6431 |
| myoC-6686 | - | UUCUAAGAAUCUUGCUGGCAGC | 22 | 6432 |
| myoC-6687 | - | UUUCUAAGAAUCUUGCUGGCAGC | 23 | 6433 |
| myoC-6688 | - | UUUUCUAAGAAUCUUGCUGGCAGC | 24 | 6434 |
| myoC-6689 | - | UAUAAACCUCUCUGGAGC | 18 | 6435 |
| myoC-6690 | - | AUAUAAACCUCUCUGGAGC | 19 | 6436 |

TABLE 10D-continued

| 4th Tier | | | | |
|---|---|---|---|---|
| gRNA Name | DNA Strand | Targeting Domain | Target Site Length | Seq ID |
| myoC-2106 | - | UAUAUAAACCUCUCUGGAGC | 20 | 2228 |
| myoC-6691 | - | AUAUAUAAACCUCUCUGGAGC | 21 | 6437 |
| myoC-6692 | - | UAUAUAUAAACCUCUCUGGAGC | 22 | 6438 |
| myoC-6693 | - | GUAUAUAUAAACCUCUCUGGAGC | 23 | 6439 |
| myoC-6694 | - | AGUAUAUAUAAACCUCUCUGGAGC | 24 | 6440 |
| myoC-6695 | - | GUCCUGGUGCAUCUGAGC | 18 | 6441 |
| myoC-6696 | - | CGUCCUGGUGCAUCUGAGC | 19 | 6442 |
| myoC-1844 | - | UCGUCCUGGUGCAUCUGAGC | 20 | 2054 |
| myoC-6697 | - | AUCGUCCUGGUGCAUCUGAGC | 21 | 6443 |
| myoC-6698 | - | AAUCGUCCUGGUGCAUCUGAGC | 22 | 6444 |
| myoC-6699 | - | GAAUCGUCCUGGUGCAUCUGAGC | 23 | 6445 |
| myoC-6700 | - | UGAAUCGUCCUGGUGCAUCUGAGC | 24 | 6446 |
| myoC-6701 | - | UGCAGGGAGUGGGGACGC | 18 | 6447 |
| myoC-6702 | - | CUGCAGGGAGUGGGGACGC | 19 | 6448 |
| myoC-988 | - | ACUGCAGGGAGUGGGGACGC | 20 | 1288 |
| myoC-6703 | - | GACUGCAGGGAGUGGGGACGC | 21 | 6449 |
| myoC-6704 | - | GGACUGCAGGGAGUGGGGACGC | 22 | 6450 |
| myoC-6705 | - | GGGACUGCAGGGAGUGGGGACGC | 23 | 6451 |
| myoC-6706 | - | GGGGACUGCAGGGAGUGGGGACGC | 24 | 6452 |
| myoC-6707 | - | GAGCGGGUGCUGAAAGGC | 18 | 6453 |
| myoC-6708 | - | UGAGCGGGUGCUGAAAGGC | 19 | 6454 |
| myoC-994 | - | CUGAGCGGGUGCUGAAAGGC | 20 | 1294 |
| myoC-6709 | - | GCUGAGCGGGUGCUGAAAGGC | 21 | 6455 |
| myoC-6710 | - | GGCUGAGCGGGUGCUGAAAGGC | 22 | 6456 |
| myoC-6711 | - | GGGCUGAGCGGGUGCUGAAAGGC | 23 | 6457 |
| myoC-6712 | - | GGGGCUGAGCGGGUGCUGAAAGGC | 24 | 6458 |
| myoC-3585 | - | AGAAGAAGCGACUAAGGC | 18 | 3331 |
| myoC-3586 | - | GAGAAGAAGCGACUAAGGC | 19 | 3332 |
| myoC-1646 | - | AGAGAAGAAGCGACUAAGGC | 20 | 1912 |
| myoC-3587 | - | AAGAGAAGAAGCGACUAAGGC | 21 | 3333 |
| myoC-3588 | - | GAAGAGAAGAAGCGACUAAGGC | 22 | 3334 |
| myoC-3589 | - | GGAAGAGAAGAAGCGACUAAGGC | 23 | 3335 |
| myoC-3590 | - | AGGAAGAGAAGAAGCGACUAAGGC | 24 | 3336 |
| myoC-3591 | - | AGCUGGGCACCCUGAGGC | 18 | 3337 |
| myoC-3592 | - | GAGCUGGGCACCCUGAGGC | 19 | 3338 |
| myoC-103 | - | GGAGCUGGGCACCCUGAGGC | 20 | 508 |
| myoC-3593 | - | GGGAGCUGGGCACCCUGAGGC | 21 | 3339 |
| myoC-3594 | - | AGGGAGCUGGGCACCCUGAGGC | 22 | 3340 |

TABLE 10D-continued

| 4th Tier | | | | |
|---|---|---|---|---|
| gRNA Name | DNA Strand | Targeting Domain | Target Site Length | Seq ID |
| myoC-3595 | – | GAGGGAGCUGGGCACCCUGAGGC | 23 | 3341 |
| myoC-3596 | – | AGAGGGAGCUGGGCACCCUGAGGC | 24 | 3342 |
| myoC-6713 | – | CCUCUCUGGAGCUCGGGC | 18 | 6459 |
| myoC-6714 | – | ACCUCUCUGGAGCUCGGGC | 19 | 6460 |
| myoC-2107 | – | AACCUCUCUGGAGCUCGGGC | 20 | 2229 |
| myoC-6715 | – | AAACCUCUCUGGAGCUCGGGC | 21 | 6461 |
| myoC-6716 | – | UAAACCUCUCUGGAGCUCGGGC | 22 | 6462 |
| myoC-6717 | – | AUAAACCUCUCUGGAGCUCGGGC | 23 | 6463 |
| myoC-6718 | – | UAUAAACCUCUCUGGAGCUCGGGC | 24 | 6464 |
| myoC-6719 | – | CAGUGUUGUUCACGGGGC | 18 | 6465 |
| myoC-6720 | – | UCAGUGUUGUUCACGGGGC | 19 | 6466 |
| myoC-1002 | – | UUCAGUGUUGUUCACGGGGC | 20 | 1302 |
| myoC-6721 | – | GUUCAGUGUUGUUCACGGGGC | 21 | 6467 |
| myoC-6722 | – | UGUUCAGUGUUGUUCACGGGGC | 22 | 6468 |
| myoC-6723 | – | AUGUUCAGUGUUGUUCACGGGGC | 23 | 6469 |
| myoC-6724 | – | GAUGUUCAGUGUUGUUCACGGGGC | 24 | 6470 |
| myoC-3597 | – | GGUGUGGGAUGUGGGGGC | 18 | 3343 |
| myoC-3598 | – | UGGUGUGGGAUGUGGGGGC | 19 | 3344 |
| myoC-1600 | – | CUGGUGUGGGAUGUGGGGGC | 20 | 1881 |
| myoC-3599 | – | CCUGGUGUGGGAUGUGGGGGC | 21 | 3345 |
| myoC-3600 | – | GCCUGGUGUGGGAUGUGGGGGC | 22 | 3346 |
| myoC-3601 | – | UGCCUGGUGUGGGAUGUGGGGGC | 23 | 3347 |
| myoC-3602 | – | CUGCCUGGUGUGGGAUGUGGGGGC | 24 | 3348 |
| myoC-3603 | – | GUUGCUGCAGCUUUGGGC | 18 | 3349 |
| myoC-3604 | – | CGUUGCUGCAGCUUUGGGC | 19 | 3350 |
| myoC-1594 | – | ACGUUGCUGCAGCUUUGGGC | 20 | 1878 |
| myoC-3605 | – | CACGUUGCUGCAGCUUUGGGC | 21 | 3351 |
| myoC-3606 | – | GCACGUUGCUGCAGCUUUGGGC | 22 | 3352 |
| myoC-3607 | – | UGCACGUUGCUGCAGCUUUGGGC | 23 | 3353 |
| myoC-3608 | – | GUGCACGUUGCUGCAGCUUUGGGC | 24 | 3354 |
| myoC-3609 | – | AGAAAAUGAGAAUCUGGC | 18 | 3355 |
| myoC-3610 | – | AAGAAAAUGAGAAUCUGGC | 19 | 3356 |
| myoC-1649 | – | CAAGAAAAUGAGAAUCUGGC | 20 | 1915 |
| myoC-3611 | – | GCAAGAAAAUGAGAAUCUGGC | 21 | 3357 |
| myoC-3612 | – | GGCAAGAAAAUGAGAAUCUGGC | 22 | 3358 |
| myoC-3613 | – | AGGCAAGAAAAUGAGAAUCUGGC | 23 | 3359 |
| myoC-3614 | – | AAGGCAAGAAAAUGAGAAUCUGGC | 24 | 3360 |

TABLE 10D-continued

| 4th Tier | | | | |
|---|---|---|---|---|
| gRNA Name | DNA Strand | Targeting Domain | Target Site Length | Seq ID |
| myoC-6725 | - | CCAGGAGGUGGGGACUGC | 18 | 6471 |
| myoC-6726 | - | UCCAGGAGGUGGGGACUGC | 19 | 6472 |
| myoC-983 | - | UUCCAGGAGGUGGGGACUGC | 20 | 1283 |
| myoC-6727 | - | AUUCCAGGAGGUGGGGACUGC | 21 | 6473 |
| myoC-6728 | - | AAUUCCAGGAGGUGGGGACUGC | 22 | 6474 |
| myoC-6729 | - | GAAUUCCAGGAGGUGGGGACUGC | 23 | 6475 |
| myoC-6730 | - | AGAAUUCCAGGAGGUGGGGACUGC | 24 | 6476 |
| myoC-6731 | - | UUUUUAUCUUUUCUCUGC | 18 | 6477 |
| myoC-6732 | - | CUUUUUAUCUUUUCUCUGC | 19 | 6478 |
| myoC-1898 | - | CCUUUUUAUCUUUUCUCUGC | 20 | 2084 |
| myoC-6733 | - | GCCUUUUUAUCUUUUCUCUGC | 21 | 6479 |
| myoC-6734 | - | AGCCUUUUUAUCUUUUCUCUGC | 22 | 6480 |
| myoC-6735 | - | GAGCCUUUUUAUCUUUUCUCUGC | 23 | 6481 |
| myoC-6736 | - | UGAGCCUUUUUAUCUUUUCUCUGC | 24 | 6482 |
| myoC-6737 | - | CUGCUGCCUCCAUCGUGC | 18 | 6483 |
| myoC-6738 | - | CCUGCUGCCUCCAUCGUGC | 19 | 6484 |
| myoC-1838 | - | CCCUGCUGCCUCCAUCGUGC | 20 | 2049 |
| myoC-6739 | - | CCCCUGCUGCCUCCAUCGUGC | 21 | 6485 |
| myoC-6740 | - | CCCCCUGCUGCCUCCAUCGUGC | 22 | 6486 |
| myoC-6741 | - | GCCCCCUGCUGCCUCCAUCGUGC | 23 | 6487 |
| myoC-6742 | - | CGCCCCCUGCUGCCUCCAUCGUGC | 24 | 6488 |
| myoC-6743 | - | CUAGUCUAACGGAGAAUC | 18 | 6489 |
| myoC-6744 | - | ACUAGUCUAACGGAGAAUC | 19 | 6490 |
| myoC-968 | - | AACUAGUCUAACGGAGAAUC | 20 | 1268 |
| myoC-6745 | - | AAACUAGUCUAACGGAGAAUC | 21 | 6491 |
| myoC-6746 | - | GAAACUAGUCUAACGGAGAAUC | 22 | 6492 |
| myoC-6747 | - | GGAAACUAGUCUAACGGAGAAUC | 23 | 6493 |
| myoC-6748 | - | GGGAAACUAGUCUAACGGAGAAUC | 24 | 6494 |
| myoC-6749 | - | AAGGAAAUAAACACCAUC | 18 | 6495 |
| myoC-6750 | - | AAAGGAAAUAAACACCAUC | 19 | 6496 |
| myoC-1836 | - | GAAAGGAAAUAAACACCAUC | 20 | 2047 |
| myoC-6751 | - | AGAAAGGAAAUAAACACCAUC | 21 | 6497 |
| myoC-6752 | - | AAGAAAGGAAAUAAACACCAUC | 22 | 6498 |
| myoC-6753 | - | AAAGAAAGGAAAUAAACACCAUC | 23 | 6499 |
| myoC-6754 | - | GAAAGAAAGGAAAUAAACACCAUC | 24 | 6500 |
| myoC-3615 | - | GCCAGGACAGCUCAGCUC | 18 | 3361 |
| myoC-3616 | - | GGCCAGGACAGCUCAGCUC | 19 | 3362 |
| myoC-96 | - | GGGCCAGGACAGCUCAGCUC | 20 | 501 |

TABLE 10D-continued

| 4th Tier | | | | |
|---|---|---|---|---|
| gRNA Name | DNA Strand | Targeting Domain | Target Site Length | Seq ID |
| myoC-3617 | - | GGGGCCAGGACAGCUCAGCUC | 21 | 3363 |
| myoC-3618 | - | GGGGGCCAGGACAGCUCAGCUC | 22 | 3364 |
| myoC-3619 | - | UGGGGGCCAGGACAGCUCAGCUC | 23 | 3365 |
| myoC-3620 | - | GUGGGGGCCAGGACAGCUCAGCUC | 24 | 3366 |
| myoC-6755 | - | CUCCUUGGCUCCAGGCUC | 18 | 6501 |
| myoC-6756 | - | ACUCCUUGGCUCCAGGCUC | 19 | 6502 |
| myoC-1845 | - | GACUCCUUGGCUCCAGGCUC | 20 | 2055 |
| myoC-6757 | - | AGACUCCUUGGCUCCAGGCUC | 21 | 6503 |
| myoC-6758 | - | GAGACUCCUUGGCUCCAGGCUC | 22 | 6504 |
| myoC-6759 | - | GGAGACUCCUUGGCUCCAGGCUC | 23 | 6505 |
| myoC-6760 | - | UGGAGACUCCUUGGCUCCAGGCUC | 24 | 6506 |
| myoC-6761 | - | UGUUUUGUUAUCACUCUC | 18 | 6507 |
| myoC-6762 | - | UUGUUUUGUUAUCACUCUC | 19 | 6508 |
| myoC-1821 | - | GUUGUUUUGUUAUCACUCUC | 20 | 2036 |
| myoC-6763 | - | GGUUGUUUUGUUAUCACUCUC | 21 | 6509 |
| myoC-6764 | - | UGGUUGUUUUGUUAUCACUCUC | 22 | 6510 |
| myoC-6765 | - | CUGGUUGUUUUGUUAUCACUCUC | 23 | 6511 |
| myoC-6766 | - | ACUGGUUGUUUUGUUAUCACUCUC | 24 | 6512 |
| myoC-6767 | - | AGUAUAUAUAAACCUCUC | 18 | 6513 |
| myoC-6768 | - | CAGUAUAUAUAAACCUCUC | 19 | 6514 |
| myoC-853 | - | CCAGUAUAUAUAAACCUCUC | 20 | 1197 |
| myoC-6769 | - | CCCAGUAUAUAUAAACCUCUC | 21 | 6515 |
| myoC-6770 | - | CCCCAGUAUAUAUAAACCUCUC | 22 | 6516 |
| myoC-6771 | - | UCCCCAGUAUAUAUAAACCUCUC | 23 | 6517 |
| myoC-6772 | - | CUCCCCAGUAUAUAUAAACCUCUC | 24 | 6518 |
| myoC-6773 | - | UGGAGGUGACAGUUUCUC | 18 | 6519 |
| myoC-6774 | - | GUGGAGGUGACAGUUUCUC | 19 | 6520 |
| myoC-1828 | - | CGUGGAGGUGACAGUUUCUC | 20 | 2041 |
| myoC-6775 | - | UCGUGGAGGUGACAGUUUCUC | 21 | 6521 |
| myoC-6776 | - | UUCGUGGAGGUGACAGUUUCUC | 22 | 6522 |
| myoC-6777 | - | CUUCGUGGAGGUGACAGUUUCUC | 23 | 6523 |
| myoC-6778 | - | CCUUCGUGGAGGUGACAGUUUCUC | 24 | 6524 |
| myoC-6779 | - | GAAAGGGGCCUCCACGUC | 18 | 6525 |
| myoC-6780 | - | GGAAAGGGGCCUCCACGUC | 19 | 6526 |
| myoC-1868 | - | GGGAAAGGGGCCUCCACGUC | 20 | 2067 |
| myoC-6781 | - | AGGGAAAGGGGCCUCCACGUC | 21 | 6527 |
| myoC-6782 | - | GAGGGAAAGGGGCCUCCACGUC | 22 | 6528 |

TABLE 10D-continued

| 4th Tier | | | | |
|---|---|---|---|---|
| gRNA Name | DNA Strand | Targeting Domain | Target Site Length | Seq ID |
| myoC-6783 | - | AGAGGGAAAGGGGCCUCCACGUC | 23 | 6529 |
| myoC-6784 | - | CAGAGGGAAAGGGGCCUCCACGUC | 24 | 6530 |
| myoC-6785 | - | CCCGGGGUCCUGGGUGUC | 18 | 6531 |
| myoC-6786 | - | ACCCGGGGUCCUGGGUGUC | 19 | 6532 |
| myoC-1820 | - | CACCCGGGGUCCUGGGUGUC | 20 | 2035 |
| myoC-6787 | - | GCACCCGGGGUCCUGGGUGUC | 21 | 6533 |
| myoC-6788 | - | AGCACCCGGGGUCCUGGGUGUC | 22 | 6534 |
| myoC-6789 | - | AAGCACCCGGGGUCCUGGGUGUC | 23 | 6535 |
| myoC-6790 | - | CAAGCACCCGGGGUCCUGGGUGUC | 24 | 6536 |
| myoC-6791 | - | CCACGUCCAGGAGAAUUC | 18 | 6537 |
| myoC-6792 | - | UCCACGUCCAGGAGAAUUC | 19 | 6538 |
| myoC-1871 | - | CUCCACGUCCAGGAGAAUUC | 20 | 2069 |
| myoC-6793 | - | CCUCCACGUCCAGGAGAAUUC | 21 | 6539 |
| myoC-6794 | - | GCCUCCACGUCCAGGAGAAUUC | 22 | 6540 |
| myoC-6795 | - | GGCCUCCACGUCCAGGAGAAUUC | 23 | 6541 |
| myoC-6796 | - | GGGCCUCCACGUCCAGGAGAAUUC | 24 | 6542 |
| myoC-6797 | - | UUCCUAGGCCGUUAAUUC | 18 | 6543 |
| myoC-6798 | - | UUUCCUAGGCCGUUAAUUC | 19 | 6544 |
| myoC-1916 | - | AUUUCCUAGGCCGUUAAUUC | 20 | 2096 |
| myoC-6799 | - | CAUUUCCUAGGCCGUUAAUUC | 21 | 6545 |
| myoC-6800 | - | UCAUUUCCUAGGCCGUUAAUUC | 22 | 6546 |
| myoC-6801 | - | CUCAUUUCCUAGGCCGUUAAUUC | 23 | 6547 |
| myoC-6802 | - | GCUCAUUUCCUAGGCCGUUAAUUC | 24 | 6548 |
| myoC-6803 | - | AAACUCCAAACAGACUUC | 18 | 6549 |
| myoC-6804 | - | GAAACUCCAAACAGACUUC | 19 | 6550 |
| myoC-845 | - | AGAAACUCCAAACAGACUUC | 20 | 1179 |
| myoC-6805 | - | AAGAAACUCCAAACAGACUUC | 21 | 6551 |
| myoC-6806 | - | AAAGAAACUCCAAACAGACUUC | 22 | 6552 |
| myoC-6807 | - | AAAAGAAACUCCAAACAGACUUC | 23 | 6553 |
| myoC-6808 | - | AAAAAGAAACUCCAAACAGACUUC | 24 | 6554 |
| myoC-6809 | - | AGUCACUGCCCUACCUUC | 18 | 6555 |
| myoC-6810 | - | CAGUCACUGCCCUACCUUC | 19 | 6556 |
| myoC-1826 | - | GCAGUCACUGCCCUACCUUC | 20 | 2040 |
| myoC-6811 | - | AGCAGUCACUGCCCUACCUUC | 21 | 6557 |
| myoC-6812 | - | AAGCAGUCACUGCCCUACCUUC | 22 | 6558 |
| myoC-6813 | - | AAAGCAGUCACUGCCCUACCUUC | 23 | 6559 |
| myoC-6814 | - | CAAAGCAGUCACUGCCCUACCUUC | 24 | 6560 |
| myoC-6815 | - | GUGCAUGGGUUUUCCUUC | 18 | 6561 |

TABLE 10D-continued

| 4th Tier | | | | |
|---|---|---|---|---|
| gRNA Name | DNA Strand | Targeting Domain | Target Site Length | Seq ID |
| myoC-6816 | – | UGUGCAUGGGUUUUCCUUC | 19 | 6562 |
| myoC-1909 | – | GUGUGCAUGGGUUUUCCUUC | 20 | 2092 |
| myoC-6817 | – | GGUGUGCAUGGGUUUUCCUUC | 21 | 6563 |
| myoC-6818 | – | GGGUGUGCAUGGGUUUUCCUUC | 22 | 6564 |
| myoC-6819 | – | AGGGUGUGCAUGGGUUUUCCUUC | 23 | 6565 |
| myoC-6820 | – | CAGGGUGUGCAUGGGUUUUCCUUC | 24 | 6566 |
| myoC-3621 | – | UCCGAGACAAGUCAGUUC | 18 | 3367 |
| myoC-3622 | – | CUCCGAGACAAGUCAGUUC | 19 | 3368 |
| myoC-191 | – | CCUCCGAGACAAGUCAGUUC | 20 | 577 |
| myoC-3623 | – | UCCUCCGAGACAAGUCAGUUC | 21 | 3369 |
| myoC-3624 | – | CUCCUCCGAGACAAGUCAGUUC | 22 | 3370 |
| myoC-3625 | – | CCUCCUCCGAGACAAGUCAGUUC | 23 | 3371 |
| myoC-3626 | – | ACCUCCUCCGAGACAAGUCAGUUC | 24 | 3372 |
| myoC-6821 | – | AGAUGUUCAGUGUUGUUC | 18 | 6567 |
| myoC-6822 | – | CAGAUGUUCAGUGUUGUUC | 19 | 6568 |
| myoC-1892 | – | CCAGAUGUUCAGUGUUGUUC | 20 | 2081 |
| myoC-6823 | – | CCCAGAUGUUCAGUGUUGUUC | 21 | 6569 |
| myoC-6824 | – | GCCCAGAUGUUCAGUGUUGUUC | 22 | 6570 |
| myoC-6825 | – | UGCCCAGAUGUUCAGUGUUGUUC | 23 | 6571 |
| myoC-6826 | – | CUGCCCAGAUGUUCAGUGUUGUUC | 24 | 6572 |
| myoC-6827 | – | GGAGAAGAAGUCUAUUUC | 18 | 6573 |
| myoC-6828 | – | AGGAGAAGAAGUCUAUUUC | 19 | 6574 |
| myoC-1904 | – | GAGGAGAAGAAGUCUAUUUC | 20 | 2088 |
| myoC-6829 | – | GGAGGAGAAGAAGUCUAUUUC | 21 | 6575 |
| myoC-6830 | – | UGGAGGAGAAGAAGUCUAUUUC | 22 | 6576 |
| myoC-6831 | – | UUGGAGGAGAAGAAGUCUAUUUC | 23 | 6577 |
| myoC-6832 | – | CUUGGAGGAGAAGAAGUCUAUUUC | 24 | 6578 |
| myoC-6833 | – | CAGCACAGCAGAGCUUUC | 18 | 6579 |
| myoC-6834 | – | UCAGCACAGCAGAGCUUUC | 19 | 6580 |
| myoC-2109 | – | CUCAGCACAGCAGAGCUUUC | 20 | 2231 |
| myoC-6835 | – | UCUCAGCACAGCAGAGCUUUC | 21 | 6581 |
| myoC-6836 | – | CUCUCAGCACAGCAGAGCUUUC | 22 | 6582 |
| myoC-6837 | – | CCUCUCAGCACAGCAGAGCUUUC | 23 | 6583 |
| myoC-6838 | – | ACCUCUCAGCACAGCAGAGCUUUC | 24 | 6584 |
| myoC-6839 | – | GUGCUGAAAGGCAGGAAG | 18 | 6585 |
| myoC-6840 | – | GGUGCUGAAAGGCAGGAAG | 19 | 6586 |
| myoC-1889 | – | GGGUGCUGAAAGGCAGGAAG | 20 | 2078 |

TABLE 10D-continued

| 4th Tier | | | | |
|---|---|---|---|---|
| gRNA Name | DNA Strand | Targeting Domain | Target Site Length | Seq ID |
| myoC-6841 | - | CGGGUGCUGAAAGGCAGGAAG | 21 | 6587 |
| myoC-6842 | - | GCGGGUGCUGAAAGGCAGGAAG | 22 | 6588 |
| myoC-6843 | - | AGCGGGUGCUGAAAGGCAGGAAG | 23 | 6589 |
| myoC-6844 | - | GAGCGGGUGCUGAAAGGCAGGAAG | 24 | 6590 |
| myoC-6845 | - | AGGCACCUCUCAGCACAG | 18 | 6591 |
| myoC-6846 | - | CAGGCACCUCUCAGCACAG | 19 | 6592 |
| myoC-2108 | - | CCAGGCACCUCUCAGCACAG | 20 | 2230 |
| myoC-6847 | - | UCCAGGCACCUCUCAGCACAG | 21 | 6593 |
| myoC-6848 | - | AUCCAGGCACCUCUCAGCACAG | 22 | 6594 |
| myoC-6849 | - | CAUCCAGGCACCUCUCAGCACAG | 23 | 6595 |
| myoC-6850 | - | CCAUCCAGGCACCUCUCAGCACAG | 24 | 6596 |
| myoC-6851 | - | GUGUGUGUGUAAAACCAG | 18 | 6597 |
| myoC-6852 | - | UGUGUGUGUGUAAAACCAG | 19 | 6598 |
| myoC-2088 | - | GUGUGUGUGUGUAAAACCAG | 20 | 2216 |
| myoC-6853 | - | UGUGUGUGUGUGUAAAACCAG | 21 | 6599 |
| myoC-6854 | - | GUGUGUGUGUGUGUAAAACCAG | 22 | 6600 |
| myoC-6855 | - | UGUGUGUGUGUGUGUAAAACCAG | 23 | 6601 |
| myoC-6856 | - | GUGUGUGUGUGUGUGUAAAACCAG | 24 | 6602 |
| myoC-3627 | - | AGGCGGGAGCGGGACCAG | 18 | 3373 |
| myoC-3628 | - | GAGGCGGGAGCGGGACCAG | 19 | 3374 |
| myoC-1632 | - | UGAGGCGGGAGCGGGACCAG | 20 | 1902 |
| myoC-3629 | - | CUGAGGCGGGAGCGGGACCAG | 21 | 3375 |
| myoC-3630 | - | CCUGAGGCGGGAGCGGGACCAG | 22 | 3376 |
| myoC-3631 | - | CCCUGAGGCGGGAGCGGGACCAG | 23 | 3377 |
| myoC-3632 | - | ACCCUGAGGCGGGAGCGGGACCAG | 24 | 3378 |
| myoC-3633 | - | AGGCCCCAGGAGACCCAG | 18 | 3379 |
| myoC-3634 | - | CAGGCCCCAGGAGACCCAG | 19 | 3380 |
| myoC-1619 | - | CCAGGCCCCAGGAGACCCAG | 20 | 1895 |
| myoC-3635 | - | GCCAGGCCCCAGGAGACCCAG | 21 | 3381 |
| myoC-3636 | - | UGCCAGGCCCCAGGAGACCCAG | 22 | 3382 |
| myoC-3637 | - | CUGCCAGGCCCCAGGAGACCCAG | 23 | 3383 |
| myoC-3638 | - | GCUGCCAGGCCCCAGGAGACCCAG | 24 | 3384 |
| myoC-6857 | - | CAGAGGUUUCCUCUCCAG | 18 | 6603 |
| myoC-6858 | - | GCAGAGGUUUCCUCUCCAG | 19 | 6604 |
| myoC-1812 | - | GGCAGAGGUUUCCUCUCCAG | 20 | 2032 |
| myoC-6859 | - | CGGCAGAGGUUUCCUCUCCAG | 21 | 6605 |
| myoC-6860 | - | CCGGCAGAGGUUUCCUCUCCAG | 22 | 6606 |
| myoC-6861 | - | CCCGGCAGAGGUUUCCUCUCCAG | 23 | 6607 |

TABLE 10D-continued

| 4th Tier | | | | |
|---|---|---|---|---|
| gRNA Name | DNA Strand | Targeting Domain | Target Site Length | Seq ID |
| myoC-6862 | - | CCCCGGCAGAGGUUUCCUCUCCAG | 24 | 6608 |
| myoC-6863 | - | CACAGCAGAGCUUUCCAG | 18 | 6609 |
| myoC-6864 | - | GCACAGCAGAGCUUUCCAG | 19 | 6610 |
| myoC-2111 | - | AGCACAGCAGAGCUUUCCAG | 20 | 2233 |
| myoC-6865 | - | CAGCACAGCAGAGCUUUCCAG | 21 | 6611 |
| myoC-6866 | - | UCAGCACAGCAGAGCUUUCCAG | 22 | 6612 |
| myoC-6867 | - | CUCAGCACAGCAGAGCUUUCCAG | 23 | 6613 |
| myoC-6868 | - | UCUCAGCACAGCAGAGCUUUCCAG | 24 | 6614 |
| myoC-3639 | - | ACCCAGGAGGGGCUGCAG | 18 | 3385 |
| myoC-3640 | - | GACCCAGGAGGGGCUGCAG | 19 | 3386 |
| myoC-188 | - | AGACCCAGGAGGGGCUGCAG | 20 | 574 |
| myoC-3641 | - | GAGACCCAGGAGGGGCUGCAG | 21 | 3387 |
| myoC-3642 | - | GGAGACCCAGGAGGGGCUGCAG | 22 | 3388 |
| myoC-3643 | - | AGGAGACCCAGGAGGGGCUGCAG | 23 | 3389 |
| myoC-3644 | - | CAGGAGACCCAGGAGGGGCUGCAG | 24 | 3390 |
| myoC-6869 | - | CUCAUGGAAGACGUGCAG | 18 | 6615 |
| myoC-6870 | - | UCUCAUGGAAGACGUGCAG | 19 | 6616 |
| myoC-1831 | - | UUCUCAUGGAAGACGUGCAG | 20 | 2043 |
| myoC-6871 | - | UUUCUCAUGGAAGACGUGCAG | 21 | 6617 |
| myoC-6872 | - | GUUUCUCAUGGAAGACGUGCAG | 22 | 6618 |
| myoC-6873 | - | AGUUUCUCAUGGAAGACGUGCAG | 23 | 6619 |
| myoC-6874 | - | CAGUUUCUCAUGGAAGACGUGCAG | 24 | 6620 |
| myoC-6875 | - | GGGACAGUGUUUCCUCAG | 18 | 6621 |
| myoC-6876 | - | GGGGACAGUGUUUCCUCAG | 19 | 6622 |
| myoC-972 | - | AGGGGACAGUGUUUCCUCAG | 20 | 1272 |
| myoC-6877 | - | GAGGGGACAGUGUUUCCUCAG | 21 | 6623 |
| myoC-6878 | - | GGAGGGGACAGUGUUUCCUCAG | 22 | 6624 |
| myoC-6879 | - | UGGAGGGGACAGUGUUUCCUCAG | 23 | 6625 |
| myoC-6880 | - | CUGGAGGGGACAGUGUUUCCUCAG | 24 | 6626 |
| myoC-3645 | - | UCAGUUCUGGAGGAAGAG | 18 | 3391 |
| myoC-3646 | - | GUCAGUUCUGGAGGAAGAG | 19 | 3392 |
| myoC-1645 | - | AGUCAGUUCUGGAGGAAGAG | 20 | 1911 |
| myoC-3647 | - | AAGUCAGUUCUGGAGGAAGAG | 21 | 3393 |
| myoC-3648 | - | CAAGUCAGUUCUGGAGGAAGAG | 22 | 3394 |
| myoC-3649 | - | ACAAGUCAGUUCUGGAGGAAGAG | 23 | 3395 |
| myoC-3650 | - | GACAAGUCAGUUCUGGAGGAAGAG | 24 | 3396 |
| myoC-3651 | - | GAAUCCAGCUGCCCAGAG | 18 | 3397 |

TABLE 10D-continued

| 4th Tier | | | | |
|---|---|---|---|---|
| gRNA Name | DNA Strand | Targeting Domain | Target Site Length | Seq ID |
| myoC-3652 | - | UGAAUCCAGCUGCCCAGAG | 19 | 3398 |
| myoC-1606 | - | AUGAAUCCAGCUGCCCAGAG | 20 | 1886 |
| myoC-3653 | - | AAUGAAUCCAGCUGCCCAGAG | 21 | 3399 |
| myoC-3654 | - | CAAUGAAUCCAGCUGCCCAGAG | 22 | 3400 |
| myoC-3655 | - | CCAAUGAAUCCAGCUGCCCAGAG | 23 | 3401 |
| myoC-3656 | - | CCCAAUGAAUCCAGCUGCCCAGAG | 24 | 3402 |
| myoC-3657 | - | GAAACCCAAACCAGAGAG | 18 | 3403 |
| myoC-3658 | - | GGAAACCCAAACCAGAGAG | 19 | 3404 |
| myoC-1636 | - | UGGAAACCCAAACCAGAGAG | 20 | 1905 |
| myoC-3659 | - | CUGGAAACCCAAACCAGAGAG | 21 | 3405 |
| myoC-3660 | - | GCUGGAAACCCAAACCAGAGAG | 22 | 3406 |
| myoC-3661 | - | AGCUGGAAACCCAAACCAGAGAG | 23 | 3407 |
| myoC-3662 | - | CAGCUGGAAACCCAAACCAGAGAG | 24 | 3408 |
| myoC-6881 | - | CCAGGAGAAUUCCAGGAG | 18 | 6627 |
| myoC-6882 | - | UCCAGGAGAAUUCCAGGAG | 19 | 6628 |
| myoC-1873 | - | GUCCAGGAGAAUUCCAGGAG | 20 | 2070 |
| myoC-6883 | - | CGUCCAGGAGAAUUCCAGGAG | 21 | 6629 |
| myoC-6884 | - | ACGUCCAGGAGAAUUCCAGGAG | 22 | 6630 |
| myoC-6885 | - | CACGUCCAGGAGAAUUCCAGGAG | 23 | 6631 |
| myoC-6886 | - | CCACGUCCAGGAGAAUUCCAGGAG | 24 | 6632 |
| myoC-6887 | - | UUUCUCUGCUUGGAGGAG | 18 | 6633 |
| myoC-6888 | - | UUUUCUCUGCUUGGAGGAG | 19 | 6634 |
| myoC-1903 | - | CUUUUCUCUGCUUGGAGGAG | 20 | 2087 |
| myoC-6889 | - | UCUUUUCUCUGCUUGGAGGAG | 21 | 6635 |
| myoC-6890 | - | AUCUUUUCUCUGCUUGGAGGAG | 22 | 6636 |
| myoC-6891 | - | UAUCUUUUCUCUGCUUGGAGGAG | 23 | 6637 |
| myoC-6892 | - | UUAUCUUUUCUCUGCUUGGAGGAG | 24 | 6638 |
| myoC-6893 | - | GGUGGGGACUGCAGGGAG | 18 | 6639 |
| myoC-6894 | - | AGGUGGGGACUGCAGGGAG | 19 | 6640 |
| myoC-985 | - | GAGGUGGGGACUGCAGGGAG | 20 | 1285 |
| myoC-6895 | - | GGAGGUGGGGACUGCAGGGAG | 21 | 6641 |
| myoC-6896 | - | AGGAGGUGGGGACUGCAGGGAG | 22 | 6642 |
| myoC-6897 | - | CAGGAGGUGGGGACUGCAGGGAG | 23 | 6643 |
| myoC-6898 | - | CCAGGAGGUGGGGACUGCAGGGAG | 24 | 6644 |
| myoC-3663 | - | GAGGGGCUGCAGAGGGAG | 18 | 3409 |
| myoC-3664 | - | GGAGGGGCUGCAGAGGGAG | 19 | 3410 |
| myoC-1625 | - | AGGAGGGGCUGCAGAGGGAG | 20 | 1898 |
| myoC-3665 | - | CAGGAGGGGCUGCAGAGGGAG | 21 | 3411 |

TABLE 10D-continued

| 4th Tier | | | | |
|---|---|---|---|---|
| gRNA Name | DNA Strand | Targeting Domain | Target Site Length | Seq ID |
| myoC-3666 | - | CCAGGAGGGGCUGCAGAGGGAG | 22 | 3412 |
| myoC-3667 | - | CCCAGGAGGGGCUGCAGAGGGAG | 23 | 3413 |
| myoC-3668 | - | ACCCAGGAGGGGCUGCAGAGGGAG | 24 | 3414 |
| myoC-3669 | - | GGCACCCUGAGGCGGGAG | 18 | 3415 |
| myoC-3670 | - | GGGCACCCUGAGGCGGGAG | 19 | 3416 |
| myoC-190 | - | UGGGCACCCUGAGGCGGGAG | 20 | 576 |
| myoC-3671 | - | CUGGGCACCCUGAGGCGGGAG | 21 | 3417 |
| myoC-3672 | - | GCUGGGCACCCUGAGGCGGGAG | 22 | 3418 |
| myoC-3673 | - | AGCUGGGCACCCUGAGGCGGGAG | 23 | 3419 |
| myoC-3674 | - | GAGCUGGGCACCCUGAGGCGGGAG | 24 | 3420 |
| myoC-6899 | - | UCCAGAAAGGAAAUGGAG | 18 | 6645 |
| myoC-6900 | - | CUCCAGAAAGGAAAUGGAG | 19 | 6646 |
| myoC-965 | - | GCUCCAGAAAGGAAAUGGAG | 20 | 1265 |
| myoC-6901 | - | GGCUCCAGAAAGGAAAUGGAG | 21 | 6647 |
| myoC-6902 | - | AGGCUCCAGAAAGGAAAUGGAG | 22 | 6648 |
| myoC-6903 | - | CAGGCUCCAGAAAGGAAAUGGAG | 23 | 6649 |
| myoC-6904 | - | CCAGGCUCCAGAAAGGAAAUGGAG | 24 | 6650 |
| myoC-6905 | - | UCUUUUCUCUGCUUGGAG | 18 | 6651 |
| myoC-6906 | - | AUCUUUUCUCUGCUUGGAG | 19 | 6652 |
| myoC-1902 | - | UAUCUUUUCUCUGCUUGGAG | 20 | 2086 |
| myoC-6907 | - | UUAUCUUUUCUCUGCUUGGAG | 21 | 6653 |
| myoC-6908 | - | UUUAUCUUUUCUCUGCUUGGAG | 22 | 6654 |
| myoC-6909 | - | UUUUAUCUUUUCUCUGCUUGGAG | 23 | 6655 |
| myoC-6910 | - | UUUUUAUCUUUUCUCUGCUUGGAG | 24 | 6656 |
| myoC-3675 | - | GGAGCUGGGCACCCUGAG | 18 | 3421 |
| myoC-3676 | - | GGGAGCUGGGCACCCUGAG | 19 | 3422 |
| myoC-1627 | - | AGGGAGCUGGGCACCCUGAG | 20 | 1900 |
| myoC-3677 | - | GAGGGAGCUGGGCACCCUGAG | 21 | 3423 |
| myoC-3678 | - | AGAGGGAGCUGGGCACCCUGAG | 22 | 3424 |
| myoC-3679 | - | CAGAGGGAGCUGGGCACCCUGAG | 23 | 3425 |
| myoC-3680 | - | GCAGAGGGAGCUGGGCACCCUGAG | 24 | 3426 |
| myoC-6911 | - | CGUCCUGGUGCAUCUGAG | 18 | 6657 |
| myoC-6912 | - | UCGUCCUGGUGCAUCUGAG | 19 | 6658 |
| myoC-1843 | - | AUCGUCCUGGUGCAUCUGAG | 20 | 2053 |
| myoC-6913 | - | AAUCGUCCUGGUGCAUCUGAG | 21 | 6659 |
| myoC-6914 | - | GAAUCGUCCUGGUGCAUCUGAG | 22 | 6660 |
| myoC-6915 | - | UGAAUCGUCCUGGUGCAUCUGAG | 23 | 6661 |

TABLE 10D-continued

| 4th Tier | | | | |
|---|---|---|---|---|
| gRNA Name | DNA Strand | Targeting Domain | Target Site Length | Seq ID |
| myoC-6916 | - | GUGAAUCGUCCUGGUGCAUCUGAG | 24 | 6662 |
| myoC-6917 | - | CUGCAGGGAGUGGGGACG | 18 | 6663 |
| myoC-6918 | - | ACUGCAGGGAGUGGGGACG | 19 | 6664 |
| myoC-1882 | - | GACUGCAGGGAGUGGGGACG | 20 | 2073 |
| myoC-6919 | - | GGACUGCAGGGAGUGGGGACG | 21 | 6665 |
| myoC-6920 | - | GGGACUGCAGGGAGUGGGGACG | 22 | 6666 |
| myoC-6921 | - | GGGGACUGCAGGGAGUGGGGACG | 23 | 6667 |
| myoC-6922 | - | UGGGGACUGCAGGGAGUGGGGACG | 24 | 6668 |
| myoC-6923 | - | GUCACUGCCCUACCUUCG | 18 | 6669 |
| myoC-6924 | - | AGUCACUGCCCUACCUUCG | 19 | 6670 |
| myoC-690 | - | CAGUCACUGCCCUACCUUCG | 20 | 1100 |
| myoC-6925 | - | GCAGUCACUGCCCUACCUUCG | 21 | 6671 |
| myoC-6926 | - | AGCAGUCACUGCCCUACCUUCG | 22 | 6672 |
| myoC-6927 | - | AAGCAGUCACUGCCCUACCUUCG | 23 | 6673 |
| myoC-6928 | - | AAAGCAGUCACUGCCCUACCUUCG | 24 | 6674 |
| myoC-6929 | - | UGAGCGGGUGCUGAAAGG | 18 | 6675 |
| myoC-6930 | - | CUGAGCGGGUGCUGAAAGG | 19 | 6676 |
| myoC-1887 | - | GCUGAGCGGGUGCUGAAAGG | 20 | 2077 |
| myoC-6931 | - | GGCUGAGCGGGUGCUGAAAGG | 21 | 6677 |
| myoC-6932 | - | GGGCUGAGCGGGUGCUGAAAGG | 22 | 6678 |
| myoC-6933 | - | GGGGCUGAGCGGGUGCUGAAAGG | 23 | 6679 |
| myoC-6934 | - | UGGGGCUGAGCGGGUGCUGAAAGG | 24 | 6680 |
| myoC-6935 | - | AAGGUGAAAAGGGCAAGG | 18 | 6681 |
| myoC-6936 | - | GAAGGUGAAAAGGGCAAGG | 19 | 6682 |
| myoC-1891 | - | GGAAGGUGAAAAGGGCAAGG | 20 | 2080 |
| myoC-6937 | - | AGGAAGGUGAAAAGGGCAAGG | 21 | 6683 |
| myoC-6938 | - | CAGGAAGGUGAAAAGGGCAAGG | 22 | 6684 |
| myoC-6939 | - | GCAGGAAGGUGAAAAGGGCAAGG | 23 | 6685 |
| myoC-6940 | - | GGCAGGAAGGUGAAAAGGGCAAGG | 24 | 6686 |
| myoC-6941 | - | UGUGUGUGUAAAACCAGG | 18 | 6687 |
| myoC-6942 | - | GUGUGUGUGUAAAACCAGG | 19 | 6688 |
| myoC-836 | - | UGUGUGUGUGUAAAACCAGG | 20 | 1218 |
| myoC-6943 | - | GUGUGUGUGUGUAAAACCAGG | 21 | 6689 |
| myoC-6944 | - | UGUGUGUGUGUGUAAAACCAGG | 22 | 6690 |
| myoC-6945 | - | GUGUGUGUGUGUGUAAAACCAGG | 23 | 6691 |
| myoC-6946 | - | UGUGUGUGUGUGUGUAAAACCAGG | 24 | 6692 |
| myoC-3681 | - | GGCCCCAGGAGACCCAGG | 18 | 3427 |
| myoC-3682 | - | AGGCCCCAGGAGACCCAGG | 19 | 3428 |

TABLE 10D-continued

| 4th Tier | | | | |
|---|---|---|---|---|
| gRNA Name | DNA Strand | Targeting Domain | Target Site Length | Seq ID |
| myoC-186 | - | CAGGCCCCAGGAGACCCAGG | 20 | 572 |
| myoC-3683 | - | CCAGGCCCCAGGAGACCCAGG | 21 | 3429 |
| myoC-3684 | - | GCCAGGCCCCAGGAGACCCAGG | 22 | 3430 |
| myoC-3685 | - | UGCCAGGCCCCAGGAGACCCAGG | 23 | 3431 |
| myoC-3686 | - | CUGCCAGGCCCCAGGAGACCCAGG | 24 | 3432 |
| myoC-6947 | - | CAGGAGAAUUCCAGGAGG | 18 | 6693 |
| myoC-6948 | - | CCAGGAGAAUUCCAGGAGG | 19 | 6694 |
| myoC-980 | - | UCCAGGAGAAUUCCAGGAGG | 20 | 1280 |
| myoC-6949 | - | GUCCAGGAGAAUUCCAGGAGG | 21 | 6695 |
| myoC-6950 | - | CGUCCAGGAGAAUUCCAGGAGG | 22 | 6696 |
| myoC-6951 | - | ACGUCCAGGAGAAUUCCAGGAGG | 23 | 6697 |
| myoC-6952 | - | CACGUCCAGGAGAAUUCCAGGAGG | 24 | 6698 |
| myoC-3693 | - | ACAAGUCAGUUCUGGAGG | 18 | 3439 |
| myoC-3694 | - | GACAAGUCAGUUCUGGAGG | 19 | 3440 |
| myoC-1643 | - | AGACAAGUCAGUUCUGGAGG | 20 | 1909 |
| myoC-3695 | - | GAGACAAGUCAGUUCUGGAGG | 21 | 3441 |
| myoC-3696 | - | CGAGACAAGUCAGUUCUGGAGG | 22 | 3442 |
| myoC-3697 | - | CCGAGACAAGUCAGUUCUGGAGG | 23 | 3443 |
| myoC-3698 | - | UCCGAGACAAGUCAGUUCUGGAGG | 24 | 3444 |
| myoC-3699 | - | GAGCUGGGCACCCUGAGG | 18 | 3445 |
| myoC-3700 | - | GGAGCUGGGCACCCUGAGG | 19 | 3446 |
| myoC-102 | - | GGGAGCUGGGCACCCUGAGG | 20 | 507 |
| myoC-3701 | - | AGGGAGCUGGGCACCCUGAGG | 21 | 3447 |
| myoC-3702 | - | GAGGGAGCUGGGCACCCUGAGG | 22 | 3448 |
| myoC-3703 | - | AGAGGGAGCUGGGCACCCUGAGG | 23 | 3449 |
| myoC-3704 | - | CAGAGGGAGCUGGGCACCCUGAGG | 24 | 3450 |
| myoC-6953 | - | UAGGCCGUUAAUUCACGG | 18 | 6699 |
| myoC-6954 | - | CUAGGCCGUUAAUUCACGG | 19 | 6700 |
| myoC-1918 | - | CCUAGGCCGUUAAUUCACGG | 20 | 2097 |
| myoC-6955 | - | UCCUAGGCCGUUAAUUCACGG | 21 | 6701 |
| myoC-6956 | - | UUCCUAGGCCGUUAAUUCACGG | 22 | 6702 |
| myoC-6957 | - | UUUCCUAGGCCGUUAAUUCACGG | 23 | 6703 |
| myoC-6958 | - | AUUUCCUAGGCCGUUAAUUCACGG | 24 | 6704 |
| myoC-6959 | - | UCAGUGUUGUUCACGGGG | 18 | 6705 |
| myoC-6960 | - | UUCAGUGUUGUUCACGGGG | 19 | 6706 |
| myoC-1894 | - | GUUCAGUGUUGUUCACGGGG | 20 | 2082 |
| myoC-6961 | - | UGUUCAGUGUUGUUCACGGGG | 21 | 6707 |

TABLE 10D-continued

| 4th Tier | | | | |
|---|---|---|---|---|
| gRNA Name | DNA Strand | Targeting Domain | Target Site Length | Seq ID |
| myoC-6962 | - | AUGUUCAGUGUUGUUCACGGGG | 22 | 6708 |
| myoC-6963 | - | GAUGUUCAGUGUUGUUCACGGGG | 23 | 6709 |
| myoC-6964 | - | AGAUGUUCAGUGUUGUUCACGGGG | 24 | 6710 |
| myoC-6965 | - | GGAGUGGGGACGCUGGGG | 18 | 6711 |
| myoC-6966 | - | GGGAGUGGGGACGCUGGGG | 19 | 6712 |
| myoC-1884 | - | AGGGAGUGGGGACGCUGGGG | 20 | 2074 |
| myoC-6967 | - | CAGGGAGUGGGGACGCUGGGG | 21 | 6713 |
| myoC-6968 | - | GCAGGGAGUGGGGACGCUGGGG | 22 | 6714 |
| myoC-6969 | - | UGCAGGGAGUGGGGACGCUGGGG | 23 | 6715 |
| myoC-6970 | - | CUGCAGGGAGUGGGGACGCUGGGG | 24 | 6716 |
| myoC-6971 | - | GGUUUCCUCUCCAGCUGG | 18 | 6717 |
| myoC-6972 | - | AGGUUUCCUCUCCAGCUGG | 19 | 6718 |
| myoC-679 | - | GAGGUUUCCUCUCCAGCUGG | 20 | 1005 |
| myoC-6973 | - | AGAGGUUUCCUCUCCAGCUGG | 21 | 6719 |
| myoC-6974 | - | CAGAGGUUUCCUCUCCAGCUGG | 22 | 6720 |
| myoC-6975 | - | GCAGAGGUUUCCUCUCCAGCUGG | 23 | 6721 |
| myoC-6976 | - | GGCAGAGGUUUCCUCUCCAGCUGG | 24 | 6722 |
| myoC-6977 | - | GUCUAACGGAGAAUCUGG | 18 | 6723 |
| myoC-6978 | - | AGUCUAACGGAGAAUCUGG | 19 | 6724 |
| myoC-969 | - | UAGUCUAACGGAGAAUCUGG | 20 | 1269 |
| myoC-6979 | - | CUAGUCUAACGGAGAAUCUGG | 21 | 6725 |
| myoC-6980 | - | ACUAGUCUAACGGAGAAUCUGG | 22 | 6726 |
| myoC-6981 | - | AACUAGUCUAACGGAGAAUCUGG | 23 | 6727 |
| myoC-6982 | - | AAACUAGUCUAACGGAGAAUCUGG | 24 | 6728 |
| myoC-3705 | - | GAGACAAGUCAGUUCUGG | 18 | 3451 |
| myoC-3706 | - | CGAGACAAGUCAGUUCUGG | 19 | 3452 |
| myoC-192 | - | CCGAGACAAGUCAGUUCUGG | 20 | 578 |
| myoC-3707 | - | UCCGAGACAAGUCAGUUCUGG | 21 | 3453 |
| myoC-3708 | - | CUCCGAGACAAGUCAGUUCUGG | 22 | 3454 |
| myoC-3709 | - | CCUCCGAGACAAGUCAGUUCUGG | 23 | 3455 |
| myoC-3710 | - | UCCUCCGAGACAAGUCAGUUCUGG | 24 | 3456 |
| myoC-6983 | - | UAUCUUUUCUCUGCUUGG | 18 | 6729 |
| myoC-6984 | - | UUAUCUUUUCUCUGCUUGG | 19 | 6730 |
| myoC-1005 | - | UUUAUCUUUUCUCUGCUUGG | 20 | 1305 |
| myoC-6985 | - | UUUUAUCUUUUCUCUGCUUGG | 21 | 6731 |
| myoC-6986 | - | UUUUUAUCUUUUCUCUGCUUGG | 22 | 6732 |
| myoC-6987 | - | CUUUUUAUCUUUUCUCUGCUUGG | 23 | 6733 |
| myoC-6988 | - | CCUUUUUAUCUUUUCUCUGCUUGG | 24 | 6734 |

TABLE 10D-continued

| 4th Tier | | | | |
|---|---|---|---|---|
| gRNA Name | DNA Strand | Targeting Domain | Target Site Length | Seq ID |
| myoC-6989 | - | GACACCAGAGACAAAAUG | 18 | 6735 |
| myoC-6990 | - | AGACACCAGAGACAAAAUG | 19 | 6736 |
| myoC-1825 | - | CAGACACCAGAGACAAAAUG | 20 | 2039 |
| myoC-6991 | - | CCAGACACCAGAGACAAAAUG | 21 | 6737 |
| myoC-6992 | - | GCCAGACACCAGAGACAAAAUG | 22 | 6738 |
| myoC-6993 | - | UGCCAGACACCAGAGACAAAAUG | 23 | 6739 |
| myoC-6994 | - | CUGCCAGACACCAGAGACAAAAUG | 24 | 6740 |
| myoC-6995 | - | GGCUCCAGAAAGGAAAUG | 18 | 6741 |
| myoC-6996 | - | AGGCUCCAGAAAGGAAAUG | 19 | 6742 |
| myoC-1850 | - | CAGGCUCCAGAAAGGAAAUG | 20 | 2058 |
| myoC-6997 | - | CCAGGCUCCAGAAAGGAAAUG | 21 | 6743 |
| myoC-6998 | - | UCCAGGCUCCAGAAAGGAAAUG | 22 | 6744 |
| myoC-6999 | - | CUCCAGGCUCCAGAAAGGAAAUG | 23 | 6745 |
| myoC-7000 | - | GCUCCAGGCUCCAGAAAGGAAAUG | 24 | 6746 |
| myoC-7001 | - | CCUCUGUCUUCCCCCAUG | 18 | 6747 |
| myoC-7002 | - | ACCUCUGUCUUCCCCCAUG | 19 | 6748 |
| myoC-2103 | - | CACCUCUGUCUUCCCCCAUG | 20 | 2226 |
| myoC-7003 | - | CCACCUCUGUCUUCCCCCAUG | 21 | 6749 |
| myoC-7004 | - | GCCACCUCUGUCUUCCCCCAUG | 22 | 6750 |
| myoC-7005 | - | GGCCACCUCUGUCUUCCCCCAUG | 23 | 6751 |
| myoC-7006 | - | UGGCCACCUCUGUCUUCCCCCAUG | 24 | 6752 |
| myoC-7007 | - | GAAGAAGUCUAUUUCAUG | 18 | 6753 |
| myoC-7008 | - | AGAAGAAGUCUAUUUCAUG | 19 | 6754 |
| myoC-1905 | - | GAGAAGAAGUCUAUUUCAUG | 20 | 2089 |
| myoC-7009 | - | GGAGAAGAAGUCUAUUUCAUG | 21 | 6755 |
| myoC-7010 | - | AGGAGAAGAAGUCUAUUUCAUG | 22 | 6756 |
| myoC-7011 | - | GAGGAGAAGAAGUCUAUUUCAUG | 23 | 6757 |
| myoC-7012 | - | GGAGGAGAAGAAGUCUAUUUCAUG | 24 | 6758 |
| myoC-3711 | - | CCUGCCUGGUGUGGGAUG | 18 | 3457 |
| myoC-3712 | - | GCCUGCCUGGUGUGGGAUG | 19 | 3458 |
| myoC-94 | - | GGCCUGCCUGGUGUGGGAUG | 20 | 499 |
| myoC-3713 | - | UGGCCUGCCUGGUGUGGGAUG | 21 | 3459 |
| myoC-3714 | - | CUGGCCUGCCUGGUGUGGGAUG | 22 | 3460 |
| myoC-3715 | - | UCUGGCCUGCCUGGUGUGGGAUG | 23 | 3461 |
| myoC-3716 | - | UUCUGGCCUGCCUGGUGUGGGAUG | 24 | 3462 |
| myoC-7013 | - | UCCAGGAGGUGGGGACUG | 18 | 6759 |
| myoC-7014 | - | UUCCAGGAGGUGGGGACUG | 19 | 6760 |

TABLE 10D-continued

| 4th Tier | | | | |
|---|---|---|---|---|
| gRNA Name | DNA Strand | Targeting Domain | Target Site Length | Seq ID |
| myoC-1876 | - | AUUCCAGGAGGUGGGGACUG | 20 | 2071 |
| myoC-7015 | - | AAUUCCAGGAGGUGGGGACUG | 21 | 6761 |
| myoC-7016 | - | GAAUUCCAGGAGGUGGGGACUG | 22 | 6762 |
| myoC-7017 | - | AGAAUUCCAGGAGGUGGGGACUG | 23 | 6763 |
| myoC-7018 | - | GAGAAUUCCAGGAGGUGGGGACUG | 24 | 6764 |
| myoC-3717 | - | GCUCGACUCAGCUCCCUG | 18 | 3463 |
| myoC-3718 | - | AGCUCGACUCAGCUCCCUG | 19 | 3464 |
| myoC-1613 | - | AAGCUCGACUCAGCUCCCUG | 20 | 1891 |
| myoC-3719 | - | AAAGCUCGACUCAGCUCCCUG | 21 | 3465 |
| myoC-3720 | - | CAAAGCUCGACUCAGCUCCCUG | 22 | 3466 |
| myoC-3721 | - | CCAAAGCUCGACUCAGCUCCCUG | 23 | 3467 |
| myoC-3722 | - | ACCAAAGCUCGACUCAGCUCCCUG | 24 | 3468 |
| myoC-7019 | - | AGGUUUCCUCUCCAGCUG | 18 | 6765 |
| myoC-7020 | - | GAGGUUUCCUCUCCAGCUG | 19 | 6766 |
| myoC-678 | - | AGAGGUUUCCUCUCCAGCUG | 20 | 1085 |
| myoC-7021 | - | CAGAGGUUUCCUCUCCAGCUG | 21 | 6767 |
| myoC-7022 | - | GCAGAGGUUUCCUCUCCAGCUG | 22 | 6768 |
| myoC-7023 | - | GGCAGAGGUUUCCUCUCCAGCUG | 23 | 6769 |
| myoC-7024 | - | CGGCAGAGGUUUCCUCUCCAGCUG | 24 | 6770 |
| myoC-3723 | - | GAGACCCAGGAGGGGCUG | 18 | 3469 |
| myoC-3724 | - | GGAGACCCAGGAGGGGCUG | 19 | 3470 |
| myoC-1621 | - | AGGAGACCCAGGAGGGGCUG | 20 | 1896 |
| myoC-3725 | - | CAGGAGACCCAGGAGGGGCUG | 21 | 3471 |
| myoC-3726 | - | CCAGGAGACCCAGGAGGGGCUG | 22 | 3472 |
| myoC-3727 | - | CCCAGGAGACCCAGGAGGGGCUG | 23 | 3473 |
| myoC-3728 | - | CCCCAGGAGACCCAGGAGGGGCUG | 24 | 3474 |
| myoC-7025 | - | AGUCUAACGGAGAAUCUG | 18 | 6771 |
| myoC-7026 | - | UAGUCUAACGGAGAAUCUG | 19 | 6772 |
| myoC-1859 | - | CUAGUCUAACGGAGAAUCUG | 20 | 2063 |
| myoC-7027 | - | ACUAGUCUAACGGAGAAUCUG | 21 | 6773 |
| myoC-7028 | - | AACUAGUCUAACGGAGAAUCUG | 22 | 6774 |
| myoC-7029 | - | AAACUAGUCUAACGGAGAAUCUG | 23 | 6775 |
| myoC-7030 | - | GAAACUAGUCUAACGGAGAAUCUG | 24 | 6776 |
| myoC-3729 | - | CGAGACAAGUCAGUUCUG | 18 | 3475 |
| myoC-3730 | - | CCGAGACAAGUCAGUUCUG | 19 | 3476 |
| myoC-1641 | - | UCCGAGACAAGUCAGUUCUG | 20 | 1908 |
| myoC-3731 | - | CUCCGAGACAAGUCAGUUCUG | 21 | 3477 |
| myoC-3732 | - | CCUCCGAGACAAGUCAGUUCUG | 22 | 3478 |

TABLE 10D-continued

| 4th Tier | | | | |
|---|---|---|---|---|
| gRNA Name | DNA Strand | Targeting Domain | Target Site Length | Seq ID |
| myoC-3733 | - | UCCUCCGAGACAAGUCAGUUCUG | 23 | 3479 |
| myoC-3734 | - | CUCCUCCGAGACAAGUCAGUUCUG | 24 | 3480 |
| myoC-7031 | - | GCCAACUUAAACCCAGUG | 18 | 6777 |
| myoC-7032 | - | AGCCAACUUAAACCCAGUG | 19 | 6778 |
| myoC-1832 | - | CAGCCAACUUAAACCCAGUG | 20 | 2044 |
| myoC-7033 | - | CCAGCCAACUUAAACCCAGUG | 21 | 6779 |
| myoC-7034 | - | GCCAGCCAACUUAAACCCAGUG | 22 | 6780 |
| myoC-7035 | - | AGCCAGCCAACUUAAACCCAGUG | 23 | 6781 |
| myoC-7036 | - | UAGCCAGCCAACUUAAACCCAGUG | 24 | 6782 |
| myoC-7037 | - | UUUCUCAUGGAAGACGUG | 18 | 6783 |
| myoC-7038 | - | GUUUCUCAUGGAAGACGUG | 19 | 6784 |
| myoC-1830 | - | AGUUUCUCAUGGAAGACGUG | 20 | 2042 |
| myoC-7039 | - | CAGUUUCUCAUGGAAGACGUG | 21 | 6785 |
| myoC-7040 | - | ACAGUUUCUCAUGGAAGACGUG | 22 | 6786 |
| myoC-7041 | - | GACAGUUUCUCAUGGAAGACGUG | 23 | 6787 |
| myoC-7042 | - | UGACAGUUUCUCAUGGAAGACGUG | 24 | 6788 |
| myoC-7043 | - | GCUGGGGCUGAGCGGGUG | 18 | 6789 |
| myoC-7044 | - | CGCUGGGGCUGAGCGGGUG | 19 | 6790 |
| myoC-1886 | - | ACGCUGGGGCUGAGCGGGUG | 20 | 2076 |
| myoC-7045 | - | GACGCUGGGGCUGAGCGGGUG | 21 | 6791 |
| myoC-7046 | - | GGACGCUGGGGCUGAGCGGGUG | 22 | 6792 |
| myoC-7047 | - | GGGACGCUGGGGCUGAGCGGGUG | 23 | 6793 |
| myoC-7048 | - | GGGGACGCUGGGGCUGAGCGGGUG | 24 | 6794 |
| myoC-7049 | - | ACUAGAAAUAUAUCCUUG | 18 | 6795 |
| myoC-7050 | - | AACUAGAAAUAUAUCCUUG | 19 | 6796 |
| myoC-2087 | - | AAACUAGAAAUAUAUCCUUG | 20 | 2215 |
| myoC-7051 | - | UAAACUAGAAAUAUAUCCUUG | 21 | 6797 |
| myoC-7052 | - | AUAAACUAGAAAUAUAUCCUUG | 22 | 6798 |
| myoC-7053 | - | UAUAAACUAGAAAUAUAUCCUUG | 23 | 6799 |
| myoC-7054 | - | AUAUAAACUAGAAAUAUAUCCUUG | 24 | 6800 |
| myoC-7055 | - | UUAUCUUUUCUCUGCUUG | 18 | 6801 |
| myoC-7056 | - | UUUAUCUUUUCUCUGCUUG | 19 | 6802 |
| myoC-1900 | - | UUUUAUCUUUUCUCUGCUUG | 20 | 2085 |
| myoC-7057 | - | UUUUUAUCUUUUCUCUGCUUG | 21 | 6803 |
| myoC-7058 | - | CUUUUUAUCUUUUCUCUGCUUG | 22 | 6804 |
| myoC-7059 | - | CCUUUUUAUCUUUUCUCUGCUUG | 23 | 6805 |
| myoC-7060 | - | GCCUUUUUAUCUUUUCUCUGCUUG | 24 | 6806 |

TABLE 10D-continued

| 4th Tier | | | | |
|---|---|---|---|---|
| gRNA Name | DNA Strand | Targeting Domain | Target Site Length | Seq ID |
| myoC-7061 | - | ACUAGUCUAACGGAGAAU | 18 | 6807 |
| myoC-7062 | - | AACUAGUCUAACGGAGAAU | 19 | 6808 |
| myoC-1857 | - | AAACUAGUCUAACGGAGAAU | 20 | 2062 |
| myoC-7063 | - | GAAACUAGUCUAACGGAGAAU | 21 | 6809 |
| myoC-7064 | - | GGAAACUAGUCUAACGGAGAAU | 22 | 6810 |
| myoC-7065 | - | GGGAAACUAGUCUAACGGAGAAU | 23 | 6811 |
| myoC-7066 | - | AGGGAAACUAGUCUAACGGAGAAU | 24 | 6812 |
| myoC-7067 | - | UGAAUCGUCCUGGUGCAU | 18 | 6813 |
| myoC-7068 | - | GUGAAUCGUCCUGGUGCAU | 19 | 6814 |
| myoC-1842 | - | CGUGAAUCGUCCUGGUGCAU | 20 | 2052 |
| myoC-7069 | - | CCGUGAAUCGUCCUGGUGCAU | 21 | 6815 |
| myoC-7070 | - | CCCGUGAAUCGUCCUGGUGCAU | 22 | 6816 |
| myoC-7071 | - | UCCCGUGAAUCGUCCUGGUGCAU | 23 | 6817 |
| myoC-7072 | - | UUCCCGUGAAUCGUCCUGGUGCAU | 24 | 6818 |
| myoC-3735 | - | GCCUGCCUGGUGUGGGAU | 18 | 3481 |
| myoC-3736 | - | GGCCUGCCUGGUGUGGGAU | 19 | 3482 |
| myoC-1597 | - | UGGCCUGCCUGGUGUGGGAU | 20 | 1880 |
| myoC-3737 | - | CUGGCCUGCCUGGUGUGGGAU | 21 | 3483 |
| myoC-3738 | - | UCUGGCCUGCCUGGUGUGGGAU | 22 | 3484 |
| myoC-3739 | - | UUCUGGCCUGCCUGGUGUGGGAU | 23 | 3485 |
| myoC-3740 | - | CUUCUGGCCUGCCUGGUGUGGGAU | 24 | 3486 |
| myoC-7073 | - | UUUAUUUAAUGGGAAUAU | 18 | 6819 |
| myoC-7074 | - | CUUUAUUUAAUGGGAAUAU | 19 | 6820 |
| myoC-1015 | - | CCUUUAUUUAAUGGGAAUAU | 20 | 1315 |
| myoC-7075 | - | GCCUUUAUUUAAUGGGAAUAU | 21 | 6821 |
| myoC-7076 | - | GGCCUUUAUUUAAUGGGAAUAU | 22 | 6822 |
| myoC-7077 | - | AGGCCUUUAUUUAAUGGGAAUAU | 23 | 6823 |
| myoC-7078 | - | AAGGCCUUUAUUUAAUGGGAAUAU | 24 | 6824 |
| myoC-7079 | - | AAAACCAGGUGGAGAUAU | 18 | 6825 |
| myoC-7080 | - | UAAAACCAGGUGGAGAUAU | 19 | 6826 |
| myoC-837 | - | GUAAAACCAGGUGGAGAUAU | 20 | 994 |
| myoC-7081 | - | UGUAAAACCAGGUGGAGAUAU | 21 | 6827 |
| myoC-7082 | - | GUGUAAAACCAGGUGGAGAUAU | 22 | 6828 |
| myoC-7083 | - | UGUGUAAAACCAGGUGGAGAUAU | 23 | 6829 |
| myoC-7084 | - | GUGUGUAAAACCAGGUGGAGAUAU | 24 | 6830 |
| myoC-3741 | - | UGCCUACAGCAACCUCCU | 18 | 3487 |
| myoC-3742 | - | CUGCCUACAGCAACCUCCU | 19 | 3488 |
| myoC-1638 | - | ACUGCCUACAGCAACCUCCU | 20 | 1906 |

TABLE 10D-continued

| 4th Tier | | | | |
|---|---|---|---|---|
| gRNA Name | DNA Strand | Targeting Domain | Target Site Length | Seq ID |
| myoC-3743 | - | GACUGCCUACAGCAACCUCCU | 21 | 3489 |
| myoC-3744 | - | AGACUGCCUACAGCAACCUCCU | 22 | 3490 |
| myoC-3745 | - | GAGACUGCCUACAGCAACCUCCU | 23 | 3491 |
| myoC-3746 | - | GGAGACUGCCUACAGCAACCUCCU | 24 | 3492 |
| myoC-7085 | - | AGUUUUCCGUUGCUUCCU | 18 | 6831 |
| myoC-7086 | - | GAGUUUUCCGUUGCUUCCU | 19 | 6832 |
| myoC-1897 | - | GGAGUUUUCCGUUGCUUCCU | 20 | 2083 |
| myoC-7087 | - | GGGAGUUUUCCGUUGCUUCCU | 21 | 6833 |
| myoC-7088 | - | UGGGAGUUUUCCGUUGCUUCCU | 22 | 6834 |
| myoC-7089 | - | CUGGGAGUUUUCCGUUGCUUCCU | 23 | 6835 |
| myoC-7090 | - | GCUGGGAGUUUUCCGUUGCUUCCU | 24 | 6836 |
| myoC-7091 | - | GAGGGGACAGUGUUUCCU | 18 | 6837 |
| myoC-7092 | - | GGAGGGGACAGUGUUUCCU | 19 | 6838 |
| myoC-1862 | - | UGGAGGGGACAGUGUUUCCU | 20 | 2064 |
| myoC-7093 | - | CUGGAGGGGACAGUGUUUCCU | 21 | 6839 |
| myoC-7094 | - | UCUGGAGGGGACAGUGUUUCCU | 22 | 6840 |
| myoC-7095 | - | AUCUGGAGGGGACAGUGUUUCCU | 23 | 6841 |
| myoC-7096 | - | AAUCUGGAGGGGACAGUGUUUCCU | 24 | 6842 |
| myoC-7097 | - | GAGGUUUCCUCUCCAGCU | 18 | 6843 |
| myoC-7098 | - | AGAGGUUUCCUCUCCAGCU | 19 | 6844 |
| myoC-677 | - | CAGAGGUUUCCUCUCCAGCU | 20 | 1097 |
| myoC-7099 | - | GCAGAGGUUUCCUCUCCAGCU | 21 | 6845 |
| myoC-7100 | - | GGCAGAGGUUUCCUCUCCAGCU | 22 | 6846 |
| myoC-7101 | - | CGGCAGAGGUUUCCUCUCCAGCU | 23 | 6847 |
| myoC-7102 | - | CCGGCAGAGGUUUCCUCUCCAGCU | 24 | 6848 |
| myoC-3747 | - | GUGCACGUUGCUGCAGCU | 18 | 3493 |
| myoC-3748 | - | UGUGCACGUUGCUGCAGCU | 19 | 3494 |
| myoC-1593 | - | CUGUGCACGUUGCUGCAGCU | 20 | 1877 |
| myoC-3749 | - | UCUGUGCACGUUGCUGCAGCU | 21 | 3495 |
| myoC-3750 | - | UUCUGUGCACGUUGCUGCAGCU | 22 | 3496 |
| myoC-3751 | - | CUUCUGUGCACGUUGCUGCAGCU | 23 | 3497 |
| myoC-3752 | - | UCUUCUGUGCACGUUGCUGCAGCU | 24 | 3498 |
| myoC-3753 | - | GGCCAGGACAGCUCAGCU | 18 | 3499 |
| myoC-3754 | - | GGGCCAGGACAGCUCAGCU | 19 | 3500 |
| myoC-1601 | - | GGGGCCAGGACAGCUCAGCU | 20 | 1882 |
| myoC-3755 | - | GGGGGCCAGGACAGCUCAGCU | 21 | 3501 |
| myoC-3756 | - | UGGGGGCCAGGACAGCUCAGCU | 22 | 3502 |

TABLE 10D-continued

| 4th Tier | | | | |
|---|---|---|---|---|
| gRNA Name | DNA Strand | Targeting Domain | Target Site Length | Seq ID |
| myoC-3757 | - | GUGGGGGCCAGGACAGCUCAGCU | 23 | 3503 |
| myoC-3758 | - | UGUGGGGGCCAGGACAGCUCAGCU | 24 | 3504 |
| myoC-7103 | - | UUUUAUCUUUUCUCUGCU | 18 | 6849 |
| myoC-7104 | - | UUUUUAUCUUUUCUCUGCU | 19 | 6850 |
| myoC-1004 | - | CUUUUUAUCUUUUCUCUGCU | 20 | 1304 |
| myoC-7105 | - | CCUUUUUAUCUUUUCUCUGCU | 21 | 6851 |
| myoC-7106 | - | GCCUUUUUAUCUUUUCUCUGCU | 22 | 6852 |
| myoC-7107 | - | AGCCUUUUUAUCUUUUCUCUGCU | 23 | 6853 |
| myoC-7108 | - | GAGCCUUUUUAUCUUUUCUCUGCU | 24 | 6854 |
| myoC-7109 | - | CAGUAUAUAUAAACCUCU | 18 | 6855 |
| myoC-7110 | - | CCAGUAUAUAUAAACCUCU | 19 | 6856 |
| myoC-2104 | - | CCCAGUAUAUAUAAACCUCU | 20 | 2227 |
| myoC-7111 | - | CCCCAGUAUAUAUAAACCUCU | 21 | 6857 |
| myoC-7112 | - | UCCCCAGUAUAUAUAAACCUCU | 22 | 6858 |
| myoC-7113 | - | CUCCCCAGUAUAUAUAAACCUCU | 23 | 6859 |
| myoC-7114 | - | GCUCCCCAGUAUAUAUAAACCUCU | 24 | 6860 |
| myoC-7115 | - | GUUUUGUUAUCACUCUCU | 18 | 6861 |
| myoC-7116 | - | UGUUUUGUUAUCACUCUCU | 19 | 6862 |
| myoC-686 | - | UUGUUUUGUUAUCACUCUCU | 20 | 1124 |
| myoC-7117 | - | GUUGUUUUGUUAUCACUCUCU | 21 | 6863 |
| myoC-7118 | - | GGUUGUUUUGUUAUCACUCUCU | 22 | 6864 |
| myoC-7119 | - | UGGUUGUUUUGUUAUCACUCUCU | 23 | 6865 |
| myoC-7120 | - | CUGGUUGUUUUGUUAUCACUCUCU | 24 | 6866 |
| myoC-3759 | - | AAACCCAAACCAGAGAGU | 18 | 3505 |
| myoC-3760 | - | GAAACCCAAACCAGAGAGU | 19 | 3506 |
| myoC-106 | - | GGAAACCCAAACCAGAGAGU | 20 | 479 |
| myoC-3761 | - | UGGAAACCCAAACCAGAGAGU | 21 | 3507 |
| myoC-3762 | - | CUGGAAACCCAAACCAGAGAGU | 22 | 3508 |
| myoC-3763 | - | GCUGGAAACCCAAACCAGAGAGU | 23 | 3509 |
| myoC-3764 | - | AGCUGGAAACCCAAACCAGAGAGU | 24 | 3510 |
| myoC-7121 | - | GUGGGGACUGCAGGGAGU | 18 | 6867 |
| myoC-7122 | - | GGUGGGGACUGCAGGGAGU | 19 | 6868 |
| myoC-986 | - | AGGUGGGGACUGCAGGGAGU | 20 | 1286 |
| myoC-7123 | - | GAGGUGGGGACUGCAGGGAGU | 21 | 6869 |
| myoC-7124 | - | GGAGGUGGGGACUGCAGGGAGU | 22 | 6870 |
| myoC-7125 | - | AGGAGGUGGGGACUGCAGGGAGU | 23 | 6871 |
| myoC-7126 | - | CAGGAGGUGGGGACUGCAGGGAGU | 24 | 6872 |
| myoC-7127 | - | AGGAGAAUUCCAGGAGGU | 18 | 6873 |

TABLE 10D-continued

| 4th Tier | | | | |
|---|---|---|---|---|
| gRNA Name | DNA Strand | Targeting Domain | Target Site Length | Seq ID |
| myoC-7128 | - | CAGGAGAAUUCCAGGAGGU | 19 | 6874 |
| myoC-981 | - | CCAGGAGAAUUCCAGGAGGU | 20 | 1281 |
| myoC-7129 | - | UCCAGGAGAAUUCCAGGAGGU | 21 | 6875 |
| myoC-7130 | - | GUCCAGGAGAAUUCCAGGAGGU | 22 | 6876 |
| myoC-7131 | - | CGUCCAGGAGAAUUCCAGGAGGU | 23 | 6877 |
| myoC-7132 | - | ACGUCCAGGAGAAUUCCAGGAGGU | 24 | 6878 |
| myoC-3771 | - | GCUUCUGGCCUGCCUGGU | 18 | 3517 |
| myoC-3772 | - | UGCUUCUGGCCUGCCUGGU | 19 | 3518 |
| myoC-1595 | - | CUGCUUCUGGCCUGCCUGGU | 20 | 1879 |
| myoC-3773 | - | GCUGCUUCUGGCCUGCCUGGU | 21 | 3519 |
| myoC-3774 | - | UGCUGCUUCUGGCCUGCCUGGU | 22 | 3520 |
| myoC-3775 | - | CUGCUGCUUCUGGCCUGCCUGGU | 23 | 3521 |
| myoC-3776 | - | GCUGCUGCUUCUGGCCUGCCUGGU | 24 | 3522 |
| myoC-3777 | - | CUGCCUGGUGUGGGAUGU | 18 | 3523 |
| myoC-3778 | - | CCUGCCUGGUGUGGGAUGU | 19 | 3524 |
| myoC-95 | - | GCCUGCCUGGUGUGGGAUGU | 20 | 500 |
| myoC-3779 | - | GGCCUGCCUGGUGUGGGAUGU | 21 | 3525 |
| myoC-3780 | - | UGGCCUGCCUGGUGUGGGAUGU | 22 | 3526 |
| myoC-3781 | - | CUGGCCUGCCUGGUGUGGGAUGU | 23 | 3527 |
| myoC-3782 | - | UCUGGCCUGCCUGGUGUGGGAUGU | 24 | 3528 |
| myoC-7133 | - | GAAACUCCAAACAGACUU | 18 | 6879 |
| myoC-7134 | - | AGAAACUCCAAACAGACUU | 19 | 6880 |
| myoC-2098 | - | AAGAAACUCCAAACAGACUU | 20 | 2222 |
| myoC-7135 | - | AAAGAAACUCCAAACAGACUU | 21 | 6881 |
| myoC-7136 | - | AAAAGAAACUCCAAACAGACUU | 22 | 6882 |
| myoC-7137 | - | AAAAAGAAACUCCAAACAGACUU | 23 | 6883 |
| myoC-7138 | - | UAAAAAGAAACUCCAAACAGACUU | 24 | 6884 |
| myoC-7139 | - | UCUUUUCUUUCAUGUCUU | 18 | 6885 |
| myoC-7140 | - | GUCUUUUCUUUCAUGUCUU | 19 | 6886 |
| myoC-1921 | - | AGUCUUUUCUUUCAUGUCUU | 20 | 2099 |
| myoC-7141 | - | GAGUCUUUUCUUUCAUGUCUU | 21 | 6887 |
| myoC-7142 | - | GGAGUCUUUUCUUUCAUGUCUU | 22 | 6888 |
| myoC-7143 | - | UGGAGUCUUUUCUUUCAUGUCUU | 23 | 6889 |
| myoC-7144 | - | CUGGAGUCUUUUCUUUCAUGUCUU | 24 | 6890 |
| myoC-3783 | - | CUCCGAGACAAGUCAGUU | 18 | 3529 |
| myoC-3784 | - | CCUCCGAGACAAGUCAGUU | 19 | 3530 |
| myoC-1639 | - | UCCUCCGAGACAAGUCAGUU | 20 | 1907 |

TABLE 10D-continued

| 4th Tier | | | | |
|---|---|---|---|---|
| gRNA Name | DNA Strand | Targeting Domain | Target Site Length | Seq ID |
| myoC-3785 | - | CUCCUCCGAGACAAGUCAGUU | 21 | 3531 |
| myoC-3786 | - | CCUCCUCCGAGACAAGUCAGUU | 22 | 3532 |
| myoC-3787 | - | ACCUCCUCCGAGACAAGUCAGUU | 23 | 3533 |
| myoC-3788 | - | AACCUCCUCCGAGACAAGUCAGUU | 24 | 3534 |

Table 10E provides exemplary targeting domains for knocking down the MYOC gene selected according to the fifth tier parameters. The targeting domains bind within 2484-903 bp upstream of transcription start site or the additional 500 bp upstream and downstream of transcription start site (extending to 1 kb up and downstream of the transcription start site), start with a 5' G and PAM is NNGRRT. It is contemplated herein that in an embodiment the targeting domain hybridizes to the target domain through complementary base pairing. Any of the targeting domains in the table can be used with a *S. aureus* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 10E

| 5th Tier | | | | |
|---|---|---|---|---|
| gRNA Name | DNA Strand | Targeting Domain | Target Site Length | Seq ID |
| myoC-7145 | + | GCAGAACCAGAAAGAAAA | 18 | 6891 |
| myoC-7146 | + | GGCAGAACCAGAAAGAAAA | 19 | 6892 |
| myoC-7147 | + | GUUUUCUUCCUGUUAAAAGAAA | 22 | 6893 |
| myoC-7148 | + | GCUAACUCCACAGAGAAA | 18 | 6894 |
| myoC-7149 | + | GCUGCUAACUCCACAGAGAAA | 21 | 6895 |
| myoC-7150 | + | GUGCUGCUAACUCCACAGAGAAA | 23 | 6896 |
| myoC-7151 | + | GAACUUGAGACAUUUACAA | 19 | 6897 |
| myoC-7152 | + | GCCUGAACUUGAGACAUUUACAA | 23 | 6898 |
| myoC-1173 | + | GUUUAUGGCUCUAUUCGCAA | 20 | 1473 |
| myoC-7153 | + | GAGUUUAUGGCUCUAUUCGCAA | 22 | 6899 |
| myoC-7154 | + | GUUUGUUUACAGCUGACCA | 19 | 6900 |
| myoC-7155 | + | GUGUUUGUUUACAGCUGACCA | 21 | 6901 |
| myoC-7156 | + | GGUGUUUGUUUACAGCUGACCA | 22 | 6902 |
| myoC-7157 | + | GGGUGUUUGUUUACAGCUGACCA | 23 | 6903 |
| myoC-7158 | + | GUCAAUUCCCACUGCCCUUGA | 21 | 6904 |
| myoC-7159 | + | GGUCAAUUCCCACUGCCCUUGA | 22 | 6905 |
| myoC-7160 | + | GUGGUCAAUUCCCACUGCCCUUGA | 24 | 6906 |
| myoC-7161 | + | GCCCUGCCUCCUAGAACC | 18 | 6907 |
| myoC-7162 | + | GGUCAAUUCCCACUGCCC | 18 | 6908 |
| myoC-2248 | + | GUGGUCAAUUCCCACUGCCC | 20 | 2332 |
| myoC-7163 | + | GCAUUGUGGCUCUCGGUCC | 19 | 6909 |
| myoC-7164 | + | GAAGCAUUGUGGCUCUCGGUCC | 22 | 6910 |
| myoC-7165 | + | GUUCACAGAACACGAGAGCUGC | 22 | 6911 |

TABLE 10E-continued

| 5th Tier | | | | |
|---|---|---|---|---|
| gRNA Name | DNA Strand | Targeting Domain | Target Site Length | Seq ID |
| myoC-7166 | + | GUGUUCACAGAACACGAGAGCUGC | 24 | 6912 |
| myoC-7167 | + | GCCCUGGCAGACUCACCUC | 19 | 6913 |
| myoC-3801 | + | GCACAGCCCGAGCAGUGUC | 19 | 3547 |
| myoC-1700 | + | GGCACAGCCCGAGCAGUGUC | 20 | 1952 |
| myoC-3802 | + | GUGGCACAGCCCGAGCAGUGUC | 22 | 3548 |
| myoC-3803 | + | GGUGGCACAGCCCGAGCAGUGUC | 23 | 3549 |
| myoC-1199 | + | GCAGUCACUGCUGAGCUGCG | 20 | 1499 |
| myoC-7168 | + | GUCAGCAGUCACUGCUGAGCUGCG | 24 | 6914 |
| myoC-7169 | + | GCCAAGUCCACCACAGGG | 18 | 6915 |
| myoC-7170 | + | GCAUAAGCCAAGUCCACCACAGGG | 24 | 6916 |
| myoC-7171 | + | GGAAGGAAAAUGUGGCUG | 18 | 6917 |
| myoC-7172 | + | GGGAAGGAAAAUGUGGCUG | 19 | 6918 |
| myoC-7173 | + | GCUUAGGGAAGGAAAAUGUGGCUG | 24 | 6919 |
| myoC-7174 | + | GCCAUAUCACCUGCUGAACU | 20 | 6920 |
| myoC-7175 | + | GAGCCAUAUCACCUGCUGAACU | 22 | 6921 |
| myoC-7176 | + | GGUACUGUUAUUACCACU | 18 | 6922 |
| myoC-7177 | + | GUUACUACCUUGUGACUUGCU | 21 | 6923 |
| myoC-7178 | + | GCUGCGUGGGGUGCUGGU | 18 | 6924 |
| myoC-2243 | + | GAGCUGCGUGGGGUGCUGGU | 20 | 2328 |
| myoC-7179 | + | GCUGAGCUGCGUGGGGUGCUGGU | 23 | 6925 |
| myoC-7180 | + | GAAUCUGUUUGGCUUUACUCUU | 22 | 6926 |
| myoC-7181 | + | GUCUAAUUUCAAAGUAGUU | 19 | 6927 |
| myoC-2290 | + | GGUCUAAUUUCAAAGUAGUU | 20 | 2368 |
| myoC-7182 | + | GAGGUCUAAUUUCAAAGUAGUU | 22 | 6928 |
| myoC-7183 | + | GGAGGUCUAAUUUCAAAGUAGUU | 23 | 6929 |
| myoC-7184 | + | GGGUACUAGUCUCAUUUU | 18 | 6930 |
| myoC-7185 | - | GCAUUUGCCAAUAACCAAA | 19 | 6931 |
| myoC-1969 | - | GGCAUUUGCCAAUAACCAAA | 20 | 2127 |
| myoC-7186 | - | GAACCAAUCAAAUAAGAA | 18 | 6932 |
| myoC-7187 | - | GCAGAACCAAUCAAAUAAGAA | 21 | 6933 |
| myoC-2059 | - | GUUCUUGGCAUGCACACACA | 20 | 2190 |
| myoC-7188 | - | GGUUCUUGGCAUGCACACACA | 21 | 6934 |
| myoC-7189 | - | GAGGUUCUUGGCAUGCACACACA | 23 | 6935 |
| myoC-7190 | - | GCAGUGACUGCUGACAGCA | 19 | 6936 |
| myoC-7191 | - | GCUCAGCAGUGACUGCUGACAGCA | 24 | 6937 |
| myoC-7192 | - | GCAAAAGGAGAAAUAAAAGGA | 21 | 6938 |
| myoC-7193 | - | GCAGUGGGAAUUGACCAC | 18 | 6939 |
| myoC-7194 | - | GGCAGUGGGAAUUGACCAC | 19 | 6940 |

TABLE 10E-continued

| 5th Tier | | | | |
|---|---|---|---|---|
| gRNA Name | DNA Strand | Targeting Domain | Target Site Length | Seq ID |
| myoC-1128 | - | GGGCAGUGGGAAUUGACCAC | 20 | 1428 |
| myoC-7195 | - | GGUUUAUUAAUGUAAAGC | 18 | 6941 |
| myoC-7196 | - | GGGUUUAUUAAUGUAAAGC | 19 | 6942 |
| myoC-7197 | - | GAUUAUAGUCCACGUGAUC | 19 | 6943 |
| myoC-1998 | - | GGAUUAUAGUCCACGUGAUC | 20 | 2146 |
| myoC-7198 | - | GGGAUUAUAGUCCACGUGAUC | 21 | 6944 |
| myoC-1962 | - | GACAGGAAGGCAGGCAGAAG | 20 | 2121 |
| myoC-7199 | - | GGACAGGAAGGCAGGCAGAAG | 21 | 6945 |
| myoC-7200 | - | GGGACAGGAAGGCAGGCAGAAG | 22 | 6946 |
| myoC-7201 | - | GGGGACAGGAAGGCAGGCAGAAG | 23 | 6947 |
| myoC-7202 | - | GGGGGACAGGAAGGCAGGCAGAAG | 24 | 6948 |
| myoC-7203 | - | GCACAGCUAGCACAAGACAG | 20 | 6949 |
| myoC-7204 | - | GACUGCACAGCUAGCACAAGACAG | 24 | 6950 |
| myoC-7205 | - | GGAGGAGAAGAAAAAGAG | 18 | 6951 |
| myoC-7206 | - | GGGAGGAGAAGAAAAAGAG | 19 | 6952 |
| myoC-1122 | - | GGGGAGGAGAAGAAAAAGAG | 20 | 1422 |
| myoC-7207 | - | GCAGGGGAGGAGAAGAAAAAGAG | 23 | 6953 |
| myoC-7208 | - | GUGUUUCUCCACUCUGGAG | 19 | 6954 |
| myoC-7209 | - | GCUCUCCCUGGAGCCUGG | 18 | 6955 |
| myoC-7210 | - | GAAUGCUCUCCCUGGAGCCUGG | 22 | 6956 |
| myoC-7211 | - | GGAAUGCUCUCCCUGGAGCCUGG | 23 | 6957 |
| myoC-3851 | - | GCUCCAGAGAAGGUAAGAAUG | 21 | 3597 |
| myoC-3852 | - | GGCUCCAGAGAAGGUAAGAAUG | 22 | 3598 |
| myoC-3210 | - | GCGACUAAGGCAAGAAAAU | 19 | 2956 |
| myoC-3211 | - | GAAGCGACUAAGGCAAGAAAAU | 22 | 2957 |
| myoC-7212 | - | GCUUAACUGCAGAACCAAUCAAAU | 24 | 6958 |
| myoC-7213 | - | GUCCAGAAAGCCUGUGAAU | 19 | 6959 |
| myoC-7214 | - | GAAAUCUGCCGCUUCUAU | 18 | 6960 |
| myoC-7215 | - | GGAAAUCUGCCGCUUCUAU | 19 | 6961 |
| myoC-1210 | - | GGGAAAUCUGCCGCUUCUAU | 20 | 1510 |
| myoC-7216 | - | GGGGAAAUCUGCCGCUUCUAU | 21 | 6962 |
| myoC-7217 | - | GGGGGAAAUCUGCCGCUUCUAU | 22 | 6963 |
| myoC-7218 | - | GGGGGGAAAUCUGCCGCUUCUAU | 23 | 6964 |
| myoC-3853 | - | GAAUGCAGAGUGGGGGGACU | 20 | 3599 |
| myoC-3854 | - | GUAAGAAUGCAGAGUGGGGGGACU | 24 | 3600 |
| myoC-7219 | - | GCAAGACGGUCGAAAACCU | 19 | 6965 |
| myoC-7220 | - | GAUACACAGUUGUUUUAAAGCU | 22 | 6966 |

TABLE 10E-continued

| 5th Tier | | | | |
|---|---|---|---|---|
| gRNA Name | DNA Strand | Targeting Domain | Target Site Length | Seq ID |
| myoC-7221 | - | GCUUUUUGUUUUUUCUCU | 18 | 6967 |
| myoC-7222 | - | GAUUCAUUCAAGGGCAGU | 18 | 6968 |
| myoC-7223 | - | GACAGAUUCAUUCAAGGGCAGU | 22 | 6969 |
| myoC-3859 | - | GCCACCAGGCUCCAGAGAAGGU | 22 | 3605 |
| myoC-3860 | - | GUGCCACCAGGCUCCAGAGAAGGU | 24 | 3606 |
| myoC-7224 | - | GCUUCAUUUAGAUUAGUGGUU | 21 | 6970 |
| myoC-7225 | - | GAGCUUCAUUUAGAUUAGUGGUU | 23 | 6971 |

Table 10F provides exemplary targeting domains for knocking down the MYOC gene selected according to the six tier parameters. The targeting domains bind within 2484-903 bp upstream of transcription start site or the additional 500 bp upstream and downstream of transcription start site (extending to 1 kb up and downstream of the transcription start site) and PAM is NNGRRT. It is contemplated herein that in an embodiment the targeting domain hybridizes to the target domain through complementary base pairing. Any of the targeting domains in the table can be used with a *S. aureus* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 10F

| 6th Tier | | | | |
|---|---|---|---|---|
| gRNA Name | DNA Strand | Targeting Domain | Target Site Length | Seq ID |
| myoC-7226 | + | CUGAGCAAAGGUUCAAAA | 18 | 6972 |
| myoC-7227 | + | UCUGAGCAAAGGUUCAAAA | 19 | 6973 |
| myoC-7228 | + | AUCUGAGCAAAGGUUCAAAA | 20 | 6974 |
| myoC-7229 | + | AAUCUGAGCAAAGGUUCAAAA | 21 | 6975 |
| myoC-7230 | + | CAAUCUGAGCAAAGGUUCAAAA | 22 | 6976 |
| myoC-7231 | + | ACAAUCUGAGCAAAGGUUCAAAA | 23 | 6977 |
| myoC-7232 | + | AACAAUCUGAGCAAAGGUUCAAAA | 24 | 6978 |
| myoC-2206 | + | UGGCAGAACCAGAAAGAAAA | 20 | 2301 |
| myoC-7233 | + | AUGGCAGAACCAGAAAGAAAA | 21 | 6979 |
| myoC-7234 | + | AAUGGCAGAACCAGAAAGAAAA | 22 | 6980 |
| myoC-7235 | + | CAAUGGCAGAACCAGAAAGAAAA | 23 | 6981 |
| myoC-7236 | + | CCAAUGGCAGAACCAGAAAGAAAA | 24 | 6982 |
| myoC-7237 | + | UCUUCCUGUUAAAAGAAA | 18 | 6983 |
| myoC-7238 | + | UUCUUCCUGUUAAAAGAAA | 19 | 6984 |
| myoC-1190 | + | UUUCUUCCUGUUAAAAGAAA | 20 | 1490 |
| myoC-7239 | + | UUUUCUUCCUGUUAAAAGAAA | 21 | 6985 |
| myoC-7240 | + | UGUUUUCUUCCUGUUAAAAGAAA | 23 | 6986 |
| myoC-7241 | + | AUGUUUUCUUCCUGUUAAAAGAAA | 24 | 6987 |
| myoC-7242 | + | UGCUAACUCCACAGAGAAA | 19 | 6988 |
| myoC-2260 | + | CUGCUAACUCCACAGAGAAA | 20 | 2342 |

TABLE 10F-continued

| 6th Tier | | | | |
|---|---|---|---|---|
| gRNA Name | DNA Strand | Targeting Domain | Target Site Length | Seq ID |
| myoC-7243 | + | UGCUGCUAACUCCACAGAGAAA | 22 | 6989 |
| myoC-7244 | + | UGUGCUGCUAACUCCACAGAGAAA | 24 | 6990 |
| myoC-7245 | + | AACUUGAGACAUUUACAA | 18 | 6991 |
| myoC-2272 | + | UGAACUUGAGACAUUUACAA | 20 | 2352 |
| myoC-7246 | + | CUGAACUUGAGACAUUUACAA | 21 | 6992 |
| myoC-7247 | + | CCUGAACUUGAGACAUUUACAA | 22 | 6993 |
| myoC-7248 | + | AGCCUGAACUUGAGACAUUUACAA | 24 | 6994 |
| myoC-7249 | + | UUAUGGCUCUAUUCGCAA | 18 | 6995 |
| myoC-7250 | + | UUUAUGGCUCUAUUCGCAA | 19 | 6996 |
| myoC-7251 | + | AGUUUAUGGCUCUAUUCGCAA | 21 | 6997 |
| myoC-7252 | + | UGAGUUUAUGGCUCUAUUCGCAA | 23 | 6998 |
| myoC-7253 | + | UUGAGUUUAUGGCUCUAUUCGCAA | 24 | 6999 |
| myoC-7254 | + | UCAACAUCCCCCCUCACA | 18 | 7000 |
| myoC-7255 | + | CUCAACAUCCCCCCUCACA | 19 | 7001 |
| myoC-2225 | + | UCUCAACAUCCCCCCUCACA | 20 | 2315 |
| myoC-7256 | + | CUCUCAACAUCCCCCCUCACA | 21 | 7002 |
| myoC-7257 | + | CCUCUCAACAUCCCCCCUCACA | 22 | 7003 |
| myoC-7258 | + | CCCUCUCAACAUCCCCCCUCACA | 23 | 7004 |
| myoC-7259 | + | CCCCUCUCAACAUCCCCCCUCACA | 24 | 7005 |
| myoC-7260 | + | UUUGUUUACAGCUGACCA | 18 | 7006 |
| myoC-2271 | + | UGUUUGUUUACAGCUGACCA | 20 | 2351 |
| myoC-7261 | + | UGGGUGUUUGUUUACAGCUGACCA | 24 | 7007 |
| myoC-7262 | + | AAUUCCCACUGCCCUUGA | 18 | 7008 |
| myoC-7263 | + | CAAUUCCCACUGCCCUUGA | 19 | 7009 |
| myoC-2247 | + | UCAAUUCCCACUGCCCUUGA | 20 | 2331 |
| myoC-7264 | + | UGGUCAAUUCCCACUGCCCUUGA | 23 | 7010 |
| myoC-7265 | + | AGCCCUGCCUCCUAGAACC | 19 | 7011 |
| myoC-2250 | + | UAGCCCUGCCUCCUAGAACC | 20 | 2334 |
| myoC-7266 | + | AUAGCCCUGCCUCCUAGAACC | 21 | 7012 |
| myoC-7267 | + | UAUAGCCCUGCCUCCUAGAACC | 22 | 7013 |
| myoC-7268 | + | AUAUAGCCCUGCCUCCUAGAACC | 23 | 7014 |
| myoC-7269 | + | AAUAUAGCCCUGCCUCCUAGAACC | 24 | 7015 |
| myoC-7270 | + | UGGUCAAUUCCCACUGCCC | 19 | 7016 |
| myoC-7271 | + | UGUGGUCAAUUCCCACUGCCC | 21 | 7017 |
| myoC-7272 | + | CUGUGGUCAAUUCCCACUGCCC | 22 | 7018 |
| myoC-7273 | + | CCUGUGGUCAAUUCCCACUGCCC | 23 | 7019 |
| myoC-7274 | + | CCCUGUGGUCAAUUCCCACUGCCC | 24 | 7020 |
| myoC-7275 | + | CAUUGUGGCUCUCGGUCC | 18 | 7021 |

TABLE 10F-continued

| 6th Tier | | | | |
|---|---|---|---|---|
| gRNA Name | DNA Strand | Targeting Domain | Target Site Length | Seq ID |
| myoC-1081 | + | AGCAUUGUGGCUCUCGGUCC | 20 | 1381 |
| myoC-7276 | + | AAGCAUUGUGGCUCUCGGUCC | 21 | 7022 |
| myoC-7277 | + | UGAAGCAUUGUGGCUCUCGGUCC | 23 | 7023 |
| myoC-7278 | + | CUGAAGCAUUGUGGCUCUCGGUCC | 24 | 7024 |
| myoC-7279 | + | AGUCAGCAAGACCUAGGC | 18 | 7025 |
| myoC-7280 | + | UAGUCAGCAAGACCUAGGC | 19 | 7026 |
| myoC-2268 | + | AUAGUCAGCAAGACCUAGGC | 20 | 2348 |
| myoC-7281 | + | UAUAGUCAGCAAGACCUAGGC | 21 | 7027 |
| myoC-7282 | + | AUAUAGUCAGCAAGACCUAGGC | 22 | 7028 |
| myoC-7283 | + | CAUAUAGUCAGCAAGACCUAGGC | 23 | 7029 |
| myoC-7284 | + | UCAUAUAGUCAGCAAGACCUAGGC | 24 | 7030 |
| myoC-7285 | + | ACAGAACACGAGAGCUGC | 18 | 7031 |
| myoC-7286 | + | CACAGAACACGAGAGCUGC | 19 | 7032 |
| myoC-2218 | + | UCACAGAACACGAGAGCUGC | 20 | 2310 |
| myoC-7287 | + | UUCACAGAACACGAGAGCUGC | 21 | 7033 |
| myoC-7288 | + | UGUUCACAGAACACGAGAGCUGC | 23 | 7034 |
| myoC-7289 | + | CCCUGGCAGACUCACCUC | 18 | 7035 |
| myoC-2278 | + | UGCCCUGGCAGACUCACCUC | 20 | 2357 |
| myoC-7290 | + | CUGCCCUGGCAGACUCACCUC | 21 | 7036 |
| myoC-7291 | + | ACUGCCCUGGCAGACUCACCUC | 22 | 7037 |
| myoC-7292 | + | AACUGCCCUGGCAGACUCACCUC | 23 | 7038 |
| myoC-7293 | + | AAACUGCCCUGGCAGACUCACCUC | 24 | 7039 |
| myoC-3904 | + | CACAGCCCGAGCAGUGUC | 18 | 3650 |
| myoC-3905 | + | UGGCACAGCCCGAGCAGUGUC | 21 | 3651 |
| myoC-3906 | + | UGGUGGCACAGCCCGAGCAGUGUC | 24 | 3652 |
| myoC-7294 | + | AGUCACUGCUGAGCUGCG | 18 | 7040 |
| myoC-7295 | + | CAGUCACUGCUGAGCUGCG | 19 | 7041 |
| myoC-7296 | + | AGCAGUCACUGCUGAGCUGCG | 21 | 7042 |
| myoC-7297 | + | CAGCAGUCACUGCUGAGCUGCG | 22 | 7043 |
| myoC-7298 | + | UCAGCAGUCACUGCUGAGCUGCG | 23 | 7044 |
| myoC-7299 | + | AGCCAAGUCCACCACAGGG | 19 | 7045 |
| myoC-2204 | + | AAGCCAAGUCCACCACAGGG | 20 | 2299 |
| myoC-7300 | + | UAAGCCAAGUCCACCACAGGG | 21 | 7046 |
| myoC-7301 | + | AUAAGCCAAGUCCACCACAGGG | 22 | 7047 |
| myoC-7302 | + | CAUAAGCCAAGUCCACCACAGGG | 23 | 7048 |
| myoC-2235 | + | AGGGAAGGAAAAUGUGGCUG | 20 | 2323 |
| myoC-7303 | + | UAGGGAAGGAAAAUGUGGCUG | 21 | 7049 |

TABLE 10F-continued

| 6th Tier | | | | |
|---|---|---|---|---|
| gRNA Name | DNA Strand | Targeting Domain | Target Site Length | Seq ID |
| myoC-7304 | + | UUAGGGAAGGAAAAUGUGGCUG | 22 | 7050 |
| myoC-7305 | + | CUUAGGGAAGGAAAAUGUGGCUG | 23 | 7051 |
| myoC-7306 | + | CAUAUCACCUGCUGAACU | 18 | 7052 |
| myoC-7307 | + | CCAUAUCACCUGCUGAACU | 19 | 7053 |
| myoC-7308 | + | AGCCAUAUCACCUGCUGAACU | 21 | 7054 |
| myoC-7309 | + | CGAGCCAUAUCACCUGCUGAACU | 23 | 7055 |
| myoC-7310 | + | ACGAGCCAUAUCACCUGCUGAACU | 24 | 7056 |
| myoC-7311 | + | AGGUACUGUUAUUACCACU | 19 | 7057 |
| myoC-2289 | + | CAGGUACUGUUAUUACCACU | 20 | 2367 |
| myoC-7312 | + | ACAGGUACUGUUAUUACCACU | 21 | 7058 |
| myoC-7313 | + | CACAGGUACUGUUAUUACCACU | 22 | 7059 |
| myoC-7314 | + | UCACAGGUACUGUUAUUACCACU | 23 | 7060 |
| myoC-7315 | + | AUCACAGGUACUGUUAUUACCACU | 24 | 7061 |
| myoC-7316 | + | ACUACCUUGUGACUUGCU | 18 | 7062 |
| myoC-7317 | + | UACUACCUUGUGACUUGCU | 19 | 7063 |
| myoC-2256 | + | UUACUACCUUGUGACUUGCU | 20 | 2339 |
| myoC-7318 | + | AGUUACUACCUUGUGACUUGCU | 22 | 7064 |
| myoC-7319 | + | CAGUUACUACCUUGUGACUUGCU | 23 | 7065 |
| myoC-7320 | + | UCAGUUACUACCUUGUGACUUGCU | 24 | 7066 |
| myoC-7321 | + | AGCUGCGUGGGGUGCUGGU | 19 | 7067 |
| myoC-7322 | + | UGAGCUGCGUGGGGUGCUGGU | 21 | 7068 |
| myoC-7323 | + | CUGAGCUGCGUGGGGUGCUGGU | 22 | 7069 |
| myoC-7324 | + | UGCUGAGCUGCGUGGGGUGCUGGU | 24 | 7070 |
| myoC-7325 | + | CUGUUUGGCUUUACUCUU | 18 | 7071 |
| myoC-7326 | + | UCUGUUUGGCUUUACUCUU | 19 | 7072 |
| myoC-1189 | + | AUCUGUUUGGCUUUACUCUU | 20 | 1489 |
| myoC-7327 | + | AAUCUGUUUGGCUUUACUCUU | 21 | 7073 |
| myoC-7328 | + | UGAAUCUGUUUGGCUUUACUCUU | 23 | 7074 |
| myoC-7329 | + | UUGAAUCUGUUUGGCUUUACUCUU | 24 | 7075 |
| myoC-7330 | + | UCUAAUUUCAAAGUAGUU | 18 | 7076 |
| myoC-7331 | + | AGGUCUAAUUUCAAAGUAGUU | 21 | 7077 |
| myoC-7332 | + | AGGAGGUCUAAUUUCAAAGUAGUU | 24 | 7078 |
| myoC-7333 | + | CUUGCUCUGGCCCAGUUU | 18 | 7079 |
| myoC-7334 | + | ACUUGCUCUGGCCCAGUUU | 19 | 7080 |
| myoC-2241 | + | CACUUGCUCUGGCCCAGUUU | 20 | 2326 |
| myoC-7335 | + | CCACUUGCUCUGGCCCAGUUU | 21 | 7081 |
| myoC-7336 | + | UCCACUUGCUCUGGCCCAGUUU | 22 | 7082 |
| myoC-7337 | + | UUCCACUUGCUCUGGCCCAGUUU | 23 | 7083 |

TABLE 10F-continued

| 6th Tier | | | | |
|---|---|---|---|---|
| gRNA Name | DNA Strand | Targeting Domain | Target Site Length | Seq ID |
| myoC-7338 | + | UUUCCACUUGCUCUGGCCCAGUUU | 24 | 7084 |
| myoC-7339 | + | AGGGUACUAGUCUCAUUUU | 19 | 7085 |
| myoC-2270 | + | AAGGGUACUAGUCUCAUUUU | 20 | 2350 |
| myoC-7340 | + | AAAGGGUACUAGUCUCAUUUU | 21 | 7086 |
| myoC-7341 | + | CAAAGGGUACUAGUCUCAUUUU | 22 | 7087 |
| myoC-7342 | + | CCAAAGGGUACUAGUCUCAUUUU | 23 | 7088 |
| myoC-7343 | + | ACCAAAGGGUACUAGUCUCAUUUU | 24 | 7089 |
| myoC-7344 | − | CAUUUGCCAAUAACCAAA | 18 | 7090 |
| myoC-7345 | − | UGGCAUUUGCCAAUAACCAAA | 21 | 7091 |
| myoC-7346 | − | AUGGCAUUUGCCAAUAACCAAA | 22 | 7092 |
| myoC-7347 | − | AAUGGCAUUUGCCAAUAACCAAA | 23 | 7093 |
| myoC-7348 | − | CAAUGGCAUUUGCCAAUAACCAAA | 24 | 7094 |
| myoC-7349 | − | AGAACCAAUCAAAUAAGAA | 19 | 7095 |
| myoC-2031 | − | CAGAACCAAUCAAAUAAGAA | 20 | 2166 |
| myoC-7350 | − | UGCAGAACCAAUCAAAUAAGAA | 22 | 7096 |
| myoC-7351 | − | CUGCAGAACCAAUCAAAUAAGAA | 23 | 7097 |
| myoC-7352 | − | ACUGCAGAACCAAUCAAAUAAGAA | 24 | 7098 |
| myoC-7353 | − | UCUUGGCAUGCACACACA | 18 | 7099 |
| myoC-7354 | − | UUCUUGGCAUGCACACACA | 19 | 7100 |
| myoC-7355 | − | AGGUUCUUGGCAUGCACACACA | 22 | 7101 |
| myoC-7356 | − | UGAGGUUCUUGGCAUGCACACACA | 24 | 7102 |
| myoC-7357 | − | CAGUGACUGCUGACAGCA | 18 | 7103 |
| myoC-1117 | − | AGCAGUGACUGCUGACAGCA | 20 | 1417 |
| myoC-7358 | − | CAGCAGUGACUGCUGACAGCA | 21 | 7104 |
| myoC-7359 | − | UCAGCAGUGACUGCUGACAGCA | 22 | 7105 |
| myoC-7360 | − | CUCAGCAGUGACUGCUGACAGCA | 23 | 7106 |
| myoC-7361 | − | AAAGGAGAAAUAAAAGGA | 18 | 7107 |
| myoC-7362 | − | AAAAGGAGAAAUAAAAGGA | 19 | 7108 |
| myoC-7363 | − | CAAAAGGAGAAAUAAAAGGA | 20 | 7109 |
| myoC-7364 | − | AGCAAAAGGAGAAAUAAAAGGA | 22 | 7110 |
| myoC-7365 | − | UAGCAAAAGGAGAAAUAAAAGGA | 23 | 7111 |
| myoC-7366 | − | AUAGCAAAAGGAGAAAUAAAAGGA | 24 | 7112 |
| myoC-7367 | − | AGGGCAGUGGGAAUUGACCAC | 21 | 7113 |
| myoC-7368 | − | AAGGGCAGUGGGAAUUGACCAC | 22 | 7114 |
| myoC-7369 | − | CAAGGGCAGUGGGAAUUGACCAC | 23 | 7115 |
| myoC-7370 | − | UCAAGGGCAGUGGGAAUUGACCAC | 24 | 7116 |
| myoC-1168 | − | UGGGUUUAUUAAUGUAAAGC | 20 | 1468 |

TABLE 10F-continued

| 6th Tier | | | | |
|---|---|---|---|---|
| gRNA Name | DNA Strand | Targeting Domain | Target Site Length | Seq ID |
| myoC-7371 | - | UUGGGUUUAUUAAUGUAAAGC | 21 | 7117 |
| myoC-7372 | - | UUUGGGUUUAUUAAUGUAAAGC | 22 | 7118 |
| myoC-7373 | - | CUUUGGGUUUAUUAAUGUAAAGC | 23 | 7119 |
| myoC-7374 | - | UCUUUGGGUUUAUUAAUGUAAAGC | 24 | 7120 |
| myoC-7375 | - | AUUAUAGUCCACGUGAUC | 18 | 7121 |
| myoC-7376 | - | AGGGAUUAUAGUCCACGUGAUC | 22 | 7122 |
| myoC-7377 | - | CAGGGAUUAUAGUCCACGUGAUC | 23 | 7123 |
| myoC-7378 | - | ACAGGGAUUAUAGUCCACGUGAUC | 24 | 7124 |
| myoC-7379 | - | AUAUUUUUCCUUUACAAG | 18 | 7125 |
| myoC-7380 | - | UAUAUUUUUCCUUUACAAG | 19 | 7126 |
| myoC-2014 | - | CUAUAUUUUUCCUUUACAAG | 20 | 2152 |
| myoC-7381 | - | ACUAUAUUUUUCCUUUACAAG | 21 | 7127 |
| myoC-7382 | - | UACUAUAUUUUUCCUUUACAAG | 22 | 7128 |
| myoC-7383 | - | AUACUAUAUUUUUCCUUUACAAG | 23 | 7129 |
| myoC-7384 | - | AAUACUAUAUUUUUCCUUUACAAG | 24 | 7130 |
| myoC-7385 | - | CAGGAAGGCAGGCAGAAG | 18 | 7131 |
| myoC-7386 | - | ACAGGAAGGCAGGCAGAAG | 19 | 7132 |
| myoC-7387 | - | ACAGCUAGCACAAGACAG | 18 | 7133 |
| myoC-7388 | - | CACAGCUAGCACAAGACAG | 19 | 7134 |
| myoC-7389 | - | UGCACAGCUAGCACAAGACAG | 21 | 7135 |
| myoC-7390 | - | CUGCACAGCUAGCACAAGACAG | 22 | 7136 |
| myoC-7391 | - | ACUGCACAGCUAGCACAAGACAG | 23 | 7137 |
| myoC-7392 | - | AGGGGAGGAGAAGAAAAAGAG | 21 | 7138 |
| myoC-7393 | - | CAGGGGAGGAGAAGAAAAAGAG | 22 | 7139 |
| myoC-7394 | - | CGCAGGGGAGGAGAAGAAAAAGAG | 24 | 7140 |
| myoC-7395 | - | UGUUUCUCCACUCUGGAG | 18 | 7141 |
| myoC-2035 | - | UGUGUUUCUCCACUCUGGAG | 20 | 2169 |
| myoC-7396 | - | CUGUGUUUCUCCACUCUGGAG | 21 | 7142 |
| myoC-7397 | - | ACUGUGUUUCUCCACUCUGGAG | 22 | 7143 |
| myoC-7398 | - | AACUGUGUUUCUCCACUCUGGAG | 23 | 7144 |
| myoC-7399 | - | AAACUGUGUUUCUCCACUCUGGAG | 24 | 7145 |
| myoC-7400 | - | UGAAAACAUCUUUCUGAG | 18 | 7146 |
| myoC-7401 | - | UUGAAAACAUCUUUCUGAG | 19 | 7147 |
| myoC-2057 | - | UUUGAAAACAUCUUUCUGAG | 20 | 2188 |
| myoC-7402 | - | AUUUGAAAACAUCUUUCUGAG | 21 | 7148 |
| myoC-7403 | - | UAUUUGAAAACAUCUUUCUGAG | 22 | 7149 |
| myoC-7404 | - | AUAUUUGAAAACAUCUUUCUGAG | 23 | 7150 |
| myoC-7405 | - | UAUAUUUGAAAACAUCUUUCUGAG | 24 | 7151 |

TABLE 10F-continued

| 6th Tier | | | | |
|---|---|---|---|---|
| gRNA Name | DNA Strand | Targeting Domain | Target Site Length | Seq ID |
| myoC-7406 | - | CUGUGAUUCUCUGUGAGG | 18 | 7152 |
| myoC-7407 | - | CCUGUGAUUCUCUGUGAGG | 19 | 7153 |
| myoC-1038 | - | CCCUGUGAUUCUCUGUGAGG | 20 | 1338 |
| myoC-7408 | - | UCCCUGUGAUUCUCUGUGAGG | 21 | 7154 |
| myoC-7409 | - | UUCCCUGUGAUUCUCUGUGAGG | 22 | 7155 |
| myoC-7410 | - | CUUCCCUGUGAUUCUCUGUGAGG | 23 | 7156 |
| myoC-7411 | - | ACUUCCCUGUGAUUCUCUGUGAGG | 24 | 7157 |
| myoC-7412 | - | UGCUCUCCCUGGAGCCUGG | 19 | 7158 |
| myoC-2078 | - | AUGCUCUCCCUGGAGCCUGG | 20 | 2207 |
| myoC-7413 | - | AAUGCUCUCCCUGGAGCCUGG | 21 | 7159 |
| myoC-7414 | - | AGGAAUGCUCUCCCUGGAGCCUGG | 24 | 7160 |
| myoC-4035 | - | CCAGAGAAGGUAAGAAUG | 18 | 3781 |
| myoC-4036 | - | UCCAGAGAAGGUAAGAAUG | 19 | 3782 |
| myoC-4037 | - | CUCCAGAGAAGGUAAGAAUG | 20 | 3783 |
| myoC-4038 | - | AGGCUCCAGAGAAGGUAAGAAUG | 23 | 3784 |
| myoC-4039 | - | CAGGCUCCAGAGAAGGUAAGAAUG | 24 | 3785 |
| myoC-7415 | - | UUGAAAUUAGACCUCCUG | 18 | 7161 |
| myoC-7416 | - | UUUGAAAUUAGACCUCCUG | 19 | 7162 |
| myoC-2053 | - | CUUUGAAAUUAGACCUCCUG | 20 | 2184 |
| myoC-7417 | - | ACUUUGAAAUUAGACCUCCUG | 21 | 7163 |
| myoC-7418 | - | UACUUUGAAAUUAGACCUCCUG | 22 | 7164 |
| myoC-7419 | - | CUACUUUGAAAUUAGACCUCCUG | 23 | 7165 |
| myoC-7420 | - | ACUACUUUGAAAUUAGACCUCCUG | 24 | 7166 |
| myoC-7421 | - | AGGAACUCUUUUUCUCUG | 18 | 7167 |
| myoC-7422 | - | UAGGAACUCUUUUUCUCUG | 19 | 7168 |
| myoC-1148 | - | UUAGGAACUCUUUUUCUCUG | 20 | 1448 |
| myoC-7423 | - | AUUAGGAACUCUUUUUCUCUG | 21 | 7169 |
| myoC-7424 | - | UAUUAGGAACUCUUUUUCUCUG | 22 | 7170 |
| myoC-7425 | - | UUAUUAGGAACUCUUUUUCUCUG | 23 | 7171 |
| myoC-7426 | - | CUUAUUAGGAACUCUUUUUCUCUG | 24 | 7172 |
| myoC-3239 | - | CGACUAAGGCAAGAAAAU | 18 | 2985 |
| myoC-1648 | - | AGCGACUAAGGCAAGAAAAU | 20 | 1914 |
| myoC-3240 | - | AAGCGACUAAGGCAAGAAAAU | 21 | 2986 |
| myoC-3241 | - | AGAAGCGACUAAGGCAAGAAAAU | 23 | 2987 |
| myoC-3242 | - | AAGAAGCGACUAAGGCAAGAAAAU | 24 | 2988 |
| myoC-7427 | - | CUGCAGAACCAAUCAAAU | 18 | 7173 |
| myoC-7428 | - | ACUGCAGAACCAAUCAAAU | 19 | 7174 |

TABLE 10F-continued

| 6th Tier | | | | |
|---|---|---|---|---|
| gRNA Name | DNA Strand | Targeting Domain | Target Site Length | Seq ID |
| myoC-2030 | - | AACUGCAGAACCAAUCAAAU | 20 | 2165 |
| myoC-7429 | - | UAACUGCAGAACCAAUCAAAU | 21 | 7175 |
| myoC-7430 | - | UUAACUGCAGAACCAAUCAAAU | 22 | 7176 |
| myoC-7431 | - | CUUAACUGCAGAACCAAUCAAAU | 23 | 7177 |
| myoC-7432 | - | UCCAGAAAGCCUGUGAAU | 18 | 7178 |
| myoC-2044 | - | AGUCCAGAAAGCCUGUGAAU | 20 | 2176 |
| myoC-7433 | - | CAGUCCAGAAAGCCUGUGAAU | 21 | 7179 |
| myoC-7434 | - | ACAGUCCAGAAAGCCUGUGAAU | 22 | 7180 |
| myoC-7435 | - | UACAGUCCAGAAAGCCUGUGAAU | 23 | 7181 |
| myoC-7436 | - | CUACAGUCCAGAAAGCCUGUGAAU | 24 | 7182 |
| myoC-7437 | - | AGGGGGGAAAUCUGCCGCUUCUAU | 24 | 7183 |
| myoC-4047 | - | AUGCAGAGUGGGGGGACU | 18 | 3793 |
| myoC-4048 | - | AAUGCAGAGUGGGGGGACU | 19 | 3794 |
| myoC-4049 | - | AGAAUGCAGAGUGGGGGGACU | 21 | 3795 |
| myoC-4050 | - | AAGAAUGCAGAGUGGGGGGACU | 22 | 3796 |
| myoC-4051 | - | UAAGAAUGCAGAGUGGGGGGACU | 23 | 3797 |
| myoC-7438 | - | CAAGACGGUCGAAAACCU | 18 | 7184 |
| myoC-1025 | - | UGCAAGACGGUCGAAAACCU | 20 | 1325 |
| myoC-7439 | - | AUGCAAGACGGUCGAAAACCU | 21 | 7185 |
| myoC-7440 | - | UAUGCAAGACGGUCGAAAACCU | 22 | 7186 |
| myoC-7441 | - | UUAUGCAAGACGGUCGAAAACCU | 23 | 7187 |
| myoC-7442 | - | CUUAUGCAAGACGGUCGAAAACCU | 24 | 7188 |
| myoC-7443 | - | CUACAGUCCAGAAAGCCU | 18 | 7189 |
| myoC-7444 | - | CCUACAGUCCAGAAAGCCU | 19 | 7190 |
| myoC-2043 | - | ACCUACAGUCCAGAAAGCCU | 20 | 2175 |
| myoC-7445 | - | AACCUACAGUCCAGAAAGCCU | 21 | 7191 |
| myoC-7446 | - | UAACCUACAGUCCAGAAAGCCU | 22 | 7192 |
| myoC-7447 | - | UUAACCUACAGUCCAGAAAGCCU | 23 | 7193 |
| myoC-7448 | - | AUUAACCUACAGUCCAGAAAGCCU | 24 | 7194 |
| myoC-7449 | - | CAGGAAGAAAACAUUCCU | 18 | 7195 |
| myoC-7450 | - | ACAGGAAGAAAACAUUCCU | 19 | 7196 |
| myoC-2025 | - | AACAGGAAGAAAACAUUCCU | 20 | 2160 |
| myoC-7451 | - | UAACAGGAAGAAAACAUUCCU | 21 | 7197 |
| myoC-7452 | - | UUAACAGGAAGAAAACAUUCCU | 22 | 7198 |
| myoC-7453 | - | UUUAACAGGAAGAAAACAUUCCU | 23 | 7199 |
| myoC-7454 | - | UUUUAACAGGAAGAAAACAUUCCU | 24 | 7200 |
| myoC-7455 | - | CACAGUUGUUUUAAAGCU | 18 | 7201 |
| myoC-7456 | - | ACACAGUUGUUUUAAAGCU | 19 | 7202 |

TABLE 10F-continued

| 6th Tier | | | | |
|---|---|---|---|---|
| gRNA Name | DNA Strand | Targeting Domain | Target Site Length | Seq ID |
| myoC-2066 | – | UACACAGUUGUUUUAAAGCU | 20 | 2197 |
| myoC-7457 | – | AUACACAGUUGUUUUAAAGCU | 21 | 7203 |
| myoC-7458 | – | AGAUACACAGUUGUUUUAAAGCU | 23 | 7204 |
| myoC-7459 | – | AAGAUACACAGUUGUUUUAAAGCU | 24 | 7205 |
| myoC-7460 | – | UGCUUUUUGUUUUUUCUCU | 19 | 7206 |
| myoC-2039 | – | UUGCUUUUUGUUUUUUCUCU | 20 | 2172 |
| myoC-7461 | – | UUUGCUUUUUGUUUUUUCUCU | 21 | 7207 |
| myoC-7462 | – | AUUUGCUUUUUGUUUUUUCUCU | 22 | 7208 |
| myoC-7463 | – | CAUUUGCUUUUUGUUUUUUCUCU | 23 | 7209 |
| myoC-7464 | – | CCAUUUGCUUUUUGUUUUUUCUCU | 24 | 7210 |
| myoC-7465 | – | AGAUUCAUUCAAGGGCAGU | 19 | 7211 |
| myoC-1127 | – | CAGAUUCAUUCAAGGGCAGU | 20 | 1427 |
| myoC-7466 | – | ACAGAUUCAUUCAAGGGCAGU | 21 | 7212 |
| myoC-7467 | – | AGACAGAUUCAUUCAAGGGCAGU | 23 | 7213 |
| myoC-7468 | – | AAGACAGAUUCAUUCAAGGGCAGU | 24 | 7214 |
| myoC-4073 | – | CCAGGCUCCAGAGAAGGU | 18 | 3819 |
| myoC-4074 | – | ACCAGGCUCCAGAGAAGGU | 19 | 3820 |
| myoC-4075 | – | CACCAGGCUCCAGAGAAGGU | 20 | 3821 |
| myoC-4076 | – | CCACCAGGCUCCAGAGAAGGU | 21 | 3822 |
| myoC-4077 | – | UGCCACCAGGCUCCAGAGAAGGU | 23 | 3823 |
| myoC-7469 | – | UUAACAUUUUAUUCCAUU | 18 | 7215 |
| myoC-7470 | – | UUUAACAUUUUAUUCCAUU | 19 | 7216 |
| myoC-2048 | – | AUUUAACAUUUUAUUCCAUU | 20 | 2179 |
| myoC-7471 | – | AAUUUAACAUUUUAUUCCAUU | 21 | 7217 |
| myoC-7472 | – | AAAUUUAACAUUUUAUUCCAUU | 22 | 7218 |
| myoC-7473 | – | UAAAUUUAACAUUUUAUUCCAUU | 23 | 7219 |
| myoC-7474 | – | CUAAAUUUAACAUUUUAUUCCAUU | 24 | 7220 |
| myoC-7475 | – | UCAUUUAGAUUAGUGGUU | 18 | 7221 |
| myoC-7476 | – | UUCAUUUAGAUUAGUGGUU | 19 | 7222 |
| myoC-7477 | – | CUUCAUUUAGAUUAGUGGUU | 20 | 7223 |
| myoC-7478 | – | AGCUUCAUUUAGAUUAGUGGUU | 22 | 7224 |
| myoC-7479 | – | AGAGCUUCAUUUAGAUUAGUGGUU | 24 | 7225 |

Table 10G provides exemplary targeting domains for knocking down the MYOC gene selected according to the seven tier parameters. The targeting domains bind within 2484-903 bp upstream of transcription start site or the additional 500 bp upstream and downstream of transcription start site (extending to 1 kb up and downstream of the transcription start site) and PAM is NNGRRV. It is contemplated herein that in an embodiment the targeting domain hybridizes to the target domain through complementary base pairing. Any of the targeting domains in the table can be used with a *S. aureus* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 10G

| 7th Tier | | | | |
|---|---|---|---|---|
| gRNA Name | DNA Strand | Targeting Domain | Target Site Length | Seq ID |
| myoC-7480 | + | UACAUUAAUAAACCCAAA | 18 | 7226 |
| myoC-7481 | + | UUACAUUAAUAAACCCAAA | 19 | 7227 |
| myoC-2283 | + | UUUACAUUAAUAAACCCAAA | 20 | 2362 |
| myoC-7482 | + | CUUUACAUUAAUAAACCCAAA | 21 | 7228 |
| myoC-7483 | + | GCUUUACAUUAAUAAACCCAAA | 22 | 7229 |
| myoC-7484 | + | UGCUUUACAUUAAUAAACCCAAA | 23 | 7230 |
| myoC-7485 | + | CUGCUUUACAUUAAUAAACCCAAA | 24 | 7231 |
| myoC-7486 | + | AAAGGAUAGUUUUUCAAA | 18 | 7232 |
| myoC-7487 | + | AAAAGGAUAGUUUUUCAAA | 19 | 7233 |
| myoC-5449 | + | AAAAAGGAUAGUUUUUCAAA | 20 | 5195 |
| myoC-7488 | + | AAAAAAGGAUAGUUUUUCAAA | 21 | 7234 |
| myoC-7489 | + | CAAAAAAGGAUAGUUUUUCAAA | 22 | 7235 |
| myoC-7490 | + | UCAAAAAAGGAUAGUUUUUCAAA | 23 | 7236 |
| myoC-7491 | + | UUCAAAAAAGGAUAGUUUUUCAAA | 24 | 7237 |
| myoC-7492 | + | AUAAAAUAUAGAUUACAA | 18 | 7238 |
| myoC-7493 | + | UAUAAAAUAUAGAUUACAA | 19 | 7239 |
| myoC-1227 | + | AUAUAAAAUAUAGAUUACAA | 20 | 1527 |
| myoC-7494 | + | UAUAUAAAAUAUAGAUUACAA | 21 | 7240 |
| myoC-7495 | + | AUAUAUAAAAUAUAGAUUACAA | 22 | 7241 |
| myoC-7496 | + | AAUAUAUAAAAUAUAGAUUACAA | 23 | 7242 |
| myoC-7497 | + | AAAUAUAUAAAAUAUAGAUUACAA | 24 | 7243 |
| myoC-7498 | + | AAAAGGAUAGUUUUUCAA | 18 | 7244 |
| myoC-7499 | + | AAAAAGGAUAGUUUUUCAA | 19 | 7245 |
| myoC-7500 | + | AAAAAAGGAUAGUUUUUCAA | 20 | 7246 |
| myoC-7501 | + | CAAAAAAGGAUAGUUUUUCAA | 21 | 7247 |
| myoC-7502 | + | UCAAAAAAGGAUAGUUUUUCAA | 22 | 7248 |
| myoC-7503 | + | UUCAAAAAAGGAUAGUUUUUCAA | 23 | 7249 |
| myoC-7504 | + | GUUCAAAAAAGGAUAGUUUUUCAA | 24 | 7250 |
| myoC-7505 | + | UUCUUCCUGUUAAAAGAA | 18 | 7251 |
| myoC-7506 | + | UUUCUUCCUGUUAAAAGAA | 19 | 7252 |
| myoC-2264 | + | UUUUCUUCCUGUUAAAAGAA | 20 | 2345 |
| myoC-7507 | + | GUUUUCUUCCUGUUAAAAGAA | 21 | 7253 |

TABLE 10G-continued

| 7th Tier | | | | |
|---|---|---|---|---|
| gRNA Name | DNA Strand | Targeting Domain | Target Site Length | Seq ID |
| myoC-7508 | + | UGUUUUCUUCCUGUUAAAAGAA | 22 | 7254 |
| myoC-7509 | + | AUGUUUUCUUCCUGUUAAAAGAA | 23 | 7255 |
| myoC-7510 | + | AAUGUUUUCUUCCUGUUAAAAGAA | 24 | 7256 |
| myoC-7511 | + | UCUGAACCACUAAUCUAA | 18 | 7257 |
| myoC-7512 | + | CUCUGAACCACUAAUCUAA | 19 | 7258 |
| myoC-7513 | + | ACUCUGAACCACUAAUCUAA | 20 | 7259 |
| myoC-7514 | + | AACUCUGAACCACUAAUCUAA | 21 | 7260 |
| myoC-7515 | + | GAACUCUGAACCACUAAUCUAA | 22 | 7261 |
| myoC-7516 | + | AGAACUCUGAACCACUAAUCUAA | 23 | 7262 |
| myoC-7517 | + | AAGAACUCUGAACCACUAAUCUAA | 24 | 7263 |
| myoC-7518 | + | GAAUUACUCAGCUUGUAA | 18 | 7264 |
| myoC-7519 | + | AGAAUUACUCAGCUUGUAA | 19 | 7265 |
| myoC-1193 | + | CAGAAUUACUCAGCUUGUAA | 20 | 1493 |
| myoC-7520 | + | UCAGAAUUACUCAGCUUGUAA | 21 | 7266 |
| myoC-7521 | + | CUCAGAAUUACUCAGCUUGUAA | 22 | 7267 |
| myoC-7522 | + | GCUCAGAAUUACUCAGCUUGUAA | 23 | 7268 |
| myoC-7523 | + | UGCUCAGAAUUACUCAGCUUGUAA | 24 | 7269 |
| myoC-7524 | + | AUGUUUUCUUCCUGUUAA | 18 | 7270 |
| myoC-7525 | + | AAUGUUUUCUUCCUGUUAA | 19 | 7271 |
| myoC-2265 | + | GAAUGUUUUCUUCCUGUUAA | 20 | 2346 |
| myoC-7526 | + | GGAAUGUUUUCUUCCUGUUAA | 21 | 7272 |
| myoC-7527 | + | AGGAAUGUUUUCUUCCUGUUAA | 22 | 7273 |
| myoC-7528 | + | UAGGAAUGUUUUCUUCCUGUUAA | 23 | 7274 |
| myoC-7529 | + | UUAGGAAUGUUUUCUUCCUGUUAA | 24 | 7275 |
| myoC-7530 | + | UGUGCUGCUAACUCCACA | 18 | 7276 |
| myoC-7531 | + | UUGUGCUGCUAACUCCACA | 19 | 7277 |
| myoC-2261 | + | CUUGUGCUGCUAACUCCACA | 20 | 2343 |
| myoC-7532 | + | CCUUGUGCUGCUAACUCCACA | 21 | 7278 |
| myoC-7533 | + | CCCUUGUGCUGCUAACUCCACA | 22 | 7279 |
| myoC-7534 | + | GCCCUUGUGCUGCUAACUCCACA | 23 | 7280 |
| myoC-7535 | + | UGCCCUUGUGCUGCUAACUCCACA | 24 | 7281 |
| myoC-7536 | + | CCCUCACAGAGAAUCACA | 18 | 7282 |
| myoC-7537 | + | CCCCUCACAGAGAAUCACA | 19 | 7283 |
| myoC-1086 | + | CCCCCUCACAGAGAAUCACA | 20 | 1386 |
| myoC-7538 | + | CCCCCCUCACAGAGAAUCACA | 21 | 7284 |
| myoC-7539 | + | UCCCCCCUCACAGAGAAUCACA | 22 | 7285 |
| myoC-7540 | + | AUCCCCCCUCACAGAGAAUCACA | 23 | 7286 |

TABLE 10G-continued

| 7th Tier | | | | |
|---|---|---|---|---|
| gRNA Name | DNA Strand | Targeting Domain | Target Site Length | Seq ID |
| myoC-7541 | + | CAUCCCCCCUCACAGAGAAUCACA | 24 | 7287 |
| myoC-7542 | + | GGACUGUGAAAACUGACA | 18 | 7288 |
| myoC-7543 | + | UGGACUGUGAAAACUGACA | 19 | 7289 |
| myoC-5454 | + | AUGGACUGUGAAAACUGACA | 20 | 5200 |
| myoC-7544 | + | UAUGGACUGUGAAAACUGACA | 21 | 7290 |
| myoC-7545 | + | CUAUGGACUGUGAAAACUGACA | 22 | 7291 |
| myoC-7546 | + | GCUAUGGACUGUGAAAACUGACA | 23 | 7292 |
| myoC-7547 | + | UGCUAUGGACUGUGAAAACUGACA | 24 | 7293 |
| myoC-7548 | + | UAUAAAAUAUAGAUUACA | 18 | 7294 |
| myoC-7549 | + | AUAUAAAAUAUAGAUUACA | 19 | 7295 |
| myoC-2295 | + | UAUAUAAAAUAUAGAUUACA | 20 | 2371 |
| myoC-7550 | + | AUAUAUAAAAUAUAGAUUACA | 21 | 7296 |
| myoC-7551 | + | AAUAUAUAAAAUAUAGAUUACA | 22 | 7297 |
| myoC-7552 | + | AAAUAUAUAAAAUAUAGAUUACA | 23 | 7298 |
| myoC-7553 | + | CAAAUAUAUAAAAUAUAGAUUACA | 24 | 7299 |
| myoC-7554 | + | CAUAAGCCAAGUCCACCA | 18 | 7300 |
| myoC-7555 | + | GCAUAAGCCAAGUCCACCA | 19 | 7301 |
| myoC-2205 | + | UGCAUAAGCCAAGUCCACCA | 20 | 2300 |
| myoC-7556 | + | UUGCAUAAGCCAAGUCCACCA | 21 | 7302 |
| myoC-7557 | + | CUUGCAUAAGCCAAGUCCACCA | 22 | 7303 |
| myoC-7558 | + | UCUUGCAUAAGCCAAGUCCACCA | 23 | 7304 |
| myoC-7559 | + | GUCUUGCAUAAGCCAAGUCCACCA | 24 | 7305 |
| myoC-7560 | + | UUUACAUUAAUAAACCCA | 18 | 7306 |
| myoC-7561 | + | CUUUACAUUAAUAAACCCA | 19 | 7307 |
| myoC-2284 | + | GCUUUACAUUAAUAAACCCA | 20 | 2363 |
| myoC-7562 | + | UGCUUUACAUUAAUAAACCCA | 21 | 7308 |
| myoC-7563 | + | CUGCUUUACAUUAAUAAACCCA | 22 | 7309 |
| myoC-7564 | + | CCUGCUUUACAUUAAUAAACCCA | 23 | 7310 |
| myoC-7565 | + | CCCUGCUUUACAUUAAUAAACCCA | 24 | 7311 |
| myoC-7566 | + | AGAGAAGACUAUGGCCCA | 18 | 7312 |
| myoC-7567 | + | CAGAGAAGACUAUGGCCCA | 19 | 7313 |
| myoC-1091 | + | GCAGAGAAGACUAUGGCCCA | 20 | 1391 |
| myoC-7568 | + | AGCAGAGAAGACUAUGGCCCA | 21 | 7314 |
| myoC-7569 | + | UAGCAGAGAAGACUAUGGCCCA | 22 | 7315 |
| myoC-7570 | + | AUAGCAGAGAAGACUAUGGCCCA | 23 | 7316 |
| myoC-7571 | + | UAUAGCAGAGAAGACUAUGGCCCA | 24 | 7317 |
| myoC-7572 | + | CUUGUGCUGCUAACUCCA | 18 | 7318 |
| myoC-7573 | + | CCUUGUGCUGCUAACUCCA | 19 | 7319 |

TABLE 10G-continued

| 7th Tier | | | | |
|---|---|---|---|---|
| gRNA Name | DNA Strand | Targeting Domain | Target Site Length | Seq ID |
| myoC-2262 | + | CCCUUGUGCUGCUAACUCCA | 20 | 2344 |
| myoC-7574 | + | GCCCUUGUGCUGCUAACUCCA | 21 | 7320 |
| myoC-7575 | + | UGCCCUUGUGCUGCUAACUCCA | 22 | 7321 |
| myoC-7576 | + | UUGCCCUUGUGCUGCUAACUCCA | 23 | 7322 |
| myoC-7577 | + | AUUGCCCUUGUGCUGCUAACUCCA | 24 | 7323 |
| myoC-7578 | + | GCACCCUACCAGGCUCCA | 18 | 7324 |
| myoC-7579 | + | AGCACCCUACCAGGCUCCA | 19 | 7325 |
| myoC-1218 | + | CAGCACCCUACCAGGCUCCA | 20 | 1518 |
| myoC-7580 | + | ACAGCACCCUACCAGGCUCCA | 21 | 7326 |
| myoC-7581 | + | GACAGCACCCUACCAGGCUCCA | 22 | 7327 |
| myoC-7582 | + | GGACAGCACCCUACCAGGCUCCA | 23 | 7328 |
| myoC-7583 | + | AGGACAGCACCCUACCAGGCUCCA | 24 | 7329 |
| myoC-7584 | + | GCAAGGGUCUUUAUAGCA | 18 | 7330 |
| myoC-7585 | + | UGCAAGGGUCUUUAUAGCA | 19 | 7331 |
| myoC-2216 | + | CUGCAAGGGUCUUUAUAGCA | 20 | 2308 |
| myoC-7586 | + | GCUGCAAGGGUCUUUAUAGCA | 21 | 7332 |
| myoC-7587 | + | AGCUGCAAGGGUCUUUAUAGCA | 22 | 7333 |
| myoC-7588 | + | GAGCUGCAAGGGUCUUUAUAGCA | 23 | 7334 |
| myoC-7589 | + | AGAGCUGCAAGGGUCUUUAUAGCA | 24 | 7335 |
| myoC-7590 | + | UUUAUGGCUCUAUUCGCA | 18 | 7336 |
| myoC-7591 | + | GUUUAUGGCUCUAUUCGCA | 19 | 7337 |
| myoC-2288 | + | AGUUUAUGGCUCUAUUCGCA | 20 | 2366 |
| myoC-7592 | + | GAGUUUAUGGCUCUAUUCGCA | 21 | 7338 |
| myoC-7593 | + | UGAGUUUAUGGCUCUAUUCGCA | 22 | 7339 |
| myoC-7594 | + | UUGAGUUUAUGGCUCUAUUCGCA | 23 | 7340 |
| myoC-7595 | + | UUUGAGUUUAUGGCUCUAUUCGCA | 24 | 7341 |
| myoC-7596 | + | UAGGAGAAAGGGCAGGCA | 18 | 7342 |
| myoC-7597 | + | CUAGGAGAAAGGGCAGGCA | 19 | 7343 |
| myoC-5455 | + | UCUAGGAGAAAGGGCAGGCA | 20 | 5201 |
| myoC-7598 | + | CUCUAGGAGAAAGGGCAGGCA | 21 | 7344 |
| myoC-7599 | + | UCUCUAGGAGAAAGGGCAGGCA | 22 | 7345 |
| myoC-7600 | + | GUCUCUAGGAGAAAGGGCAGGCA | 23 | 7346 |
| myoC-7601 | + | AGUCUCUAGGAGAAAGGGCAGGCA | 24 | 7347 |
| myoC-7602 | + | CCCCCUCACAGAGAAUCA | 18 | 7348 |
| myoC-7603 | + | CCCCCCUCACAGAGAAUCA | 19 | 7349 |
| myoC-2224 | + | UCCCCCCUCACAGAGAAUCA | 20 | 2314 |
| myoC-7604 | + | AUCCCCCCUCACAGAGAAUCA | 21 | 7350 |

TABLE 10G-continued

| 7th Tier | | | | |
|---|---|---|---|---|
| gRNA Name | DNA Strand | Targeting Domain | Target Site Length | Seq ID |
| myoC-7605 | + | CAUCCCCCCUCACAGAGAAUCA | 22 | 7351 |
| myoC-7606 | + | ACAUCCCCCCUCACAGAGAAUCA | 23 | 7352 |
| myoC-7607 | + | AACAUCCCCCCUCACAGAGAAUCA | 24 | 7353 |
| myoC-7608 | + | UGGAGUCUGACGUGAUCA | 18 | 7354 |
| myoC-7609 | + | CUGGAGUCUGACGUGAUCA | 19 | 7355 |
| myoC-2230 | + | CCUGGAGUCUGACGUGAUCA | 20 | 2319 |
| myoC-7610 | + | UCCUGGAGUCUGACGUGAUCA | 21 | 7356 |
| myoC-7611 | + | GUCCUGGAGUCUGACGUGAUCA | 22 | 7357 |
| myoC-7612 | + | GGUCCUGGAGUCUGACGUGAUCA | 23 | 7358 |
| myoC-7613 | + | CGGUCCUGGAGUCUGACGUGAUCA | 24 | 7359 |
| myoC-7614 | + | UCUCAACAUCCCCCCUCA | 18 | 7360 |
| myoC-7615 | + | CUCUCAACAUCCCCCCUCA | 19 | 7361 |
| myoC-2226 | + | CCUCUCAACAUCCCCCCUCA | 20 | 2316 |
| myoC-7616 | + | CCCUCUCAACAUCCCCCCUCA | 21 | 7362 |
| myoC-7617 | + | CCCCUCUCAACAUCCCCCCUCA | 22 | 7363 |
| myoC-7618 | + | UCCCCUCUCAACAUCCCCCCUCA | 23 | 7364 |
| myoC-7619 | + | UUCCCCUCUCAACAUCCCCCCUCA | 24 | 7365 |
| myoC-7620 | + | AUGUGGCUGUUGGGUUCA | 18 | 7366 |
| myoC-7621 | + | AAUGUGGCUGUUGGGUUCA | 19 | 7367 |
| myoC-2234 | + | AAAUGUGGCUGUUGGGUUCA | 20 | 2322 |
| myoC-7622 | + | AAAAUGUGGCUGUUGGGUUCA | 21 | 7368 |
| myoC-7623 | + | GAAAAUGUGGCUGUUGGGUUCA | 22 | 7369 |
| myoC-7624 | + | GGAAAAUGUGGCUGUUGGGUUCA | 23 | 7370 |
| myoC-7625 | + | AGGAAAAUGUGGCUGUUGGGUUCA | 24 | 7371 |
| myoC-7626 | + | AUCACAGGGAAGUGUUCA | 18 | 7372 |
| myoC-7627 | + | AAUCACAGGGAAGUGUUCA | 19 | 7373 |
| myoC-2221 | + | GAAUCACAGGGAAGUGUUCA | 20 | 2313 |
| myoC-7628 | + | AGAAUCACAGGGAAGUGUUCA | 21 | 7374 |
| myoC-7629 | + | GAGAAUCACAGGGAAGUGUUCA | 22 | 7375 |
| myoC-7630 | + | AGAGAAUCACAGGGAAGUGUUCA | 23 | 7376 |
| myoC-7631 | + | CAGAGAAUCACAGGGAAGUGUUCA | 24 | 7377 |
| myoC-7632 | + | ACCAAUGGCAGAACCAGA | 18 | 7378 |
| myoC-7633 | + | AACCAAUGGCAGAACCAGA | 19 | 7379 |
| myoC-2207 | + | CAACCAAUGGCAGAACCAGA | 20 | 2302 |
| myoC-7634 | + | CCAACCAAUGGCAGAACCAGA | 21 | 7380 |
| myoC-7635 | + | GCCAACCAAUGGCAGAACCAGA | 22 | 7381 |
| myoC-7636 | + | AGCCAACCAAUGGCAGAACCAGA | 23 | 7382 |
| myoC-7637 | + | CAGCCAACCAAUGGCAGAACCAGA | 24 | 7383 |

TABLE 10G-continued

| 7th Tier | | | | |
|---|---|---|---|---|
| gRNA Name | DNA Strand | Targeting Domain | Target Site Length | Seq ID |
| myoC-7638 | + | GGCAGACUCACCUCCAGA | 18 | 7384 |
| myoC-7639 | + | UGGCAGACUCACCUCCAGA | 19 | 7385 |
| myoC-2277 | + | CUGGCAGACUCACCUCCAGA | 20 | 2356 |
| myoC-7640 | + | CCUGGCAGACUCACCUCCAGA | 21 | 7386 |
| myoC-7641 | + | CCCUGGCAGACUCACCUCCAGA | 22 | 7387 |
| myoC-7642 | + | GCCCUGGCAGACUCACCUCCAGA | 23 | 7388 |
| myoC-7643 | + | UGCCCUGGCAGACUCACCUCCAGA | 24 | 7389 |
| myoC-7644 | + | UGUGCAGUCUCUAGGAGA | 18 | 7390 |
| myoC-7645 | + | CUGUGCAGUCUCUAGGAGA | 19 | 7391 |
| myoC-7646 | + | GCUGUGCAGUCUCUAGGAGA | 20 | 7392 |
| myoC-7647 | + | AGCUGUGCAGUCUCUAGGAGA | 21 | 7393 |
| myoC-7648 | + | UAGCUGUGCAGUCUCUAGGAGA | 22 | 7394 |
| myoC-7649 | + | CUAGCUGUGCAGUCUCUAGGAGA | 23 | 7395 |
| myoC-7650 | + | GCUAGCUGUGCAGUCUCUAGGAGA | 24 | 7396 |
| myoC-7651 | + | AAGACUAUGGCCCAGGGA | 18 | 7397 |
| myoC-7652 | + | GAAGACUAUGGCCCAGGGA | 19 | 7398 |
| myoC-1092 | + | AGAAGACUAUGGCCCAGGGA | 20 | 1392 |
| myoC-7653 | + | GAGAAGACUAUGGCCCAGGGA | 21 | 7399 |
| myoC-7654 | + | AGAGAAGACUAUGGCCCAGGGA | 22 | 7400 |
| myoC-7655 | + | CAGAGAAGACUAUGGCCCAGGGA | 23 | 7401 |
| myoC-7656 | + | GCAGAGAAGACUAUGGCCCAGGGA | 24 | 7402 |
| myoC-7657 | + | AUUGUCUAUGCUUAGGGA | 18 | 7403 |
| myoC-7658 | + | CAUUGUCUAUGCUUAGGGA | 19 | 7404 |
| myoC-1075 | + | CCAUUGUCUAUGCUUAGGGA | 20 | 1375 |
| myoC-7659 | + | GCCAUUGUCUAUGCUUAGGGA | 21 | 7405 |
| myoC-7660 | + | UGCCAUUGUCUAUGCUUAGGGA | 22 | 7406 |
| myoC-7661 | + | AUGCCAUUGUCUAUGCUUAGGGA | 23 | 7407 |
| myoC-7662 | + | AAUGCCAUUGUCUAUGCUUAGGGA | 24 | 7408 |
| myoC-5871 | + | GUUGCCCAGAAGACAUGA | 18 | 5617 |
| myoC-5872 | + | AGUUGCCCAGAAGACAUGA | 19 | 5618 |
| myoC-2201 | + | UAGUUGCCCAGAAGACAUGA | 20 | 2296 |
| myoC-5873 | + | GUAGUUGCCCAGAAGACAUGA | 21 | 5619 |
| myoC-5874 | + | AGUAGUUGCCCAGAAGACAUGA | 22 | 5620 |
| myoC-5875 | + | GAGUAGUUGCCCAGAAGACAUGA | 23 | 5621 |
| myoC-5876 | + | UGAGUAGUUGCCCAGAAGACAUGA | 24 | 5622 |
| myoC-7663 | + | GUGAUCAGUGAGGACUGA | 18 | 7409 |
| myoC-7664 | + | CGUGAUCAGUGAGGACUGA | 19 | 7410 |

TABLE 10G-continued

| 7th Tier | | | | |
|---|---|---|---|---|
| gRNA Name | DNA Strand | Targeting Domain | Target Site Length | Seq ID |
| myoC-1083 | + | ACGUGAUCAGUGAGGACUGA | 20 | 1383 |
| myoC-7665 | + | GACGUGAUCAGUGAGGACUGA | 21 | 7411 |
| myoC-7666 | + | UGACGUGAUCAGUGAGGACUGA | 22 | 7412 |
| myoC-7667 | + | CUGACGUGAUCAGUGAGGACUGA | 23 | 7413 |
| myoC-7668 | + | UCUGACGUGAUCAGUGAGGACUGA | 24 | 7414 |
| myoC-7669 | + | GAAAAAGAGUUCCUAAUA | 18 | 7415 |
| myoC-7670 | + | AGAAAAAGAGUUCCUAAUA | 19 | 7416 |
| myoC-1192 | + | GAGAAAAAGAGUUCCUAAUA | 20 | 1492 |
| myoC-7671 | + | AGAGAAAAAGAGUUCCUAAUA | 21 | 7417 |
| myoC-7672 | + | CAGAGAAAAAGAGUUCCUAAUA | 22 | 7418 |
| myoC-7673 | + | ACAGAGAAAAAGAGUUCCUAAUA | 23 | 7419 |
| myoC-7674 | + | CACAGAGAAAAAGAGUUCCUAAUA | 24 | 7420 |
| myoC-7675 | + | CAAAGGAAACAAAUGAUA | 18 | 7421 |
| myoC-7676 | + | ACAAAGGAAACAAAUGAUA | 19 | 7422 |
| myoC-2293 | + | UACAAAGGAAACAAAUGAUA | 20 | 2370 |
| myoC-7677 | + | UUACAAAGGAAACAAAUGAUA | 21 | 7423 |
| myoC-7678 | + | AUUACAAAGGAAACAAAUGAUA | 22 | 7424 |
| myoC-7679 | + | GAUUACAAAGGAAACAAAUGAUA | 23 | 7425 |
| myoC-7680 | + | AGAUUACAAAGGAAACAAAUGAUA | 24 | 7426 |
| myoC-7681 | + | CCAGGGAGAGCAUUCCUA | 18 | 7427 |
| myoC-7682 | + | UCCAGGGAGAGCAUUCCUA | 19 | 7428 |
| myoC-2307 | + | CUCCAGGGAGAGCAUUCCUA | 20 | 2378 |
| myoC-7683 | + | GCUCCAGGGAGAGCAUUCCUA | 21 | 7429 |
| myoC-7684 | + | GGCUCCAGGGAGAGCAUUCCUA | 22 | 7430 |
| myoC-7685 | + | AGGCUCCAGGGAGAGCAUUCCUA | 23 | 7431 |
| myoC-7686 | + | CAGGCUCCAGGGAGAGCAUUCCUA | 24 | 7432 |
| myoC-7687 | + | AGAAUUACUCAGCUUGUA | 18 | 7433 |
| myoC-7688 | + | CAGAAUUACUCAGCUUGUA | 19 | 7434 |
| myoC-2255 | + | UCAGAAUUACUCAGCUUGUA | 20 | 2338 |
| myoC-7689 | + | CUCAGAAUUACUCAGCUUGUA | 21 | 7435 |
| myoC-7690 | + | GCUCAGAAUUACUCAGCUUGUA | 22 | 7436 |
| myoC-7691 | + | UGCUCAGAAUUACUCAGCUUGUA | 23 | 7437 |
| myoC-7692 | + | UUGCUCAGAAUUACUCAGCUUGUA | 24 | 7438 |
| myoC-7693 | + | UGCCAUUGUCUAUGCUUA | 18 | 7439 |
| myoC-7694 | + | AUGCCAUUGUCUAUGCUUA | 19 | 7440 |
| myoC-1074 | + | AAUGCCAUUGUCUAUGCUUA | 20 | 1374 |
| myoC-7695 | + | AAAUGCCAUUGUCUAUGCUUA | 21 | 7441 |
| myoC-7696 | + | CAAAUGCCAUUGUCUAUGCUUA | 22 | 7442 |

TABLE 10G-continued

| 7th Tier | | | | |
|---|---|---|---|---|
| gRNA Name | DNA Strand | Targeting Domain | Target Site Length | Seq ID |
| myoC-7697 | + | GCAAAUGCCAUUGUCUAUGCUUA | 23 | 7443 |
| myoC-7698 | + | GGCAAAUGCCAUUGUCUAUGCUUA | 24 | 7444 |
| myoC-7699 | + | GGGAAGUGUUCACAGAAC | 18 | 7445 |
| myoC-7700 | + | AGGGAAGUGUUCACAGAAC | 19 | 7446 |
| myoC-2220 | + | CAGGGAAGUGUUCACAGAAC | 20 | 2312 |
| myoC-7701 | + | ACAGGGAAGUGUUCACAGAAC | 21 | 7447 |
| myoC-7702 | + | CACAGGGAAGUGUUCACAGAAC | 22 | 7448 |
| myoC-7703 | + | UCACAGGGAAGUGUUCACAGAAC | 23 | 7449 |
| myoC-7704 | + | AUCACAGGGAAGUGUUCACAGAAC | 24 | 7450 |
| myoC-7705 | + | GCCAACCAAUGGCAGAAC | 18 | 7451 |
| myoC-7706 | + | AGCCAACCAAUGGCAGAAC | 19 | 7452 |
| myoC-2208 | + | CAGCCAACCAAUGGCAGAAC | 20 | 2303 |
| myoC-7707 | + | ACAGCCAACCAAUGGCAGAAC | 21 | 7453 |
| myoC-7708 | + | CACAGCCAACCAAUGGCAGAAC | 22 | 7454 |
| myoC-7709 | + | GCACAGCCAACCAAUGGCAGAAC | 23 | 7455 |
| myoC-7710 | + | CGCACAGCCAACCAAUGGCAGAAC | 24 | 7456 |
| myoC-7711 | + | CUGCAGUUAAGCCUGAAC | 18 | 7457 |
| myoC-7712 | + | UCUGCAGUUAAGCCUGAAC | 19 | 7458 |
| myoC-2273 | + | UUCUGCAGUUAAGCCUGAAC | 20 | 2353 |
| myoC-7713 | + | GUUCUGCAGUUAAGCCUGAAC | 21 | 7459 |
| myoC-7714 | + | GGUUCUGCAGUUAAGCCUGAAC | 22 | 7460 |
| myoC-7715 | + | UGGUUCUGCAGUUAAGCCUGAAC | 23 | 7461 |
| myoC-7716 | + | UUGGUUCUGCAGUUAAGCCUGAAC | 24 | 7462 |
| myoC-7717 | + | GAAGUGUUCACAGAACAC | 18 | 7463 |
| myoC-7718 | + | GGAAGUGUUCACAGAACAC | 19 | 7464 |
| myoC-2219 | + | GGGAAGUGUUCACAGAACAC | 20 | 2311 |
| myoC-7719 | + | AGGGAAGUGUUCACAGAACAC | 21 | 7465 |
| myoC-7720 | + | CAGGGAAGUGUUCACAGAACAC | 22 | 7466 |
| myoC-7721 | + | ACAGGGAAGUGUUCACAGAACAC | 23 | 7467 |
| myoC-7722 | + | CACAGGGAAGUGUUCACAGAACAC | 24 | 7468 |
| myoC-7723 | + | GAAGUAACUUUAAGCCAC | 18 | 7469 |
| myoC-7724 | + | AGAAGUAACUUUAAGCCAC | 19 | 7470 |
| myoC-2281 | + | CAGAAGUAACUUUAAGCCAC | 20 | 2360 |
| myoC-7725 | + | UCAGAAGUAACUUUAAGCCAC | 21 | 7471 |
| myoC-7726 | + | GUCAGAAGUAACUUUAAGCCAC | 22 | 7472 |
| myoC-7727 | + | UGUCAGAAGUAACUUUAAGCCAC | 23 | 7473 |
| myoC-7728 | + | CUGUCAGAAGUAACUUUAAGCCAC | 24 | 7474 |

TABLE 10G-continued

| 7th Tier | | | | |
|---|---|---|---|---|
| gRNA Name | DNA Strand | Targeting Domain | Target Site Length | Seq ID |
| myoC-7729 | + | ACUGACAUGGAGGGGCAC | 18 | 7475 |
| myoC-7730 | + | AACUGACAUGGAGGGGCAC | 19 | 7476 |
| myoC-7731 | + | AAACUGACAUGGAGGGGCAC | 20 | 7477 |
| myoC-7732 | + | AAAACUGACAUGGAGGGGCAC | 21 | 7478 |
| myoC-7733 | + | GAAAACUGACAUGGAGGGGCAC | 22 | 7479 |
| myoC-7734 | + | UGAAAACUGACAUGGAGGGGCAC | 23 | 7480 |
| myoC-7735 | + | GUGAAAACUGACAUGGAGGGGCAC | 24 | 7481 |
| myoC-7736 | + | CCCCUCACAGAGAAUCAC | 18 | 7482 |
| myoC-7737 | + | CCCCCUCACAGAGAAUCAC | 19 | 7483 |
| myoC-1085 | + | CCCCCCUCACAGAGAAUCAC | 20 | 1385 |
| myoC-7738 | + | UCCCCCCUCACAGAGAAUCAC | 21 | 7484 |
| myoC-7739 | + | AUCCCCCCUCACAGAGAAUCAC | 22 | 7485 |
| myoC-7740 | + | CAUCCCCCCUCACAGAGAAUCAC | 23 | 7486 |
| myoC-7741 | + | ACAUCCCCCCUCACAGAGAAUCAC | 24 | 7487 |
| myoC-7742 | + | CCUAGAACCCAGGAUCAC | 18 | 7488 |
| myoC-7743 | + | UCCUAGAACCCAGGAUCAC | 19 | 7489 |
| myoC-2249 | + | CUCCUAGAACCCAGGAUCAC | 20 | 2333 |
| myoC-7744 | + | CCUCCUAGAACCCAGGAUCAC | 21 | 7490 |
| myoC-7745 | + | GCCUCCUAGAACCCAGGAUCAC | 22 | 7491 |
| myoC-7746 | + | UGCCUCCUAGAACCCAGGAUCAC | 23 | 7492 |
| myoC-7747 | + | CUGCCUCCUAGAACCCAGGAUCAC | 24 | 7493 |
| myoC-5955 | + | AGUAGUUGCCCAGAAGAC | 18 | 5701 |
| myoC-5956 | + | GAGUAGUUGCCCAGAAGAC | 19 | 5702 |
| myoC-2202 | + | UGAGUAGUUGCCCAGAAGAC | 20 | 2297 |
| myoC-7748 | + | CUGAGUAGUUGCCCAGAAGAC | 21 | 7494 |
| myoC-7749 | + | GCUGAGUAGUUGCCCAGAAGAC | 22 | 7495 |
| myoC-7750 | + | GGCUGAGUAGUUGCCCAGAAGAC | 23 | 7496 |
| myoC-7751 | + | GGGCUGAGUAGUUGCCCAGAAGAC | 24 | 7497 |
| myoC-7752 | + | UGGACUGUGAAAACUGAC | 18 | 7498 |
| myoC-7753 | + | AUGGACUGUGAAAACUGAC | 19 | 7499 |
| myoC-7754 | + | UAUGGACUGUGAAAACUGAC | 20 | 7500 |
| myoC-7755 | + | CUAUGGACUGUGAAAACUGAC | 21 | 7501 |
| myoC-7756 | + | GCUAUGGACUGUGAAAACUGAC | 22 | 7502 |
| myoC-7757 | + | UGCUAUGGACUGUGAAAACUGAC | 23 | 7503 |
| myoC-7758 | + | UUGCUAUGGACUGUGAAAACUGAC | 24 | 7504 |
| myoC-7759 | + | CUAAAUUACUAGUAAUAC | 18 | 7505 |
| myoC-7760 | + | GCUAAAUUACUAGUAAUAC | 19 | 7506 |
| myoC-7761 | + | AGCUAAAUUACUAGUAAUAC | 20 | 7507 |

TABLE 10G-continued

| 7th Tier | | | | |
|---|---|---|---|---|
| gRNA Name | DNA Strand | Targeting Domain | Target Site Length | Seq ID |
| myoC-7762 | + | GAGCUAAAUUACUAGUAAUAC | 21 | 7508 |
| myoC-7763 | + | GGAGCUAAAUUACUAGUAAUAC | 22 | 7509 |
| myoC-7764 | + | AGGAGCUAAAUUACUAGUAAUAC | 23 | 7510 |
| myoC-7765 | + | CAGGAGCUAAAUUACUAGUAAUAC | 24 | 7511 |
| myoC-7766 | + | CAGAGAAGACUAUGGCCC | 18 | 7512 |
| myoC-7767 | + | GCAGAGAAGACUAUGGCCC | 19 | 7513 |
| myoC-1090 | + | AGCAGAGAAGACUAUGGCCC | 20 | 1390 |
| myoC-7768 | + | UAGCAGAGAAGACUAUGGCCC | 21 | 7514 |
| myoC-7769 | + | AUAGCAGAGAAGACUAUGGCCC | 22 | 7515 |
| myoC-7770 | + | UAUAGCAGAGAAGACUAUGGCCC | 23 | 7516 |
| myoC-7771 | + | UUAUAGCAGAGAAGACUAUGGCCC | 24 | 7517 |
| myoC-7772 | + | CAGGUCUCCCGACUUCCC | 18 | 7518 |
| myoC-7773 | + | UCAGGUCUCCCGACUUCCC | 19 | 7519 |
| myoC-2252 | + | AUCAGGUCUCCCGACUUCCC | 20 | 2336 |
| myoC-7774 | + | AAUCAGGUCUCCCGACUUCCC | 21 | 7520 |
| myoC-7775 | + | AAAUCAGGUCUCCCGACUUCCC | 22 | 7521 |
| myoC-7776 | + | GAAAUCAGGUCUCCCGACUUCCC | 23 | 7522 |
| myoC-7777 | + | AGAAAUCAGGUCUCCCGACUUCCC | 24 | 7523 |
| myoC-7778 | + | AGGGCAGGCAGGGAGGCC | 18 | 7524 |
| myoC-7779 | + | AAGGGCAGGCAGGGAGGCC | 19 | 7525 |
| myoC-5467 | + | AAAGGGCAGGCAGGGAGGCC | 20 | 5213 |
| myoC-7780 | + | GAAAGGGCAGGCAGGGAGGCC | 21 | 7526 |
| myoC-7781 | + | AGAAAGGGCAGGCAGGGAGGCC | 22 | 7527 |
| myoC-7782 | + | GAGAAAGGGCAGGCAGGGAGGCC | 23 | 7528 |
| myoC-7783 | + | GGAGAAAGGGCAGGCAGGGAGGCC | 24 | 7529 |
| myoC-7784 | + | GCAGAGAAGACUAUGGCC | 18 | 7530 |
| myoC-7785 | + | AGCAGAGAAGACUAUGGCC | 19 | 7531 |
| myoC-2215 | + | UAGCAGAGAAGACUAUGGCC | 20 | 2307 |
| myoC-7786 | + | AUAGCAGAGAAGACUAUGGCC | 21 | 7532 |
| myoC-7787 | + | UAUAGCAGAGAAGACUAUGGCC | 22 | 7533 |
| myoC-7788 | + | UUAUAGCAGAGAAGACUAUGGCC | 23 | 7534 |
| myoC-7789 | + | UUUAUAGCAGAGAAGACUAUGGCC | 24 | 7535 |
| myoC-7790 | + | UCUGUGUGUGUGCAUGCC | 18 | 7536 |
| myoC-7791 | + | CUCUGUGUGUGUGCAUGCC | 19 | 7537 |
| myoC-2302 | + | ACUCUGUGUGUGUGCAUGCC | 20 | 2375 |
| myoC-7792 | + | UACUCUGUGUGUGUGCAUGCC | 21 | 7538 |
| myoC-7793 | + | UUACUCUGUGUGUGUGCAUGCC | 22 | 7539 |

TABLE 10G-continued

| 7th Tier | | | | |
|---|---|---|---|---|
| gRNA Name | DNA Strand | Targeting Domain | Target Site Length | Seq ID |
| myoC-7794 | + | CUUACUCUGUGUGUGUGCAUGCC | 23 | 7540 |
| myoC-7795 | + | UCUUACUCUGUGUGUGUGCAUGCC | 24 | 7541 |
| myoC-7796 | + | CAGGGCUGAGUAGUUGCC | 18 | 7542 |
| myoC-7797 | + | ACAGGGCUGAGUAGUUGCC | 19 | 7543 |
| myoC-2203 | + | CACAGGGCUGAGUAGUUGCC | 20 | 2298 |
| myoC-7798 | + | CCACAGGGCUGAGUAGUUGCC | 21 | 7544 |
| myoC-7799 | + | ACCACAGGGCUGAGUAGUUGCC | 22 | 7545 |
| myoC-7800 | + | CACCACAGGGCUGAGUAGUUGCC | 23 | 7546 |
| myoC-7801 | + | CCACCACAGGGCUGAGUAGUUGCC | 24 | 7547 |
| myoC-7802 | + | CAAUAUAGCCCUGCCUCC | 18 | 7548 |
| myoC-7803 | + | ACAAUAUAGCCCUGCCUCC | 19 | 7549 |
| myoC-2251 | + | CACAAUAUAGCCCUGCCUCC | 20 | 2335 |
| myoC-7804 | + | CCACAAUAUAGCCCUGCCUCC | 21 | 7550 |
| myoC-7805 | + | CCCACAAUAUAGCCCUGCCUCC | 22 | 7551 |
| myoC-7806 | + | CCCCACAAUAUAGCCCUGCCUCC | 23 | 7552 |
| myoC-7807 | + | CCCCCACAAUAUAGCCCUGCCUCC | 24 | 7553 |
| myoC-7808 | + | AGCACCCUACCAGGCUCC | 18 | 7554 |
| myoC-7809 | + | CAGCACCCUACCAGGCUCC | 19 | 7555 |
| myoC-1217 | + | ACAGCACCCUACCAGGCUCC | 20 | 1517 |
| myoC-7810 | + | GACAGCACCCUACCAGGCUCC | 21 | 7556 |
| myoC-7811 | + | GGACAGCACCCUACCAGGCUCC | 22 | 7557 |
| myoC-7812 | + | AGGACAGCACCCUACCAGGCUCC | 23 | 7558 |
| myoC-7813 | + | AAGGACAGCACCCUACCAGGCUCC | 24 | 7559 |
| myoC-7814 | + | UUGGUUCUGCAGUUAAGC | 18 | 7560 |
| myoC-7815 | + | AUUGGUUCUGCAGUUAAGC | 19 | 7561 |
| myoC-2274 | + | GAUUGGUUCUGCAGUUAAGC | 20 | 2354 |
| myoC-7816 | + | UGAUUGGUUCUGCAGUUAAGC | 21 | 7562 |
| myoC-7817 | + | UUGAUUGGUUCUGCAGUUAAGC | 22 | 7563 |
| myoC-7818 | + | UUUGAUUGGUUCUGCAGUUAAGC | 23 | 7564 |
| myoC-7819 | + | AUUUGAUUGGUUCUGCAGUUAAGC | 24 | 7565 |
| myoC-4259 | + | GGAGCCUGGUGGCACAGC | 18 | 4005 |
| myoC-4260 | + | UGGAGCCUGGUGGCACAGC | 19 | 4006 |
| myoC-1701 | + | CUGGAGCCUGGUGGCACAGC | 20 | 1953 |
| myoC-4261 | + | UCUGGAGCCUGGUGGCACAGC | 21 | 4007 |
| myoC-4262 | + | CUCUGGAGCCUGGUGGCACAGC | 22 | 4008 |
| myoC-4263 | + | UCUCUGGAGCCUGGUGGCACAGC | 23 | 4009 |
| myoC-4264 | + | UUCUCUGGAGCCUGGUGGCACAGC | 24 | 4010 |
| myoC-7820 | + | UUAAAAACAAGAUCCAGC | 18 | 7566 |

TABLE 10G-continued

| 7th Tier | | | | |
|---|---|---|---|---|
| gRNA Name | DNA Strand | Targeting Domain | Target Site Length | Seq ID |
| myoC-7821 | + | GUUAAAAACAAGAUCCAGC | 19 | 7567 |
| myoC-1228 | + | UGUUAAAAACAAGAUCCAGC | 20 | 1528 |
| myoC-7822 | + | AUGUUAAAAACAAGAUCCAGC | 21 | 7568 |
| myoC-7823 | + | UAUGUUAAAAACAAGAUCCAGC | 22 | 7569 |
| myoC-7824 | + | AUAUGUUAAAAACAAGAUCCAGC | 23 | 7570 |
| myoC-7825 | + | AAUAUGUUAAAAACAAGAUCCAGC | 24 | 7571 |
| myoC-7826 | + | CUAGGAGAAAGGGCAGGC | 18 | 7572 |
| myoC-7827 | + | UCUAGGAGAAAGGGCAGGC | 19 | 7573 |
| myoC-5471 | + | CUCUAGGAGAAAGGGCAGGC | 20 | 5217 |
| myoC-7828 | + | UCUCUAGGAGAAAGGGCAGGC | 21 | 7574 |
| myoC-7829 | + | GUCUCUAGGAGAAAGGGCAGGC | 22 | 7575 |
| myoC-7830 | + | AGUCUCUAGGAGAAAGGGCAGGC | 23 | 7576 |
| myoC-7831 | + | CAGUCUCUAGGAGAAAGGGCAGGC | 24 | 7577 |
| myoC-7832 | + | AAGGGCAGGCAGGGAGGC | 18 | 7578 |
| myoC-7833 | + | AAAGGGCAGGCAGGGAGGC | 19 | 7579 |
| myoC-7834 | + | GAAAGGGCAGGCAGGGAGGC | 20 | 7580 |
| myoC-7835 | + | AGAAAGGGCAGGCAGGGAGGC | 21 | 7581 |
| myoC-7836 | + | GAGAAAGGGCAGGCAGGGAGGC | 22 | 7582 |
| myoC-7837 | + | GGAGAAAGGGCAGGCAGGGAGGC | 23 | 7583 |
| myoC-7838 | + | AGGAGAAAGGGCAGGCAGGGAGGC | 24 | 7584 |
| myoC-7839 | + | CAGUCACUGCUGAGCUGC | 18 | 7585 |
| myoC-7840 | + | GCAGUCACUGCUGAGCUGC | 19 | 7586 |
| myoC-2245 | + | AGCAGUCACUGCUGAGCUGC | 20 | 2329 |
| myoC-7841 | + | CAGCAGUCACUGCUGAGCUGC | 21 | 7587 |
| myoC-7842 | + | UCAGCAGUCACUGCUGAGCUGC | 22 | 7588 |
| myoC-7843 | + | GUCAGCAGUCACUGCUGAGCUGC | 23 | 7589 |
| myoC-7844 | + | UGUCAGCAGUCACUGCUGAGCUGC | 24 | 7590 |
| myoC-7845 | + | AACCUCAUUGGUGAAAUC | 18 | 7591 |
| myoC-7846 | + | GAACCUCAUUGGUGAAAUC | 19 | 7592 |
| myoC-1224 | + | AGAACCUCAUUGGUGAAAUC | 20 | 1524 |
| myoC-7847 | + | AAGAACCUCAUUGGUGAAAUC | 21 | 7593 |
| myoC-7848 | + | CAAGAACCUCAUUGGUGAAAUC | 22 | 7594 |
| myoC-7849 | + | CCAAGAACCUCAUUGGUGAAAUC | 23 | 7595 |
| myoC-7850 | + | GCCAAGAACCUCAUUGGUGAAAUC | 24 | 7596 |
| myoC-3315 | + | UCGCUUCUUCUCUUCCUC | 18 | 3061 |
| myoC-3316 | + | GUCGCUUCUUCUCUUCCUC | 19 | 3062 |
| myoC-1696 | + | AGUCGCUUCUUCUCUUCCUC | 20 | 1950 |

TABLE 10G-continued

| 7th Tier | | | | |
|---|---|---|---|---|
| gRNA Name | DNA Strand | Targeting Domain | Target Site Length | Seq ID |
| myoC-3317 | + | UAGUCGCUUCUUCUCUUCCUC | 21 | 3063 |
| myoC-3318 | + | UUAGUCGCUUCUUCUCUUCCUC | 22 | 3064 |
| myoC-3319 | + | CUUAGUCGCUUCUUCUCUUCCUC | 23 | 3065 |
| myoC-3320 | + | CCUUAGUCGCUUCUUCUCUUCCUC | 24 | 3066 |
| myoC-7851 | + | CAGCACCCUACCAGGCUC | 18 | 7597 |
| myoC-7852 | + | ACAGCACCCUACCAGGCUC | 19 | 7598 |
| myoC-2311 | + | GACAGCACCCUACCAGGCUC | 20 | 2380 |
| myoC-7853 | + | GGACAGCACCCUACCAGGCUC | 21 | 7599 |
| myoC-7854 | + | AGGACAGCACCCUACCAGGCUC | 22 | 7600 |
| myoC-7855 | + | AAGGACAGCACCCUACCAGGCUC | 23 | 7601 |
| myoC-7856 | + | CAAGGACAGCACCCUACCAGGCUC | 24 | 7602 |
| myoC-7857 | + | AAUCUAAAUGAAGCUCUC | 18 | 7603 |
| myoC-7858 | + | UAAUCUAAAUGAAGCUCUC | 19 | 7604 |
| myoC-5474 | + | CUAAUCUAAAUGAAGCUCUC | 20 | 5220 |
| myoC-7859 | + | ACUAAUCUAAAUGAAGCUCUC | 21 | 7605 |
| myoC-7860 | + | CACUAAUCUAAAUGAAGCUCUC | 22 | 7606 |
| myoC-7861 | + | CCACUAAUCUAAAUGAAGCUCUC | 23 | 7607 |
| myoC-7862 | + | ACCACUAAUCUAAAUGAAGCUCUC | 24 | 7608 |
| myoC-7863 | + | UGCUAGCUGUGCAGUCUC | 18 | 7609 |
| myoC-7864 | + | GUGCUAGCUGUGCAGUCUC | 19 | 7610 |
| myoC-7865 | + | UGUGCUAGCUGUGCAGUCUC | 20 | 7611 |
| myoC-7866 | + | UUGUGCUAGCUGUGCAGUCUC | 21 | 7612 |
| myoC-7867 | + | CUUGUGCUAGCUGUGCAGUCUC | 22 | 7613 |
| myoC-7868 | + | UCUUGUGCUAGCUGUGCAGUCUC | 23 | 7614 |
| myoC-7869 | + | GUCUUGUGCUAGCUGUGCAGUCUC | 24 | 7615 |
| myoC-4331 | + | CUGCAUUCUUACCUUCUC | 18 | 4077 |
| myoC-4332 | + | UCUGCAUUCUUACCUUCUC | 19 | 4078 |
| myoC-3184 | + | CUCUGCAUUCUUACCUUCUC | 20 | 2930 |
| myoC-4333 | + | ACUCUGCAUUCUUACCUUCUC | 21 | 4079 |
| myoC-4334 | + | CACUCUGCAUUCUUACCUUCUC | 22 | 4080 |
| myoC-4335 | + | CCACUCUGCAUUCUUACCUUCUC | 23 | 4081 |
| myoC-4336 | + | CCCACUCUGCAUUCUUACCUUCUC | 24 | 4082 |
| myoC-7870 | + | GCAUUGUGGCUCUCGGUC | 18 | 7616 |
| myoC-7871 | + | AGCAUUGUGGCUCUCGGUC | 19 | 7617 |
| myoC-2232 | + | AAGCAUUGUGGCUCUCGGUC | 20 | 2320 |
| myoC-7872 | + | GAAGCAUUGUGGCUCUCGGUC | 21 | 7618 |
| myoC-7873 | + | UGAAGCAUUGUGGCUCUCGGUC | 22 | 7619 |
| myoC-7874 | + | CUGAAGCAUUGUGGCUCUCGGUC | 23 | 7620 |

TABLE 10G-continued

| 7th Tier | | | | |
|---|---|---|---|---|
| gRNA Name | DNA Strand | Targeting Domain | Target Site Length | Seq ID |
| myoC-7875 | + | CCUGAAGCAUUGUGGCUCUCGGUC | 24 | 7621 |
| myoC-4343 | + | CGAGCAGUGUCUCGGGUC | 18 | 4089 |
| myoC-4344 | + | CCGAGCAGUGUCUCGGGUC | 19 | 4090 |
| myoC-203 | + | CCCGAGCAGUGUCUCGGGUC | 20 | 589 |
| myoC-4345 | + | GCCCGAGCAGUGUCUCGGGUC | 21 | 4091 |
| myoC-4346 | + | AGCCCGAGCAGUGUCUCGGGUC | 22 | 4092 |
| myoC-4347 | + | CAGCCCGAGCAGUGUCUCGGGUC | 23 | 4093 |
| myoC-4348 | + | ACAGCCCGAGCAGUGUCUCGGGUC | 24 | 4094 |
| myoC-7876 | + | UGGGUUCAUUGAGCUUUC | 18 | 7622 |
| myoC-7877 | + | UUGGGUUCAUUGAGCUUUC | 19 | 7623 |
| myoC-2233 | + | GUUGGGUUCAUUGAGCUUUC | 20 | 2321 |
| myoC-7878 | + | UGUUGGGUUCAUUGAGCUUUC | 21 | 7624 |
| myoC-7879 | + | CUGUUGGGUUCAUUGAGCUUUC | 22 | 7625 |
| myoC-7880 | + | GCUGUUGGGUUCAUUGAGCUUUC | 23 | 7626 |
| myoC-7881 | + | GGCUGUUGGGUUCAUUGAGCUUUC | 24 | 7627 |
| myoC-7882 | + | GACUAUGGCCCAGGGAAG | 18 | 7628 |
| myoC-7883 | + | AGACUAUGGCCCAGGGAAG | 19 | 7629 |
| myoC-2210 | + | AAGACUAUGGCCCAGGGAAG | 20 | 2305 |
| myoC-7884 | + | GAAGACUAUGGCCCAGGGAAG | 21 | 7630 |
| myoC-7885 | + | AGAAGACUAUGGCCCAGGGAAG | 22 | 7631 |
| myoC-7886 | + | GAGAAGACUAUGGCCCAGGGAAG | 23 | 7632 |
| myoC-7887 | + | AGAGAAGACUAUGGCCCAGGGAAG | 24 | 7633 |
| myoC-7888 | + | AAAAGAGUUCCUAAUAAG | 18 | 7634 |
| myoC-7889 | + | AAAAAGAGUUCCUAAUAAG | 19 | 7635 |
| myoC-2257 | + | GAAAAAGAGUUCCUAAUAAG | 20 | 2340 |
| myoC-7890 | + | AGAAAAAGAGUUCCUAAUAAG | 21 | 7636 |
| myoC-7891 | + | GAGAAAAAGAGUUCCUAAUAAG | 22 | 7637 |
| myoC-7892 | + | AGAGAAAAAGAGUUCCUAAUAAG | 23 | 7638 |
| myoC-7893 | + | CAGAGAAAAAGAGUUCCUAAUAAG | 24 | 7639 |
| myoC-7894 | + | GUUAAAAACAAGAUCCAG | 18 | 7640 |
| myoC-7895 | + | UGUUAAAAACAAGAUCCAG | 19 | 7641 |
| myoC-2292 | + | AUGUUAAAAACAAGAUCCAG | 20 | 2369 |
| myoC-7896 | + | UAUGUUAAAAACAAGAUCCAG | 21 | 7642 |
| myoC-7897 | + | AUAUGUUAAAAACAAGAUCCAG | 22 | 7643 |
| myoC-7898 | + | AAUAUGUUAAAAACAAGAUCCAG | 23 | 7644 |
| myoC-7899 | + | UAAUAUGUUAAAAACAAGAUCCAG | 24 | 7645 |
| myoC-7900 | + | GCAGACUCACCUCCAGAG | 18 | 7646 |

TABLE 10G-continued

| 7th Tier | | | | |
|---|---|---|---|---|
| gRNA Name | DNA Strand | Targeting Domain | Target Site Length | Seq ID |
| myoC-7901 | + | GGCAGACUCACCUCCAGAG | 19 | 7647 |
| myoC-1181 | + | UGGCAGACUCACCUCCAGAG | 20 | 1481 |
| myoC-7902 | + | CUGGCAGACUCACCUCCAGAG | 21 | 7648 |
| myoC-7903 | + | CCUGGCAGACUCACCUCCAGAG | 22 | 7649 |
| myoC-7904 | + | CCCUGGCAGACUCACCUCCAGAG | 23 | 7650 |
| myoC-7905 | + | GCCCUGGCAGACUCACCUCCAGAG | 24 | 7651 |
| myoC-7906 | + | CUGCAAGGGUCUUUAUAG | 18 | 7652 |
| myoC-7907 | + | GCUGCAAGGGUCUUUAUAG | 19 | 7653 |
| myoC-2217 | + | AGCUGCAAGGGUCUUUAUAG | 20 | 2309 |
| myoC-7908 | + | GAGCUGCAAGGGUCUUUAUAG | 21 | 7654 |
| myoC-7909 | + | AGAGCUGCAAGGGUCUUUAUAG | 22 | 7655 |
| myoC-7910 | + | GAGAGCUGCAAGGGUCUUUAUAG | 23 | 7656 |
| myoC-7911 | + | CGAGAGCUGCAAGGGUCUUUAUAG | 24 | 7657 |
| myoC-7912 | + | UAGCUGUGCAGUCUCUAG | 18 | 7658 |
| myoC-7913 | + | CUAGCUGUGCAGUCUCUAG | 19 | 7659 |
| myoC-7914 | + | GCUAGCUGUGCAGUCUCUAG | 20 | 7660 |
| myoC-7915 | + | UGCUAGCUGUGCAGUCUCUAG | 21 | 7661 |
| myoC-7916 | + | GUGCUAGCUGUGCAGUCUCUAG | 22 | 7662 |
| myoC-7917 | + | UGUGCUAGCUGUGCAGUCUCUAG | 23 | 7663 |
| myoC-7918 | + | UUGUGCUAGCUGUGCAGUCUCUAG | 24 | 7664 |
| myoC-7919 | + | AUCAGAUAGUAAACAUCG | 18 | 7665 |
| myoC-7920 | + | AAUCAGAUAGUAAACAUCG | 19 | 7666 |
| myoC-2269 | + | GAAUCAGAUAGUAAACAUCG | 20 | 2349 |
| myoC-7921 | + | UGAAUCAGAUAGUAAACAUCG | 21 | 7667 |
| myoC-7922 | + | CUGAAUCAGAUAGUAAACAUCG | 22 | 7668 |
| myoC-7923 | + | UCUGAAUCAGAUAGUAAACAUCG | 23 | 7669 |
| myoC-7924 | + | UUCUGAAUCAGAUAGUAAACAUCG | 24 | 7670 |
| myoC-7925 | + | ACCCUACCAGGCUCCAGG | 18 | 7671 |
| myoC-7926 | + | CACCCUACCAGGCUCCAGG | 19 | 7672 |
| myoC-2308 | + | GCACCCUACCAGGCUCCAGG | 20 | 2379 |
| myoC-7927 | + | AGCACCCUACCAGGCUCCAGG | 21 | 7673 |
| myoC-7928 | + | CAGCACCCUACCAGGCUCCAGG | 22 | 7674 |
| myoC-7929 | + | ACAGCACCCUACCAGGCUCCAGG | 23 | 7675 |
| myoC-7930 | + | GACAGCACCCUACCAGGCUCCAGG | 24 | 7676 |
| myoC-7931 | + | UCUAGGAGAAAGGGCAGG | 18 | 7677 |
| myoC-7932 | + | CUCUAGGAGAAAGGGCAGG | 19 | 7678 |
| myoC-7933 | + | UCUCUAGGAGAAAGGGCAGG | 20 | 7679 |
| myoC-7934 | + | GUCUCUAGGAGAAAGGGCAGG | 21 | 7680 |

TABLE 10G-continued

| 7th Tier | | | | |
|---|---|---|---|---|
| gRNA Name | DNA Strand | Targeting Domain | Target Site Length | Seq ID |
| myoC-7935 | + | AGUCUCUAGGAGAAAGGGCAGG | 22 | 7681 |
| myoC-7936 | + | CAGUCUCUAGGAGAAAGGGCAGG | 23 | 7682 |
| myoC-7937 | + | GCAGUCUCUAGGAGAAAGGGCAGG | 24 | 7683 |
| myoC-7938 | + | CGUGGGGUGCUGGUCAGG | 18 | 7684 |
| myoC-7939 | + | GCGUGGGGUGCUGGUCAGG | 19 | 7685 |
| myoC-2242 | + | UGCGUGGGGUGCUGGUCAGG | 20 | 2327 |
| myoC-7940 | + | CUGCGUGGGGUGCUGGUCAGG | 21 | 7686 |
| myoC-7941 | + | GCUGCGUGGGGUGCUGGUCAGG | 22 | 7687 |
| myoC-7942 | + | AGCUGCGUGGGGUGCUGGUCAGG | 23 | 7688 |
| myoC-7943 | + | GAGCUGCGUGGGGUGCUGGUCAGG | 24 | 7689 |
| myoC-7944 | + | GAAGACUAUGGCCCAGGG | 18 | 7690 |
| myoC-7945 | + | AGAAGACUAUGGCCCAGGG | 19 | 7691 |
| myoC-2212 | + | GAGAAGACUAUGGCCCAGGG | 20 | 2306 |
| myoC-7946 | + | AGAGAAGACUAUGGCCCAGGG | 21 | 7692 |
| myoC-7947 | + | CAGAGAAGACUAUGGCCCAGGG | 22 | 7693 |
| myoC-7948 | + | GCAGAGAAGACUAUGGCCCAGGG | 23 | 7694 |
| myoC-7949 | + | AGCAGAGAAGACUAUGGCCCAGGG | 24 | 7695 |
| myoC-7950 | + | CAUUGUCUAUGCUUAGGG | 18 | 7696 |
| myoC-7951 | + | CCAUUGUCUAUGCUUAGGG | 19 | 7697 |
| myoC-2237 | + | GCCAUUGUCUAUGCUUAGGG | 20 | 2324 |
| myoC-7952 | + | UGCCAUUGUCUAUGCUUAGGG | 21 | 7698 |
| myoC-7953 | + | AUGCCAUUGUCUAUGCUUAGGG | 22 | 7699 |
| myoC-7954 | + | AAUGCCAUUGUCUAUGCUUAGGG | 23 | 7700 |
| myoC-7955 | + | AAAUGCCAUUGUCUAUGCUUAGGG | 24 | 7701 |
| myoC-7956 | + | CGCACAGCCAACCAAUGG | 18 | 7702 |
| myoC-7957 | + | UCGCACAGCCAACCAAUGG | 19 | 7703 |
| myoC-2209 | + | GUCGCACAGCCAACCAAUGG | 20 | 2304 |
| myoC-7958 | + | GGUCGCACAGCCAACCAAUGG | 21 | 7704 |
| myoC-7959 | + | CGGUCGCACAGCCAACCAAUGG | 22 | 7705 |
| myoC-7960 | + | ACGGUCGCACAGCCAACCAAUGG | 23 | 7706 |
| myoC-7961 | + | CACGGUCGCACAGCCAACCAAUGG | 24 | 7707 |
| myoC-7962 | + | CUGUGAAAACUGACAUGG | 18 | 7708 |
| myoC-7963 | + | ACUGUGAAAACUGACAUGG | 19 | 7709 |
| myoC-5479 | + | GACUGUGAAAACUGACAUGG | 20 | 5225 |
| myoC-7964 | + | GGACUGUGAAAACUGACAUGG | 21 | 7710 |
| myoC-7965 | + | UGGACUGUGAAAACUGACAUGG | 22 | 7711 |
| myoC-7966 | + | AUGGACUGUGAAAACUGACAUGG | 23 | 7712 |

TABLE 10G-continued

| gRNA Name | DNA Strand | Targeting Domain | Target Site Length | Seq ID |
|---|---|---|---|---|
| 7th Tier | | | | |
| myoC-7967 | + | UAUGGACUGUGAAAACUGACAUGG | 24 | 7713 |
| myoC-7968 | + | ACAACUGUGUAUCUUUGG | 18 | 7714 |
| myoC-7969 | + | AACAACUGUGUAUCUUUGG | 19 | 7715 |
| myoC-2303 | + | AAACAACUGUGUAUCUUUGG | 20 | 2376 |
| myoC-7970 | + | AAAACAACUGUGUAUCUUUGG | 21 | 7716 |
| myoC-7971 | + | UAAAACAACUGUGUAUCUUUGG | 22 | 7717 |
| myoC-7972 | + | UUAAAACAACUGUGUAUCUUUGG | 23 | 7718 |
| myoC-7973 | + | UUUAAAACAACUGUGUAUCUUUGG | 24 | 7719 |
| myoC-7974 | + | ACUGUGAAAACUGACAUG | 18 | 7720 |
| myoC-7975 | + | GACUGUGAAAACUGACAUG | 19 | 7721 |
| myoC-7976 | + | GGACUGUGAAAACUGACAUG | 20 | 7722 |
| myoC-7977 | + | UGGACUGUGAAAACUGACAUG | 21 | 7723 |
| myoC-7978 | + | AUGGACUGUGAAAACUGACAUG | 22 | 7724 |
| myoC-7979 | + | UAUGGACUGUGAAAACUGACAUG | 23 | 7725 |
| myoC-7980 | + | CUAUGGACUGUGAAAACUGACAUG | 24 | 7726 |
| myoC-7981 | + | UGCUGUCAGCAGUCACUG | 18 | 7727 |
| myoC-7982 | + | GUGCUGUCAGCAGUCACUG | 19 | 7728 |
| myoC-2246 | + | CGUGCUGUCAGCAGUCACUG | 20 | 2330 |
| myoC-7983 | + | CCGUGCUGUCAGCAGUCACUG | 21 | 7729 |
| myoC-7984 | + | UCCGUGCUGUCAGCAGUCACUG | 22 | 7730 |
| myoC-7985 | + | CUCCGUGCUGUCAGCAGUCACUG | 23 | 7731 |
| myoC-7986 | + | ACUCCGUGCUGUCAGCAGUCACUG | 24 | 7732 |
| myoC-7987 | + | CGUGAUCAGUGAGGACUG | 18 | 7733 |
| myoC-7988 | + | ACGUGAUCAGUGAGGACUG | 19 | 7734 |
| myoC-2228 | + | GACGUGAUCAGUGAGGACUG | 20 | 2317 |
| myoC-7989 | + | UGACGUGAUCAGUGAGGACUG | 21 | 7735 |
| myoC-7990 | + | CUGACGUGAUCAGUGAGGACUG | 22 | 7736 |
| myoC-7991 | + | UCUGACGUGAUCAGUGAGGACUG | 23 | 7737 |
| myoC-7992 | + | GUCUGACGUGAUCAGUGAGGACUG | 24 | 7738 |
| myoC-7993 | + | UACGAGCCAUAUCACCUG | 18 | 7739 |
| myoC-7994 | + | CUACGAGCCAUAUCACCUG | 19 | 7740 |
| myoC-7995 | + | ACUACGAGCCAUAUCACCUG | 20 | 7741 |
| myoC-7996 | + | CACUACGAGCCAUAUCACCUG | 21 | 7742 |
| myoC-7997 | + | UCACUACGAGCCAUAUCACCUG | 22 | 7743 |
| myoC-7998 | + | GUCACUACGAGCCAUAUCACCUG | 23 | 7744 |
| myoC-7999 | + | GGUCACUACGAGCCAUAUCACCUG | 24 | 7745 |
| myoC-8000 | + | CCUCAUUGGUGAAAUCUG | 18 | 7746 |
| myoC-8001 | + | ACCUCAUUGGUGAAAUCUG | 19 | 7747 |

TABLE 10G-continued

| 7th Tier | | | | |
|---|---|---|---|---|
| gRNA Name | DNA Strand | Targeting Domain | Target Site Length | Seq ID |
| myoC-1226 | + | AACCUCAUUGGUGAAAUCUG | 20 | 1526 |
| myoC-8002 | + | GAACCUCAUUGGUGAAAUCUG | 21 | 7748 |
| myoC-8003 | + | AGAACCUCAUUGGUGAAAUCUG | 22 | 7749 |
| myoC-8004 | + | AAGAACCUCAUUGGUGAAAUCUG | 23 | 7750 |
| myoC-8005 | + | CAAGAACCUCAUUGGUGAAAUCUG | 24 | 7751 |
| myoC-8006 | + | AGACUCACCUCCAGAGUG | 18 | 7752 |
| myoC-8007 | + | CAGACUCACCUCCAGAGUG | 19 | 7753 |
| myoC-2275 | + | GCAGACUCACCUCCAGAGUG | 20 | 2355 |
| myoC-8008 | + | GGCAGACUCACCUCCAGAGUG | 21 | 7754 |
| myoC-8009 | + | UGGCAGACUCACCUCCAGAGUG | 22 | 7755 |
| myoC-8010 | + | CUGGCAGACUCACCUCCAGAGUG | 23 | 7756 |
| myoC-8011 | + | CCUGGCAGACUCACCUCCAGAGUG | 24 | 7757 |
| myoC-8012 | + | AUGCCAAGAACCUCAUUG | 18 | 7758 |
| myoC-8013 | + | CAUGCCAAGAACCUCAUUG | 19 | 7759 |
| myoC-2301 | + | GCAUGCCAAGAACCUCAUUG | 20 | 2374 |
| myoC-8014 | + | UGCAUGCCAAGAACCUCAUUG | 21 | 7760 |
| myoC-8015 | + | GUGCAUGCCAAGAACCUCAUUG | 22 | 7761 |
| myoC-8016 | + | UGUGCAUGCCAAGAACCUCAUUG | 23 | 7762 |
| myoC-8017 | + | GUGUGCAUGCCAAGAACCUCAUUG | 24 | 7763 |
| myoC-8018 | + | GAACCUCAUUGGUGAAAU | 18 | 7764 |
| myoC-8019 | + | AGAACCUCAUUGGUGAAAU | 19 | 7765 |
| myoC-2300 | + | AAGAACCUCAUUGGUGAAAU | 20 | 2373 |
| myoC-8020 | + | CAAGAACCUCAUUGGUGAAAU | 21 | 7766 |
| myoC-8021 | + | CCAAGAACCUCAUUGGUGAAAU | 22 | 7767 |
| myoC-8022 | + | GCCAAGAACCUCAUUGGUGAAAU | 23 | 7768 |
| myoC-8023 | + | UGCCAAGAACCUCAUUGGUGAAAU | 24 | 7769 |
| myoC-8024 | + | AAAGGUACAAAUAACAAU | 18 | 7770 |
| myoC-8025 | + | AAAAGGUACAAAUAACAAU | 19 | 7771 |
| myoC-8026 | + | CAAAAGGUACAAAUAACAAU | 20 | 7772 |
| myoC-8027 | + | UCAAAAGGUACAAAUAACAAU | 21 | 7773 |
| myoC-8028 | + | AUCAAAAGGUACAAAUAACAAU | 22 | 7774 |
| myoC-8029 | + | CAUCAAAAGGUACAAAUAACAAU | 23 | 7775 |
| myoC-8030 | + | ACAUCAAAAGGUACAAAUAACAAU | 24 | 7776 |
| myoC-8031 | + | AGAAAAAGAGUUCCUAAU | 18 | 7777 |
| myoC-8032 | + | GAGAAAAAGAGUUCCUAAU | 19 | 7778 |
| myoC-2259 | + | AGAGAAAAAGAGUUCCUAAU | 20 | 2341 |
| myoC-8033 | + | CAGAGAAAAAGAGUUCCUAAU | 21 | 7779 |

TABLE 10G-continued

| 7th Tier | | | | |
|---|---|---|---|---|
| gRNA Name | DNA Strand | Targeting Domain | Target Site Length | Seq ID |
| myoC-8034 | + | ACAGAGAAAAAGAGUUCCUAAU | 22 | 7780 |
| myoC-8035 | + | CACAGAGAAAAAGAGUUCCUAAU | 23 | 7781 |
| myoC-8036 | + | CCACAGAGAAAAAGAGUUCCUAAU | 24 | 7782 |
| myoC-8037 | + | AAAGGAAAAAUAUAGUAU | 18 | 7783 |
| myoC-8038 | + | UAAAGGAAAAAUAUAGUAU | 19 | 7784 |
| myoC-2253 | + | GUAAAGGAAAAAUAUAGUAU | 20 | 2337 |
| myoC-8039 | + | UGUAAAGGAAAAAUAUAGUAU | 21 | 7785 |
| myoC-8040 | + | UUGUAAAGGAAAAAUAUAGUAU | 22 | 7786 |
| myoC-8041 | + | CUUGUAAAGGAAAAAUAUAGUAU | 23 | 7787 |
| myoC-8042 | + | GCUUGUAAAGGAAAAAUAUAGUAU | 24 | 7788 |
| myoC-8043 | + | UGGAGGGGCACAAGAACU | 18 | 7789 |
| myoC-8044 | + | AUGGAGGGGCACAAGAACU | 19 | 7790 |
| myoC-8045 | + | CAUGGAGGGGCACAAGAACU | 20 | 7791 |
| myoC-8046 | + | ACAUGGAGGGGCACAAGAACU | 21 | 7792 |
| myoC-8047 | + | GACAUGGAGGGGCACAAGAACU | 22 | 7793 |
| myoC-8048 | + | UGACAUGGAGGGGCACAAGAACU | 23 | 7794 |
| myoC-8049 | + | CUGACAUGGAGGGGCACAAGAACU | 24 | 7795 |
| myoC-8050 | + | CGCCUGUAGCAGGUCACU | 18 | 7796 |
| myoC-8051 | + | GCGCCUGUAGCAGGUCACU | 19 | 7797 |
| myoC-8052 | + | AGCGCCUGUAGCAGGUCACU | 20 | 7798 |
| myoC-8053 | + | GAGCGCCUGUAGCAGGUCACU | 21 | 7799 |
| myoC-8054 | + | GGAGCGCCUGUAGCAGGUCACU | 22 | 7800 |
| myoC-8055 | + | UGGAGCGCCUGUAGCAGGUCACU | 23 | 7801 |
| myoC-8056 | + | CUGGAGCGCCUGUAGCAGGUCACU | 24 | 7802 |
| myoC-8057 | + | CUCCUUUUGCUAUGGACU | 18 | 7803 |
| myoC-8058 | + | UCUCCUUUUGCUAUGGACU | 19 | 7804 |
| myoC-8059 | + | UUCUCCUUUUGCUAUGGACU | 20 | 7805 |
| myoC-8060 | + | UUUCUCCUUUUGCUAUGGACU | 21 | 7806 |
| myoC-8061 | + | AUUUCUCCUUUUGCUAUGGACU | 22 | 7807 |
| myoC-8062 | + | UAUUUCUCCUUUUGCUAUGGACU | 23 | 7808 |
| myoC-8063 | + | UUAUUUCUCCUUUUGCUAUGGACU | 24 | 7809 |
| myoC-8064 | + | UUGAAAUAAUGAUUGCCU | 18 | 7810 |
| myoC-8065 | + | CUUGAAAUAAUGAUUGCCU | 19 | 7811 |
| myoC-2280 | + | ACUUGAAAUAAUGAUUGCCU | 20 | 2359 |
| myoC-8066 | + | CACUUGAAAUAAUGAUUGCCU | 21 | 7812 |
| myoC-8067 | + | CCACUUGAAAUAAUGAUUGCCU | 22 | 7813 |
| myoC-8068 | + | GCCACUUGAAAUAAUGAUUGCCU | 23 | 7814 |
| myoC-8069 | + | AGCCACUUGAAAUAAUGAUUGCCU | 24 | 7815 |

TABLE 10G-continued

| 7th Tier | | | | |
|---|---|---|---|---|
| gRNA Name | DNA Strand | Targeting Domain | Target Site Length | Seq ID |
| myoC-8070 | + | AAUGCCAUUGUCUAUGCU | 18 | 7816 |
| myoC-8071 | + | AAAUGCCAUUGUCUAUGCU | 19 | 7817 |
| myoC-2240 | + | CAAAUGCCAUUGUCUAUGCU | 20 | 2325 |
| myoC-8072 | + | GCAAAUGCCAUUGUCUAUGCU | 21 | 7818 |
| myoC-8073 | + | GGCAAAUGCCAUUGUCUAUGCU | 22 | 7819 |
| myoC-8074 | + | UGGCAAAUGCCAUUGUCUAUGCU | 23 | 7820 |
| myoC-8075 | + | UUGGCAAAUGCCAUUGUCUAUGCU | 24 | 7821 |
| myoC-8076 | + | UUUAUUUCUCCUUUUGCU | 18 | 7822 |
| myoC-8077 | + | UUUUAUUUCUCCUUUUGCU | 19 | 7823 |
| myoC-8078 | + | CUUUUAUUUCUCCUUUUGCU | 20 | 7824 |
| myoC-8079 | + | CCUUUUAUUUCUCCUUUUGCU | 21 | 7825 |
| myoC-8080 | + | UCCUUUUAUUUCUCCUUUUGCU | 22 | 7826 |
| myoC-8081 | + | GUCCUUUUAUUUCUCCUUUUGCU | 23 | 7827 |
| myoC-8082 | + | GGUCCUUUUAUUUCUCCUUUUGCU | 24 | 7828 |
| myoC-8083 | + | ACCUCAUUGGUGAAAUCU | 18 | 7829 |
| myoC-8084 | + | AACCUCAUUGGUGAAAUCU | 19 | 7830 |
| myoC-1225 | + | GAACCUCAUUGGUGAAAUCU | 20 | 1525 |
| myoC-8085 | + | AGAACCUCAUUGGUGAAAUCU | 21 | 7831 |
| myoC-8086 | + | AAGAACCUCAUUGGUGAAAUCU | 22 | 7832 |
| myoC-8087 | + | CAAGAACCUCAUUGGUGAAAUCU | 23 | 7833 |
| myoC-8088 | + | CCAAGAACCUCAUUGGUGAAAUCU | 24 | 7834 |
| myoC-8089 | + | UAAAACAACUGUGUAUCU | 18 | 7835 |
| myoC-8090 | + | UUAAAACAACUGUGUAUCU | 19 | 7836 |
| myoC-2306 | + | UUUAAAACAACUGUGUAUCU | 20 | 2377 |
| myoC-8091 | + | CUUUAAAACAACUGUGUAUCU | 21 | 7837 |
| myoC-8092 | + | GCUUUAAAACAACUGUGUAUCU | 22 | 7838 |
| myoC-8093 | + | AGCUUUAAAACAACUGUGUAUCU | 23 | 7839 |
| myoC-8094 | + | UAGCUUUAAAACAACUGUGUAUCU | 24 | 7840 |
| myoC-8095 | + | UCUGUUUGGCUUUACUCU | 18 | 7841 |
| myoC-8096 | + | AUCUGUUUGGCUUUACUCU | 19 | 7842 |
| myoC-2267 | + | AAUCUGUUUGGCUUUACUCU | 20 | 2347 |
| myoC-8097 | + | GAAUCUGUUUGGCUUUACUCU | 21 | 7843 |
| myoC-8098 | + | UGAAUCUGUUUGGCUUUACUCU | 22 | 7844 |
| myoC-8099 | + | UUGAAUCUGUUUGGCUUUACUCU | 23 | 7845 |
| myoC-8100 | + | CUUGAAUCUGUUUGGCUUUACUCU | 24 | 7846 |
| myoC-8101 | + | UAAUCUAAAUGAAGCUCU | 18 | 7847 |
| myoC-8102 | + | CUAAUCUAAAUGAAGCUCU | 19 | 7848 |

TABLE 10G-continued

| 7th Tier | | | | |
|---|---|---|---|---|
| gRNA Name | DNA Strand | Targeting Domain | Target Site Length | Seq ID |
| myoC-8103 | + | ACUAAUCUAAAUGAAGCUCU | 20 | 7849 |
| myoC-8104 | + | CACUAAUCUAAAUGAAGCUCU | 21 | 7850 |
| myoC-8105 | + | CCACUAAUCUAAAUGAAGCUCU | 22 | 7851 |
| myoC-8106 | + | ACCACUAAUCUAAAUGAAGCUCU | 23 | 7852 |
| myoC-8107 | + | AACCACUAAUCUAAAUGAAGCUCU | 24 | 7853 |
| myoC-8108 | + | GCUAGCUGUGCAGUCUCU | 18 | 7854 |
| myoC-8109 | + | UGCUAGCUGUGCAGUCUCU | 19 | 7855 |
| myoC-5480 | + | GUGCUAGCUGUGCAGUCUCU | 20 | 5226 |
| myoC-8110 | + | UGUGCUAGCUGUGCAGUCUCU | 21 | 7856 |
| myoC-8111 | + | UUGUGCUAGCUGUGCAGUCUCU | 22 | 7857 |
| myoC-8112 | + | CUUGUGCUAGCUGUGCAGUCUCU | 23 | 7858 |
| myoC-8113 | + | UCUUGUGCUAGCUGUGCAGUCUCU | 24 | 7859 |
| myoC-4531 | + | GAGCAGUGUCUCGGGUCU | 18 | 4277 |
| myoC-4532 | + | CGAGCAGUGUCUCGGGUCU | 19 | 4278 |
| myoC-204 | + | CCGAGCAGUGUCUCGGGUCU | 20 | 590 |
| myoC-4533 | + | CCCGAGCAGUGUCUCGGGUCU | 21 | 4279 |
| myoC-4534 | + | GCCCGAGCAGUGUCUCGGGUCU | 22 | 4280 |
| myoC-4535 | + | AGCCCGAGCAGUGUCUCGGGUCU | 23 | 4281 |
| myoC-4536 | + | CAGCCCGAGCAGUGUCUCGGGUCU | 24 | 4282 |
| myoC-4537 | + | UCUGCAUUCUUACCUUCU | 18 | 4283 |
| myoC-4538 | + | CUCUGCAUUCUUACCUUCU | 19 | 4284 |
| myoC-4539 | + | ACUCUGCAUUCUUACCUUCU | 20 | 4285 |
| myoC-4540 | + | CACUCUGCAUUCUUACCUUCU | 21 | 4286 |
| myoC-4541 | + | CCACUCUGCAUUCUUACCUUCU | 22 | 4287 |
| myoC-4542 | + | CCCACUCUGCAUUCUUACCUUCU | 23 | 4288 |
| myoC-4543 | + | CCCCACUCUGCAUUCUUACCUUCU | 24 | 4289 |
| myoC-8114 | + | AAUCUGGGGAACUCUUCU | 18 | 7860 |
| myoC-8115 | + | AAAUCUGGGGAACUCUUCU | 19 | 7861 |
| myoC-2296 | + | GAAAUCUGGGGAACUCUUCU | 20 | 2372 |
| myoC-8116 | + | UGAAAUCUGGGGAACUCUUCU | 21 | 7862 |
| myoC-8117 | + | GUGAAAUCUGGGGAACUCUUCU | 22 | 7863 |
| myoC-8118 | + | GGUGAAAUCUGGGGAACUCUUCU | 23 | 7864 |
| myoC-8119 | + | UGGUGAAAUCUGGGGAACUCUUCU | 24 | 7865 |
| myoC-8120 | + | GAGUCUGACGUGAUCAGU | 18 | 7866 |
| myoC-8121 | + | GGAGUCUGACGUGAUCAGU | 19 | 7867 |
| myoC-2229 | + | UGGAGUCUGACGUGAUCAGU | 20 | 2318 |
| myoC-8122 | + | CUGGAGUCUGACGUGAUCAGU | 21 | 7868 |
| myoC-8123 | + | CCUGGAGUCUGACGUGAUCAGU | 22 | 7869 |

TABLE 10G-continued

| 7th Tier | | | | |
|---|---|---|---|---|
| gRNA Name | DNA Strand | Targeting Domain | Target Site Length | Seq ID |
| myoC-8124 | + | UCCUGGAGUCUGACGUGAUCAGU | 23 | 7870 |
| myoC-8125 | + | GUCCUGGAGUCUGACGUGAUCAGU | 24 | 7871 |
| myoC-8126 | + | UAAAAUGUUAAAUUUAGU | 18 | 7872 |
| myoC-8127 | + | AUAAAAUGUUAAAUUUAGU | 19 | 7873 |
| myoC-2286 | + | AAUAAAAUGUUAAAUUUAGU | 20 | 2365 |
| myoC-8128 | + | GAAUAAAAUGUUAAAUUUAGU | 21 | 7874 |
| myoC-8129 | + | GGAAUAAAAUGUUAAAUUUAGU | 22 | 7875 |
| myoC-8130 | + | UGGAAUAAAAUGUUAAAUUUAGU | 23 | 7876 |
| myoC-8131 | + | AUGGAAUAAAAUGUUAAAUUUAGU | 24 | 7877 |
| myoC-4558 | + | CCGAGCAGUGUCUCGGGU | 18 | 4304 |
| myoC-4559 | + | CCCGAGCAGUGUCUCGGGU | 19 | 4305 |
| myoC-1699 | + | GCCCGAGCAGUGUCUCGGGU | 20 | 1951 |
| myoC-4560 | + | AGCCCGAGCAGUGUCUCGGGU | 21 | 4306 |
| myoC-4561 | + | CAGCCCGAGCAGUGUCUCGGGU | 22 | 4307 |
| myoC-4562 | + | ACAGCCCGAGCAGUGUCUCGGGU | 23 | 4308 |
| myoC-4563 | + | CACAGCCCGAGCAGUGUCUCGGGU | 24 | 4309 |
| myoC-8132 | + | UAAAUAUACCAAAACUGU | 18 | 7878 |
| myoC-8133 | + | AUAAAUAUACCAAAACUGU | 19 | 7879 |
| myoC-2282 | + | AAUAAAUAUACCAAAACUGU | 20 | 2361 |
| myoC-8134 | + | CAAUAAAUAUACCAAAACUGU | 21 | 7880 |
| myoC-8135 | + | CCAAUAAAUAUACCAAAACUGU | 22 | 7881 |
| myoC-8136 | + | GCCAAUAAAUAUACCAAAACUGU | 23 | 7882 |
| myoC-8137 | + | AGCCAAUAAAUAUACCAAAACUGU | 24 | 7883 |
| myoC-8138 | + | ACAACAGUGUCAAUACUU | 18 | 7884 |
| myoC-8139 | + | AACAACAGUGUCAAUACUU | 19 | 7885 |
| myoC-2279 | + | CAACAACAGUGUCAAUACUU | 20 | 2358 |
| myoC-8140 | + | CCAACAACAGUGUCAAUACUU | 21 | 7886 |
| myoC-8141 | + | ACCAACAACAGUGUCAAUACUU | 22 | 7887 |
| myoC-8142 | + | UACCAACAACAGUGUCAAUACUU | 23 | 7888 |
| myoC-8143 | + | AUACCAACAACAGUGUCAAUACUU | 24 | 7889 |
| myoC-8144 | + | AUGCCAUUGUCUAUGCUU | 18 | 7890 |
| myoC-8145 | + | AAUGCCAUUGUCUAUGCUU | 19 | 7891 |
| myoC-1073 | + | AAAUGCCAUUGUCUAUGCUU | 20 | 1373 |
| myoC-8146 | + | CAAAUGCCAUUGUCUAUGCUU | 21 | 7892 |
| myoC-8147 | + | GCAAAUGCCAUUGUCUAUGCUU | 22 | 7893 |
| myoC-8148 | + | GGCAAAUGCCAUUGUCUAUGCUU | 23 | 7894 |
| myoC-8149 | + | UGGCAAAUGCCAUUGUCUAUGCUU | 24 | 7895 |

TABLE 10G-continued

| 7th Tier | | | | |
|---|---|---|---|---|
| gRNA Name | DNA Strand | Targeting Domain | Target Site Length | Seq ID |
| myoC-8150 | + | AAAACAACUGUGUAUCUU | 18 | 7896 |
| myoC-8151 | + | UAAAACAACUGUGUAUCUU | 19 | 7897 |
| myoC-1220 | + | UUAAAACAACUGUGUAUCUU | 20 | 1520 |
| myoC-8152 | + | UUUAAAACAACUGUGUAUCUU | 21 | 7898 |
| myoC-8153 | + | CUUUAAAACAACUGUGUAUCUU | 22 | 7899 |
| myoC-8154 | + | GCUUUAAAACAACUGUGUAUCUU | 23 | 7900 |
| myoC-8155 | + | AGCUUUAAAACAACUGUGUAUCUU | 24 | 7901 |
| myoC-8156 | + | UUCAAAUUCACAGGCUUU | 18 | 7902 |
| myoC-8157 | + | AUUCAAAUUCACAGGCUUU | 19 | 7903 |
| myoC-2285 | + | CAUUCAAAUUCACAGGCUUU | 20 | 2364 |
| myoC-8158 | + | UCAUUCAAAUUCACAGGCUUU | 21 | 7904 |
| myoC-8159 | + | CUCAUUCAAAUUCACAGGCUUU | 22 | 7905 |
| myoC-8160 | + | CCUCAUUCAAAUUCACAGGCUUU | 23 | 7906 |
| myoC-8161 | + | UCCUCAUUCAAAUUCACAGGCUUU | 24 | 7907 |
| myoC-8162 | + | AAACAACUGUGUAUCUUU | 18 | 7908 |
| myoC-8163 | + | AAAACAACUGUGUAUCUUU | 19 | 7909 |
| myoC-1221 | + | UAAAACAACUGUGUAUCUUU | 20 | 1521 |
| myoC-8164 | + | UUAAAACAACUGUGUAUCUUU | 21 | 7910 |
| myoC-8165 | + | UUUAAAACAACUGUGUAUCUUU | 22 | 7911 |
| myoC-8166 | + | CUUUAAAACAACUGUGUAUCUUU | 23 | 7912 |
| myoC-8167 | + | GCUUUAAAACAACUGUGUAUCUUU | 24 | 7913 |
| myoC-8168 | - | UUGCCUGGCAUUCAAAAA | 18 | 7914 |
| myoC-8169 | - | UUUGCCUGGCAUUCAAAAA | 19 | 7915 |
| myoC-1971 | - | UUUUGCCUGGCAUUCAAAAA | 20 | 2129 |
| myoC-8170 | - | CUUUUGCCUGGCAUUCAAAAA | 21 | 7916 |
| myoC-8171 | - | GCUUUUGCCUGGCAUUCAAAAA | 22 | 7917 |
| myoC-8172 | - | AGCUUUUGCCUGGCAUUCAAAAA | 23 | 7918 |
| myoC-8173 | - | UAGCUUUUGCCUGGCAUUCAAAAA | 24 | 7919 |
| myoC-8174 | - | AGGGGAGGAGAAGAAAAA | 18 | 7920 |
| myoC-8175 | - | CAGGGGAGGAGAAGAAAAA | 19 | 7921 |
| myoC-1987 | - | GCAGGGGAGGAGAAGAAAAA | 20 | 2139 |
| myoC-8176 | - | CGCAGGGGAGGAGAAGAAAAA | 21 | 7922 |
| myoC-8177 | - | GCGCAGGGGAGGAGAAGAAAAA | 22 | 7923 |
| myoC-8178 | - | AGCGCAGGGGAGGAGAAGAAAAA | 23 | 7924 |
| myoC-8179 | - | CAGCGCAGGGGAGGAGAAGAAAAA | 24 | 7925 |
| myoC-8180 | - | UUCACAGUCCAUAGCAAA | 18 | 7926 |
| myoC-8181 | - | UUUCACAGUCCAUAGCAAA | 19 | 7927 |
| myoC-5447 | - | UUUUCACAGUCCAUAGCAAA | 20 | 5193 |

TABLE 10G-continued

| 7th Tier | | | | |
|---|---|---|---|---|
| gRNA Name | DNA Strand | Targeting Domain | Target Site Length | Seq ID |
| myoC-8182 | - | GUUUUCACAGUCCAUAGCAAA | 21 | 7928 |
| myoC-8183 | - | AGUUUUCACAGUCCAUAGCAAA | 22 | 7929 |
| myoC-8184 | - | CAGUUUUCACAGUCCAUAGCAAA | 23 | 7930 |
| myoC-8185 | - | UCAGUUUUCACAGUCCAUAGCAAA | 24 | 7931 |
| myoC-3441 | - | AGCGACUAAGGCAAGAAA | 18 | 3187 |
| myoC-3442 | - | AAGCGACUAAGGCAAGAAA | 19 | 3188 |
| myoC-1647 | - | GAAGCGACUAAGGCAAGAAA | 20 | 1913 |
| myoC-3443 | - | AGAAGCGACUAAGGCAAGAAA | 21 | 3189 |
| myoC-3444 | - | AAGAAGCGACUAAGGCAAGAAA | 22 | 3190 |
| myoC-3445 | - | GAAGAAGCGACUAAGGCAAGAAA | 23 | 3191 |
| myoC-3446 | - | AGAAGAAGCGACUAAGGCAAGAAA | 24 | 3192 |
| myoC-8186 | - | GCAGGGGAGGAGAAGAAA | 18 | 7932 |
| myoC-8187 | - | CGCAGGGGAGGAGAAGAAA | 19 | 7933 |
| myoC-1986 | - | GCGCAGGGGAGGAGAAGAAA | 20 | 2138 |
| myoC-8188 | - | AGCGCAGGGGAGGAGAAGAAA | 21 | 7934 |
| myoC-8189 | - | CAGCGCAGGGGAGGAGAAGAAA | 22 | 7935 |
| myoC-8190 | - | GCAGCGCAGGGGAGGAGAAGAAA | 23 | 7936 |
| myoC-8191 | - | UGCAGCGCAGGGGAGGAGAAGAAA | 24 | 7937 |
| myoC-8192 | - | UACUAUCUGAUUCAGAAA | 18 | 7938 |
| myoC-8193 | - | UUACUAUCUGAUUCAGAAA | 19 | 7939 |
| myoC-2028 | - | UUUACUAUCUGAUUCAGAAA | 20 | 2163 |
| myoC-8194 | - | GUUUACUAUCUGAUUCAGAAA | 21 | 7940 |
| myoC-8195 | - | UGUUUACUAUCUGAUUCAGAAA | 22 | 7941 |
| myoC-8196 | - | AUGUUUACUAUCUGAUUCAGAAA | 23 | 7942 |
| myoC-8197 | - | GAUGUUUACUAUCUGAUUCAGAAA | 24 | 7943 |
| myoC-8198 | - | UGAUUUUGUCAUUACCAA | 18 | 7944 |
| myoC-8199 | - | GUGAUUUUGUCAUUACCAA | 19 | 7945 |
| myoC-2050 | - | UGUGAUUUUGUCAUUACCAA | 20 | 2181 |
| myoC-8200 | - | CUGUGAUUUUGUCAUUACCAA | 21 | 7946 |
| myoC-8201 | - | CCUGUGAUUUUGUCAUUACCAA | 22 | 7947 |
| myoC-8202 | - | ACCUGUGAUUUUGUCAUUACCAA | 23 | 7948 |
| myoC-8203 | - | UACCUGUGAUUUUGUCAUUACCAA | 24 | 7949 |
| myoC-8204 | - | AAAACUGGGCCAGAGCAA | 18 | 7950 |
| myoC-8205 | - | AAAAACUGGGCCAGAGCAA | 19 | 7951 |
| myoC-1973 | - | CAAAAACUGGGCCAGAGCAA | 20 | 2131 |
| myoC-8206 | - | UCAAAAACUGGGCCAGAGCAA | 21 | 7952 |
| myoC-8207 | - | UUCAAAAACUGGGCCAGAGCAA | 22 | 7953 |

TABLE 10G-continued

| 7th Tier | | | | |
|---|---|---|---|---|
| gRNA Name | DNA Strand | Targeting Domain | Target Site Length | Seq ID |
| myoC-8208 | - | AUUCAAAAACUGGGCCAGAGCAA | 23 | 7954 |
| myoC-8209 | - | CAUUCAAAAACUGGGCCAGAGCAA | 24 | 7955 |
| myoC-8210 | - | UUUCACAGUCCAUAGCAA | 18 | 7956 |
| myoC-8211 | - | UUUUCACAGUCCAUAGCAA | 19 | 7957 |
| myoC-8212 | - | GUUUUCACAGUCCAUAGCAA | 20 | 7958 |
| myoC-8213 | - | AGUUUUCACAGUCCAUAGCAA | 21 | 7959 |
| myoC-8214 | - | CAGUUUUCACAGUCCAUAGCAA | 22 | 7960 |
| myoC-8215 | - | UCAGUUUUCACAGUCCAUAGCAA | 23 | 7961 |
| myoC-8216 | - | GUCAGUUUUCACAGUCCAUAGCAA | 24 | 7962 |
| myoC-8217 | - | GGGAAAAAAUCAGUUCAA | 18 | 7963 |
| myoC-8218 | - | GGGGAAAAAAUCAGUUCAA | 19 | 7964 |
| myoC-1142 | - | GGGGGAAAAAAUCAGUUCAA | 20 | 1442 |
| myoC-8219 | - | GGGGGGAAAAAAUCAGUUCAA | 21 | 7965 |
| myoC-8220 | - | UGGGGGGAAAAAAUCAGUUCAA | 22 | 7966 |
| myoC-8221 | - | GUGGGGGGAAAAAAUCAGUUCAA | 23 | 7967 |
| myoC-8222 | - | UGUGGGGGGAAAAAAUCAGUUCAA | 24 | 7968 |
| myoC-8223 | - | AUUUUAUUCCAUUGCGAA | 18 | 7969 |
| myoC-8224 | - | CAUUUUAUUCCAUUGCGAA | 19 | 7970 |
| myoC-2049 | - | ACAUUUUAUUCCAUUGCGAA | 20 | 2180 |
| myoC-8225 | - | AACAUUUUAUUCCAUUGCGAA | 21 | 7971 |
| myoC-8226 | - | UAACAUUUUAUUCCAUUGCGAA | 22 | 7972 |
| myoC-8227 | - | UUAACAUUUUAUUCCAUUGCGAA | 23 | 7973 |
| myoC-8228 | - | UUUAACAUUUUAUUCCAUUGCGAA | 24 | 7974 |
| myoC-8229 | - | UAGCAAAAGGAGAAAUAA | 18 | 7975 |
| myoC-8230 | - | AUAGCAAAAGGAGAAAUAA | 19 | 7976 |
| myoC-8231 | - | CAUAGCAAAAGGAGAAAUAA | 20 | 7977 |
| myoC-8232 | - | CCAUAGCAAAAGGAGAAAUAA | 21 | 7978 |
| myoC-8233 | - | UCCAUAGCAAAAGGAGAAAUAA | 22 | 7979 |
| myoC-8234 | - | GUCCAUAGCAAAAGGAGAAAUAA | 23 | 7980 |
| myoC-8235 | - | AGUCCAUAGCAAAAGGAGAAAUAA | 24 | 7981 |
| myoC-8236 | - | CAAGUCACAAGGUAGUAA | 18 | 7982 |
| myoC-8237 | - | GCAAGUCACAAGGUAGUAA | 19 | 7983 |
| myoC-2016 | - | AGCAAGUCACAAGGUAGUAA | 20 | 2154 |
| myoC-8238 | - | GAGCAAGUCACAAGGUAGUAA | 21 | 7984 |
| myoC-8239 | - | UGAGCAAGUCACAAGGUAGUAA | 22 | 7985 |
| myoC-8240 | - | CUGAGCAAGUCACAAGGUAGUAA | 23 | 7986 |
| myoC-8241 | - | UCUGAGCAAGUCACAAGGUAGUAA | 24 | 7987 |
| myoC-8242 | - | GUUGCAGAUACGUUGUAA | 18 | 7988 |

TABLE 10G-continued

| 7th Tier | | | | |
|---|---|---|---|---|
| gRNA Name | DNA Strand | Targeting Domain | Target Site Length | Seq ID |
| myoC-8243 | - | UGUUGCAGAUACGUUGUAA | 19 | 7989 |
| myoC-2051 | - | UUGUUGCAGAUACGUUGUAA | 20 | 2182 |
| myoC-8244 | - | GUUGUUGCAGAUACGUUGUAA | 21 | 7990 |
| myoC-8245 | - | AGUUGUUGCAGAUACGUUGUAA | 22 | 7991 |
| myoC-8246 | - | CAGUUGUUGCAGAUACGUUGUAA | 23 | 7992 |
| myoC-8247 | - | ACAGUUGUUGCAGAUACGUUGUAA | 24 | 7993 |
| myoC-8248 | - | CAAUCCCGUUUCUUUUAA | 18 | 7994 |
| myoC-8249 | - | GCAAUCCCGUUUCUUUUAA | 19 | 7995 |
| myoC-2022 | - | GGCAAUCCCGUUUCUUUUAA | 20 | 2158 |
| myoC-8250 | - | GGGCAAUCCCGUUUCUUUUAA | 21 | 7996 |
| myoC-8251 | - | AGGGCAAUCCCGUUUCUUUUAA | 22 | 7997 |
| myoC-8252 | - | AAGGGCAAUCCCGUUUCUUUUAA | 23 | 7998 |
| myoC-8253 | - | CAAGGGCAAUCCCGUUUCUUUUAA | 24 | 7999 |
| myoC-8254 | - | UGGAGCAGCUGAGCCACA | 18 | 8000 |
| myoC-8255 | - | CUGGAGCAGCUGAGCCACA | 19 | 8001 |
| myoC-1047 | - | GCUGGAGCAGCUGAGCCACA | 20 | 1347 |
| myoC-8256 | - | AGCUGGAGCAGCUGAGCCACA | 21 | 8002 |
| myoC-8257 | - | GAGCUGGAGCAGCUGAGCCACA | 22 | 8003 |
| myoC-8258 | - | AGAGCUGGAGCAGCUGAGCCACA | 23 | 8004 |
| myoC-8259 | - | CAGAGCUGGAGCAGCUGAGCCACA | 24 | 8005 |
| myoC-8260 | - | GUUCCCCAGAUUUCACCA | 18 | 8006 |
| myoC-8261 | - | AGUUCCCCAGAUUUCACCA | 19 | 8007 |
| myoC-2058 | - | GAGUUCCCCAGAUUUCACCA | 20 | 2189 |
| myoC-8262 | - | AGAGUUCCCCAGAUUUCACCA | 21 | 8008 |
| myoC-8263 | - | AAGAGUUCCCCAGAUUUCACCA | 22 | 8009 |
| myoC-8264 | - | GAAGAGUUCCCCAGAUUUCACCA | 23 | 8010 |
| myoC-8265 | - | AGAAGAGUUCCCCAGAUUUCACCA | 24 | 8011 |
| myoC-8266 | - | GGCAGUGGGAAUUGACCA | 18 | 8012 |
| myoC-8267 | - | GGGCAGUGGGAAUUGACCA | 19 | 8013 |
| myoC-1996 | - | AGGGCAGUGGGAAUUGACCA | 20 | 2145 |
| myoC-8268 | - | AAGGGCAGUGGGAAUUGACCA | 21 | 8014 |
| myoC-8269 | - | CAAGGGCAGUGGGAAUUGACCA | 22 | 8015 |
| myoC-8270 | - | UCAAGGGCAGUGGGAAUUGACCA | 23 | 8016 |
| myoC-8271 | - | UUCAAGGGCAGUGGGAAUUGACCA | 24 | 8017 |
| myoC-8272 | - | GCUGGAGCAGCUGAGCCA | 18 | 8018 |
| myoC-8273 | - | AGCUGGAGCAGCUGAGCCA | 19 | 8019 |
| myoC-1949 | - | GAGCUGGAGCAGCUGAGCCA | 20 | 2116 |

TABLE 10G-continued

| 7th Tier | | | | |
|---|---|---|---|---|
| gRNA Name | DNA Strand | Targeting Domain | Target Site Length | Seq ID |
| myoC-8274 | - | AGAGCUGGAGCAGCUGAGCCA | 21 | 8020 |
| myoC-8275 | - | CAGAGCUGGAGCAGCUGAGCCA | 22 | 8021 |
| myoC-8276 | - | GCAGAGCUGGAGCAGCUGAGCCA | 23 | 8022 |
| myoC-8277 | - | GGCAGAGCUGGAGCAGCUGAGCCA | 24 | 8023 |
| myoC-4656 | - | CUGUGCCACCAGGCUCCA | 18 | 4402 |
| myoC-4657 | - | GCUGUGCCACCAGGCUCCA | 19 | 4403 |
| myoC-1662 | - | GGCUGUGCCACCAGGCUCCA | 20 | 1924 |
| myoC-4658 | - | GGGCUGUGCCACCAGGCUCCA | 21 | 4404 |
| myoC-4659 | - | CGGGCUGUGCCACCAGGCUCCA | 22 | 4405 |
| myoC-4660 | - | UCGGGCUGUGCCACCAGGCUCCA | 23 | 4406 |
| myoC-4661 | - | CUCGGGCUGUGCCACCAGGCUCCA | 24 | 4407 |
| myoC-8278 | - | GGAGUGACCUGCAGCGCA | 18 | 8024 |
| myoC-8279 | - | CGGAGUGACCUGCAGCGCA | 19 | 8025 |
| myoC-1119 | - | ACGGAGUGACCUGCAGCGCA | 20 | 1419 |
| myoC-8280 | - | CACGGAGUGACCUGCAGCGCA | 21 | 8026 |
| myoC-8281 | - | GCACGGAGUGACCUGCAGCGCA | 22 | 8027 |
| myoC-8282 | - | AGCACGGAGUGACCUGCAGCGCA | 23 | 8028 |
| myoC-8283 | - | CAGCACGGAGUGACCUGCAGCGCA | 24 | 8029 |
| myoC-8284 | - | CAGAUUCAUUCAAGGGCA | 18 | 8030 |
| myoC-8285 | - | ACAGAUUCAUUCAAGGGCA | 19 | 8031 |
| myoC-1993 | - | GACAGAUUCAUUCAAGGGCA | 20 | 2144 |
| myoC-8286 | - | AGACAGAUUCAUUCAAGGGCA | 21 | 8032 |
| myoC-8287 | - | AAGACAGAUUCAUUCAAGGGCA | 22 | 8033 |
| myoC-8288 | - | AAAGACAGAUUCAUUCAAGGGCA | 23 | 8034 |
| myoC-8289 | - | GAAAGACAGAUUCAUUCAAGGGCA | 24 | 8035 |
| myoC-8290 | - | AUGCUUCAGGAAAGCUCA | 18 | 8036 |
| myoC-8291 | - | AAUGCUUCAGGAAAGCUCA | 19 | 8037 |
| myoC-1968 | - | CAAUGCUUCAGGAAAGCUCA | 20 | 2126 |
| myoC-8292 | - | ACAAUGCUUCAGGAAAGCUCA | 21 | 8038 |
| myoC-8293 | - | CACAAUGCUUCAGGAAAGCUCA | 22 | 8039 |
| myoC-8294 | - | CCACAAUGCUUCAGGAAAGCUCA | 23 | 8040 |
| myoC-8295 | - | GCCACAAUGCUUCAGGAAAGCUCA | 24 | 8041 |
| myoC-8296 | - | GGGGAAAAAAUCAGUUCA | 18 | 8042 |
| myoC-8297 | - | GGGGGAAAAAAUCAGUUCA | 19 | 8043 |
| myoC-1141 | - | GGGGGGAAAAAAUCAGUUCA | 20 | 1441 |
| myoC-8298 | - | UGGGGGGAAAAAAUCAGUUCA | 21 | 8044 |
| myoC-8299 | - | GUGGGGGGAAAAAAUCAGUUCA | 22 | 8045 |
| myoC-8300 | - | UGUGGGGGGAAAAAAUCAGUUCA | 23 | 8046 |

TABLE 10G-continued

| 7th Tier | | | | |
|---|---|---|---|---|
| gRNA Name | DNA Strand | Targeting Domain | Target Site Length | Seq ID |
| myoC-8301 | - | UUGUGGGGGGAAAAAAUCAGUUCA | 24 | 8047 |
| myoC-8302 | - | GGGAGGAGAAGAAAAAGA | 18 | 8048 |
| myoC-8303 | - | GGGGAGGAGAAGAAAAAGA | 19 | 8049 |
| myoC-1988 | - | AGGGGAGGAGAAGAAAAAGA | 20 | 2140 |
| myoC-8304 | - | CAGGGGAGGAGAAGAAAAAGA | 21 | 8050 |
| myoC-8305 | - | GCAGGGGAGGAGAAGAAAAAGA | 22 | 8051 |
| myoC-8306 | - | CGCAGGGGAGGAGAAGAAAAAGA | 23 | 8052 |
| myoC-8307 | - | GCGCAGGGGAGGAGAAGAAAAAGA | 24 | 8053 |
| myoC-8308 | - | GGUGCCUGAGAUGCAAGA | 18 | 8054 |
| myoC-8309 | - | UGGUGCCUGAGAUGCAAGA | 19 | 8055 |
| myoC-2063 | - | UUGGUGCCUGAGAUGCAAGA | 20 | 2194 |
| myoC-8310 | - | AUUGGUGCCUGAGAUGCAAGA | 21 | 8056 |
| myoC-8311 | - | CAUUGGUGCCUGAGAUGCAAGA | 22 | 8057 |
| myoC-8312 | - | ACAUUGGUGCCUGAGAUGCAAGA | 23 | 8058 |
| myoC-8313 | - | GACAUUGGUGCCUGAGAUGCAAGA | 24 | 8059 |
| myoC-4668 | - | AGAAGGUAAGAAUGCAGA | 18 | 4414 |
| myoC-4669 | - | GAGAAGGUAAGAAUGCAGA | 19 | 4415 |
| myoC-4670 | - | AGAGAAGGUAAGAAUGCAGA | 20 | 4416 |
| myoC-4671 | - | CAGAGAAGGUAAGAAUGCAGA | 21 | 4417 |
| myoC-4672 | - | CCAGAGAAGGUAAGAAUGCAGA | 22 | 4418 |
| myoC-4673 | - | UCCAGAGAAGGUAAGAAUGCAGA | 23 | 4419 |
| myoC-4674 | - | CUCCAGAGAAGGUAAGAAUGCAGA | 24 | 4420 |
| myoC-4681 | - | GAGGUAGCAAGGCUGAGA | 18 | 4427 |
| myoC-4682 | - | GGAGGUAGCAAGGCUGAGA | 19 | 4428 |
| myoC-198 | - | AGGAGGUAGCAAGGCUGAGA | 20 | 584 |
| myoC-4683 | - | CAGGAGGUAGCAAGGCUGAGA | 21 | 4429 |
| myoC-4684 | - | CCAGGAGGUAGCAAGGCUGAGA | 22 | 4430 |
| myoC-4685 | - | GCCAGGAGGUAGCAAGGCUGAGA | 23 | 4431 |
| myoC-4686 | - | AGCCAGGAGGUAGCAAGGCUGAGA | 24 | 4432 |
| myoC-8314 | - | UGAGGGGGGAUGUUGAGA | 18 | 8060 |
| myoC-8315 | - | GUGAGGGGGGAUGUUGAGA | 19 | 8061 |
| myoC-1041 | - | UGUGAGGGGGGAUGUUGAGA | 20 | 1341 |
| myoC-8316 | - | CUGUGAGGGGGGAUGUUGAGA | 21 | 8062 |
| myoC-8317 | - | UCUGUGAGGGGGGAUGUUGAGA | 22 | 8063 |
| myoC-8318 | - | CUCUGUGAGGGGGGAUGUUGAGA | 23 | 8064 |
| myoC-8319 | - | UCUCUGUGAGGGGGGAUGUUGAGA | 24 | 8065 |
| myoC-8320 | - | UCACGUCAGACUCCAGGA | 18 | 8066 |

TABLE 10G-continued

| 7th Tier | | | | |
|---|---|---|---|---|
| gRNA Name | DNA Strand | Targeting Domain | Target Site Length | Seq ID |
| myoC-8321 | − | AUCACGUCAGACUCCAGGA | 19 | 8067 |
| myoC-1964 | − | GAUCACGUCAGACUCCAGGA | 20 | 2123 |
| myoC-8322 | − | UGAUCACGUCAGACUCCAGGA | 21 | 8068 |
| myoC-8323 | − | CUGAUCACGUCAGACUCCAGGA | 22 | 8069 |
| myoC-8324 | − | ACUGAUCACGUCAGACUCCAGGA | 23 | 8070 |
| myoC-8325 | − | CACUGAUCACGUCAGACUCCAGGA | 24 | 8071 |
| myoC-8326 | − | GGGGAUGUUGAGAGGGGA | 18 | 8072 |
| myoC-8327 | − | GGGGGAUGUUGAGAGGGGA | 19 | 8073 |
| myoC-1043 | − | GGGGGGAUGUUGAGAGGGGA | 20 | 1343 |
| myoC-8328 | − | AGGGGGGAUGUUGAGAGGGGA | 21 | 8074 |
| myoC-8329 | − | GAGGGGGGAUGUUGAGAGGGGA | 22 | 8075 |
| myoC-8330 | − | UGAGGGGGGAUGUUGAGAGGGGA | 23 | 8076 |
| myoC-8331 | − | GUGAGGGGGGAUGUUGAGAGGGGA | 24 | 8077 |
| myoC-8332 | − | AGGGGAGGUGGAGGGGGA | 18 | 8078 |
| myoC-8333 | − | CAGGGGAGGUGGAGGGGGA | 19 | 8079 |
| myoC-1959 | − | ACAGGGGAGGUGGAGGGGGA | 20 | 2119 |
| myoC-8334 | − | CACAGGGGAGGUGGAGGGGGA | 21 | 8080 |
| myoC-8335 | − | CCACAGGGGAGGUGGAGGGGGA | 22 | 8081 |
| myoC-8336 | − | GCCACAGGGGAGGUGGAGGGGGA | 23 | 8082 |
| myoC-8337 | − | AGCCACAGGGGAGGUGGAGGGGGA | 24 | 8083 |
| myoC-8338 | − | AGCCACAGGGGAGGUGGA | 18 | 8084 |
| myoC-8339 | − | GAGCCACAGGGGAGGUGGA | 19 | 8085 |
| myoC-1052 | − | UGAGCCACAGGGGAGGUGGA | 20 | 1352 |
| myoC-8340 | − | CUGAGCCACAGGGGAGGUGGA | 21 | 8086 |
| myoC-8341 | − | GCUGAGCCACAGGGGAGGUGGA | 22 | 8087 |
| myoC-8342 | − | AGCUGAGCCACAGGGGAGGUGGA | 23 | 8088 |
| myoC-8343 | − | CAGCUGAGCCACAGGGGAGGUGGA | 24 | 8089 |
| myoC-8344 | − | UUUUAAAGCUAGGGGUGA | 18 | 8090 |
| myoC-8345 | − | GUUUUAAAGCUAGGGGUGA | 19 | 8091 |
| myoC-2070 | − | UGUUUUAAAGCUAGGGGUGA | 20 | 2201 |
| myoC-8346 | − | UUGUUUUAAAGCUAGGGGUGA | 21 | 8092 |
| myoC-8347 | − | GUUGUUUUAAAGCUAGGGGUGA | 22 | 8093 |
| myoC-8348 | − | AGUUGUUUUAAAGCUAGGGGUGA | 23 | 8094 |
| myoC-8349 | − | CAGUUGUUUUAAAGCUAGGGGUGA | 24 | 8095 |
| myoC-8350 | − | CCCUGUGAUUCUCUGUGA | 18 | 8096 |
| myoC-8351 | − | UCCCUGUGAUUCUCUGUGA | 19 | 8097 |
| myoC-1036 | − | UUCCCUGUGAUUCUCUGUGA | 20 | 1336 |
| myoC-8352 | − | CUUCCCUGUGAUUCUCUGUGA | 21 | 8098 |

TABLE 10G-continued

| 7th Tier | | | | |
|---|---|---|---|---|
| gRNA Name | DNA Strand | Targeting Domain | Target Site Length | Seq ID |
| myoC-8353 | - | ACUUCCCUGUGAUUCUCUGUGA | 22 | 8099 |
| myoC-8354 | - | CACUUCCCUGUGAUUCUCUGUGA | 23 | 8100 |
| myoC-8355 | - | ACACUUCCCUGUGAUUCUCUGUGA | 24 | 8101 |
| myoC-8356 | - | UGUGAGGGGGGAUGUUGA | 18 | 8102 |
| myoC-8357 | - | CUGUGAGGGGGGAUGUUGA | 19 | 8103 |
| myoC-1939 | - | UCUGUGAGGGGGGAUGUUGA | 20 | 2111 |
| myoC-8358 | - | CUCUGUGAGGGGGGAUGUUGA | 21 | 8104 |
| myoC-8359 | - | UCUCUGUGAGGGGGGAUGUUGA | 22 | 8105 |
| myoC-8360 | - | UUCUCUGUGAGGGGGGAUGUUGA | 23 | 8106 |
| myoC-8361 | - | AUUCUCUGUGAGGGGGGAUGUUGA | 24 | 8107 |
| myoC-8362 | - | GAAAGCCUGUGAAUUUGA | 18 | 8108 |
| myoC-8363 | - | AGAAAGCCUGUGAAUUUGA | 19 | 8109 |
| myoC-2045 | - | CAGAAAGCCUGUGAAUUUGA | 20 | 2177 |
| myoC-8364 | - | CCAGAAAGCCUGUGAAUUUGA | 21 | 8110 |
| myoC-8365 | - | UCCAGAAAGCCUGUGAAUUUGA | 22 | 8111 |
| myoC-8366 | - | GUCCAGAAAGCCUGUGAAUUUGA | 23 | 8112 |
| myoC-8367 | - | AGUCCAGAAAGCCUGUGAAUUUGA | 24 | 8113 |
| myoC-8368 | - | GGAAAUCUGCCGCUUCUA | 18 | 8114 |
| myoC-8369 | - | GGGAAAUCUGCCGCUUCUA | 19 | 8115 |
| myoC-2074 | - | GGGGAAAUCUGCCGCUUCUA | 20 | 2205 |
| myoC-8370 | - | GGGGGAAAUCUGCCGCUUCUA | 21 | 8116 |
| myoC-8371 | - | GGGGGGAAAUCUGCCGCUUCUA | 22 | 8117 |
| myoC-8372 | - | AGGGGGGAAAUCUGCCGCUUCUA | 23 | 8118 |
| myoC-8373 | - | GAGGGGGGAAAUCUGCCGCUUCUA | 24 | 8119 |
| myoC-8374 | - | CACAAGACAGAUGAAUUA | 18 | 8120 |
| myoC-8375 | - | GCACAAGACAGAUGAAUUA | 19 | 8121 |
| myoC-5461 | - | AGCACAAGACAGAUGAAUUA | 20 | 5207 |
| myoC-8376 | - | UAGCACAAGACAGAUGAAUUA | 21 | 8122 |
| myoC-8377 | - | CUAGCACAAGACAGAUGAAUUA | 22 | 8123 |
| myoC-8378 | - | GCUAGCACAAGACAGAUGAAUUA | 23 | 8124 |
| myoC-8379 | - | AGCUAGCACAAGACAGAUGAAUUA | 24 | 8125 |
| myoC-8380 | - | AAUCCCGUUUCUUUUAAC | 18 | 8126 |
| myoC-8381 | - | CAAUCCCGUUUCUUUUAAC | 19 | 8127 |
| myoC-1151 | - | GCAAUCCCGUUUCUUUUAAC | 20 | 1451 |
| myoC-8382 | - | GGCAAUCCCGUUUCUUUUAAC | 21 | 8128 |
| myoC-8383 | - | GGGCAAUCCCGUUUCUUUUAAC | 22 | 8129 |
| myoC-8384 | - | AGGGCAAUCCCGUUUCUUUUAAC | 23 | 8130 |

TABLE 10G-continued

| 7th Tier | | | | |
|---|---|---|---|---|
| gRNA Name | DNA Strand | Targeting Domain | Target Site Length | Seq ID |
| myoC-8385 | - | AAGGGCAAUCCCGUUUCUUUUAAC | 24 | 8131 |
| myoC-8386 | - | CUGGAGCAGCUGAGCCAC | 18 | 8132 |
| myoC-8387 | - | GCUGGAGCAGCUGAGCCAC | 19 | 8133 |
| myoC-1046 | - | AGCUGGAGCAGCUGAGCCAC | 20 | 1346 |
| myoC-8388 | - | GAGCUGGAGCAGCUGAGCCAC | 21 | 8134 |
| myoC-8389 | - | AGAGCUGGAGCAGCUGAGCCAC | 22 | 8135 |
| myoC-8390 | - | CAGAGCUGGAGCAGCUGAGCCAC | 23 | 8136 |
| myoC-8391 | - | GCAGAGCUGGAGCAGCUGAGCCAC | 24 | 8137 |
| myoC-8392 | - | CUGUGGAGUUAGCAGCAC | 18 | 8138 |
| myoC-8393 | - | UCUGUGGAGUUAGCAGCAC | 19 | 8139 |
| myoC-2021 | - | CUCUGUGGAGUUAGCAGCAC | 20 | 2157 |
| myoC-8394 | - | UCUCUGUGGAGUUAGCAGCAC | 21 | 8140 |
| myoC-8395 | - | UUCUCUGUGGAGUUAGCAGCAC | 22 | 8141 |
| myoC-8396 | - | UUUCUCUGUGGAGUUAGCAGCAC | 23 | 8142 |
| myoC-8397 | - | UUUUCUCUGUGGAGUUAGCAGCAC | 24 | 8143 |
| myoC-4765 | - | GGGCCAGUGUCCCCAGAC | 18 | 4511 |
| myoC-4766 | - | GGGGCCAGUGUCCCCAGAC | 19 | 4512 |
| myoC-1659 | - | AGGGGCCAGUGUCCCCAGAC | 20 | 1921 |
| myoC-4767 | - | AAGGGGCCAGUGUCCCCAGAC | 21 | 4513 |
| myoC-4768 | - | GAAGGGGCCAGUGUCCCCAGAC | 22 | 4514 |
| myoC-4769 | - | AGAAGGGGCCAGUGUCCCCAGAC | 23 | 4515 |
| myoC-4770 | - | GAGAAGGGGCCAGUGUCCCCAGAC | 24 | 4516 |
| myoC-8398 | - | GGGGAGGUGGAGGGGGAC | 18 | 8144 |
| myoC-8399 | - | AGGGGAGGUGGAGGGGGAC | 19 | 8145 |
| myoC-1055 | - | CAGGGGAGGUGGAGGGGGAC | 20 | 1355 |
| myoC-8400 | - | ACAGGGGAGGUGGAGGGGGAC | 21 | 8146 |
| myoC-8401 | - | CACAGGGGAGGUGGAGGGGGAC | 22 | 8147 |
| myoC-8402 | - | CCACAGGGGAGGUGGAGGGGGAC | 23 | 8148 |
| myoC-8403 | - | GCCACAGGGGAGGUGGAGGGGGAC | 24 | 8149 |
| myoC-8404 | - | GCAAGACGGUCGAAAACC | 18 | 8150 |
| myoC-8405 | - | UGCAAGACGGUCGAAAACC | 19 | 8151 |
| myoC-1924 | - | AUGCAAGACGGUCGAAAACC | 20 | 2102 |
| myoC-8406 | - | UAUGCAAGACGGUCGAAAACC | 21 | 8152 |
| myoC-8407 | - | UUAUGCAAGACGGUCGAAAACC | 22 | 8153 |
| myoC-8408 | - | CUUAUGCAAGACGGUCGAAAACC | 23 | 8154 |
| myoC-8409 | - | GCUUAUGCAAGACGGUCGAAAACC | 24 | 8155 |
| myoC-8410 | - | UUGGUUGGCUGUGCGACC | 18 | 8156 |
| myoC-8411 | - | AUUGGUUGGCUGUGCGACC | 19 | 8157 |

TABLE 10G-continued

| 7th Tier | | | | |
|---|---|---|---|---|
| gRNA Name | DNA Strand | Targeting Domain | Target Site Length | Seq ID |
| myoC-1928 | - | CAUUGGUUGGCUGUGCGACC | 20 | 2104 |
| myoC-8412 | - | CCAUUGGUUGGCUGUGCGACC | 21 | 8158 |
| myoC-8413 | - | GCCAUUGGUUGGCUGUGCGACC | 22 | 8159 |
| myoC-8414 | - | UGCCAUUGGUUGGCUGUGCGACC | 23 | 8160 |
| myoC-8415 | - | CUGCCAUUGGUUGGCUGUGCGACC | 24 | 8161 |
| myoC-8416 | - | ACGUCAGACUCCAGGACC | 18 | 8162 |
| myoC-8417 | - | CACGUCAGACUCCAGGACC | 19 | 8163 |
| myoC-1965 | - | UCACGUCAGACUCCAGGACC | 20 | 2124 |
| myoC-8418 | - | AUCACGUCAGACUCCAGGACC | 21 | 8164 |
| myoC-8419 | - | GAUCACGUCAGACUCCAGGACC | 22 | 8165 |
| myoC-8420 | - | UGAUCACGUCAGACUCCAGGACC | 23 | 8166 |
| myoC-8421 | - | CUGAUCACGUCAGACUCCAGGACC | 24 | 8167 |
| myoC-8422 | - | CUAUAGGAAUGCUCUCCC | 18 | 8168 |
| myoC-8423 | - | UCUAUAGGAAUGCUCUCCC | 19 | 8169 |
| myoC-1211 | - | UUCUAUAGGAAUGCUCUCCC | 20 | 1511 |
| myoC-8424 | - | CUUCUAUAGGAAUGCUCUCCC | 21 | 8170 |
| myoC-8425 | - | GCUUCUAUAGGAAUGCUCUCCC | 22 | 8171 |
| myoC-8426 | - | CGCUUCUAUAGGAAUGCUCUCCC | 23 | 8172 |
| myoC-8427 | - | CCGCUUCUAUAGGAAUGCUCUCCC | 24 | 8173 |
| myoC-3549 | - | GGUUGGAAAGCAGCAGCC | 18 | 3295 |
| myoC-3550 | - | AGGUUGGAAAGCAGCAGCC | 19 | 3296 |
| myoC-107 | - | GAGGUUGGAAAGCAGCAGCC | 20 | 511 |
| myoC-3551 | - | GGAGGUUGGAAAGCAGCAGCC | 21 | 3297 |
| myoC-3552 | - | AGGAGGUUGGAAAGCAGCAGCC | 22 | 3298 |
| myoC-3553 | - | CAGGAGGUUGGAAAGCAGCAGCC | 23 | 3299 |
| myoC-3554 | - | CCAGGAGGUUGGAAAGCAGCAGCC | 24 | 3300 |
| myoC-3555 | - | GAAAAUGAGAAUCUGGCC | 18 | 3301 |
| myoC-3556 | - | AGAAAAUGAGAAUCUGGCC | 19 | 3302 |
| myoC-195 | - | AAGAAAAUGAGAAUCUGGCC | 20 | 581 |
| myoC-3557 | - | CAAGAAAAUGAGAAUCUGGCC | 21 | 3303 |
| myoC-3558 | - | GCAAGAAAAUGAGAAUCUGGCC | 22 | 3304 |
| myoC-3559 | - | GGCAAGAAAAUGAGAAUCUGGCC | 23 | 3305 |
| myoC-3560 | - | AGGCAAGAAAAUGAGAAUCUGGCC | 24 | 3306 |
| myoC-8428 | - | UCUAUAGGAAUGCUCUCC | 18 | 8174 |
| myoC-8429 | - | UUCUAUAGGAAUGCUCUCC | 19 | 8175 |
| myoC-2076 | - | CUUCUAUAGGAAUGCUCUCC | 20 | 2206 |
| myoC-8430 | - | GCUUCUAUAGGAAUGCUCUCC | 21 | 8176 |

TABLE 10G-continued

| 7th Tier | | | | |
|---|---|---|---|---|
| gRNA Name | DNA Strand | Targeting Domain | Target Site Length | Seq ID |
| myoC-8431 | - | CGCUUCUAUAGGAAUGCUCUCC | 22 | 8177 |
| myoC-8432 | - | CCGCUUCUAUAGGAAUGCUCUCC | 23 | 8178 |
| myoC-8433 | - | GCCGCUUCUAUAGGAAUGCUCUCC | 24 | 8179 |
| myoC-8434 | - | CCUGCCUGCCCUUUCUCC | 18 | 8180 |
| myoC-8435 | - | CCCUGCCUGCCCUUUCUCC | 19 | 8181 |
| myoC-8436 | - | UCCCUGCCUGCCCUUUCUCC | 20 | 8182 |
| myoC-8437 | - | CUCCCUGCCUGCCCUUUCUCC | 21 | 8183 |
| myoC-8438 | - | CCUCCCUGCCUGCCCUUUCUCC | 22 | 8184 |
| myoC-8439 | - | GCCUCCCUGCCUGCCCUUUCUCC | 23 | 8185 |
| myoC-8440 | - | GGCCUCCCUGCCUGCCCUUUCUCC | 24 | 8186 |
| myoC-8441 | - | GCAAGUGUCUCUCCUUCC | 18 | 8187 |
| myoC-8442 | - | GGCAAGUGUCUCUCCUUCC | 19 | 8188 |
| myoC-1929 | - | GGGCAAGUGUCUCUCCUUCC | 20 | 2105 |
| myoC-8443 | - | UGGGCAAGUGUCUCUCCUUCC | 21 | 8189 |
| myoC-8444 | - | GUGGGCAAGUGUCUCUCCUUCC | 22 | 8190 |
| myoC-8445 | - | CGUGGGCAAGUGUCUCUCCUUCC | 23 | 8191 |
| myoC-8446 | - | CCGUGGGCAAGUGUCUCUCCUUCC | 24 | 8192 |
| myoC-8447 | - | ACACAGUUGUUUUAAAGC | 18 | 8193 |
| myoC-8448 | - | UACACAGUUGUUUUAAAGC | 19 | 8194 |
| myoC-2065 | - | AUACACAGUUGUUUUAAAGC | 20 | 2196 |
| myoC-8449 | - | GAUACACAGUUGUUUUAAAGC | 21 | 8195 |
| myoC-8450 | - | AGAUACACAGUUGUUUUAAAGC | 22 | 8196 |
| myoC-8451 | - | AAGAUACACAGUUGUUUUAAAGC | 23 | 8197 |
| myoC-8452 | - | AAAGAUACACAGUUGUUUUAAAGC | 24 | 8198 |
| myoC-8453 | - | GCAGUGACUGCUGACAGC | 18 | 8199 |
| myoC-8454 | - | AGCAGUGACUGCUGACAGC | 19 | 8200 |
| myoC-1976 | - | CAGCAGUGACUGCUGACAGC | 20 | 2133 |
| myoC-8455 | - | UCAGCAGUGACUGCUGACAGC | 21 | 8201 |
| myoC-8456 | - | CUCAGCAGUGACUGCUGACAGC | 22 | 8202 |
| myoC-8457 | - | GCUCAGCAGUGACUGCUGACAGC | 23 | 8203 |
| myoC-8458 | - | AGCUCAGCAGUGACUGCUGACAGC | 24 | 8204 |
| myoC-3579 | - | AGGUUGGAAAGCAGCAGC | 18 | 3325 |
| myoC-3580 | - | GAGGUUGGAAAGCAGCAGC | 19 | 3326 |
| myoC-1653 | - | GGAGGUUGGAAAGCAGCAGC | 20 | 1917 |
| myoC-3581 | - | AGGAGGUUGGAAAGCAGCAGC | 21 | 3327 |
| myoC-3582 | - | CAGGAGGUUGGAAAGCAGCAGC | 22 | 3328 |
| myoC-3583 | - | CCAGGAGGUUGGAAAGCAGCAGC | 23 | 3329 |
| myoC-3584 | - | GCCAGGAGGUUGGAAAGCAGCAGC | 24 | 3330 |

TABLE 10G-continued

| 7th Tier | | | | |
|---|---|---|---|---|
| gRNA Name | DNA Strand | Targeting Domain | Target Site Length | Seq ID |
| myoC-8459 | - | AGGGGAAGGAGGCAGAGC | 18 | 8205 |
| myoC-8460 | - | GAGGGGAAGGAGGCAGAGC | 19 | 8206 |
| myoC-1045 | - | AGAGGGGAAGGAGGCAGAGC | 20 | 1345 |
| myoC-8461 | - | GAGAGGGGAAGGAGGCAGAGC | 21 | 8207 |
| myoC-8462 | - | UGAGAGGGGAAGGAGGCAGAGC | 22 | 8208 |
| myoC-8463 | - | UUGAGAGGGGAAGGAGGCAGAGC | 23 | 8209 |
| myoC-8464 | - | GUUGAGAGGGGAAGGAGGCAGAGC | 24 | 8210 |
| myoC-8465 | - | GAGGGAUAGUGUAUGAGC | 18 | 8211 |
| myoC-8466 | - | AGAGGGAUAGUGUAUGAGC | 19 | 8212 |
| myoC-1991 | - | GAGAGGGAUAGUGUAUGAGC | 20 | 2142 |
| myoC-8467 | - | AGAGAGGGAUAGUGUAUGAGC | 21 | 8213 |
| myoC-8468 | - | AAGAGAGGGAUAGUGUAUGAGC | 22 | 8214 |
| myoC-8469 | - | AAAGAGAGGGAUAGUGUAUGAGC | 23 | 8215 |
| myoC-8470 | - | AAAAGAGAGGGAUAGUGUAUGAGC | 24 | 8216 |
| myoC-8471 | - | CGGAGUGACCUGCAGCGC | 18 | 8217 |
| myoC-8472 | - | ACGGAGUGACCUGCAGCGC | 19 | 8218 |
| myoC-1118 | - | CACGGAGUGACCUGCAGCGC | 20 | 1418 |
| myoC-8473 | - | GCACGGAGUGACCUGCAGCGC | 21 | 8219 |
| myoC-8474 | - | AGCACGGAGUGACCUGCAGCGC | 22 | 8220 |
| myoC-8475 | - | CAGCACGGAGUGACCUGCAGCGC | 23 | 8221 |
| myoC-8476 | - | ACAGCACGGAGUGACCUGCAGCGC | 24 | 8222 |
| myoC-3585 | - | AGAAGAAGCGACUAAGGC | 18 | 3331 |
| myoC-3586 | - | GAGAAGAAGCGACUAAGGC | 19 | 3332 |
| myoC-1646 | - | AGAGAAGAAGCGACUAAGGC | 20 | 1912 |
| myoC-3587 | - | AAGAGAAGAAGCGACUAAGGC | 21 | 3333 |
| myoC-3588 | - | GAAGAGAAGAAGCGACUAAGGC | 22 | 3334 |
| myoC-3589 | - | GGAAGAGAAGAAGCGACUAAGGC | 23 | 3335 |
| myoC-3590 | - | AGGAAGAGAAGAAGCGACUAAGGC | 24 | 3336 |
| myoC-8477 | - | GGCAUUCAAAAACUGGGC | 18 | 8223 |
| myoC-8478 | - | UGGCAUUCAAAAACUGGGC | 19 | 8224 |
| myoC-1972 | - | CUGGCAUUCAAAAACUGGGC | 20 | 2130 |
| myoC-8479 | - | CCUGGCAUUCAAAAACUGGGC | 21 | 8225 |
| myoC-8480 | - | GCCUGGCAUUCAAAAACUGGGC | 22 | 8226 |
| myoC-8481 | - | UGCCUGGCAUUCAAAAACUGGGC | 23 | 8227 |
| myoC-8482 | - | UUGCCUGGCAUUCAAAAACUGGGC | 24 | 8228 |
| myoC-3609 | - | AGAAAAUGAGAAUCUGGC | 18 | 3355 |
| myoC-3610 | - | AAGAAAAUGAGAAUCUGGC | 19 | 3356 |

TABLE 10G-continued

| 7th Tier | | | | |
|---|---|---|---|---|
| gRNA Name | DNA Strand | Targeting Domain | Target Site Length | Seq ID |
| myoC-1649 | – | CAAGAAAAUGAGAAUCUGGC | 20 | 1915 |
| myoC-3611 | – | GCAAGAAAAUGAGAAUCUGGC | 21 | 3357 |
| myoC-3612 | – | GGCAAGAAAAUGAGAAUCUGGC | 22 | 3358 |
| myoC-3613 | – | AGGCAAGAAAAUGAGAAUCUGGC | 23 | 3359 |
| myoC-3614 | – | AAGGCAAGAAAAUGAGAAUCUGGC | 24 | 3360 |
| myoC-8483 | – | AGAGCAAGUGGAAAAUGC | 18 | 8229 |
| myoC-8484 | – | CAGAGCAAGUGGAAAAUGC | 19 | 8230 |
| myoC-1975 | – | CCAGAGCAAGUGGAAAAUGC | 20 | 2132 |
| myoC-8485 | – | GCCAGAGCAAGUGGAAAAUGC | 21 | 8231 |
| myoC-8486 | – | GGCCAGAGCAAGUGGAAAAUGC | 22 | 8232 |
| myoC-8487 | – | GGGCCAGAGCAAGUGGAAAAUGC | 23 | 8233 |
| myoC-8488 | – | UGGGCCAGAGCAAGUGGAAAAUGC | 24 | 8234 |
| myoC-4878 | – | CCAGACCCGAGACACUGC | 18 | 4624 |
| myoC-4879 | – | CCCAGACCCGAGACACUGC | 19 | 4625 |
| myoC-1660 | – | CCCCAGACCCGAGACACUGC | 20 | 1922 |
| myoC-4880 | – | UCCCCAGACCCGAGACACUGC | 21 | 4626 |
| myoC-4881 | – | GUCCCCAGACCCGAGACACUGC | 22 | 4627 |
| myoC-4882 | – | UGUCCCCAGACCCGAGACACUGC | 23 | 4628 |
| myoC-4883 | – | GUGUCCCCAGACCCGAGACACUGC | 24 | 4629 |
| myoC-8489 | – | CUCUGGAGGUGAGUCUGC | 18 | 8235 |
| myoC-8490 | – | ACUCUGGAGGUGAGUCUGC | 19 | 8236 |
| myoC-2036 | – | CACUCUGGAGGUGAGUCUGC | 20 | 2170 |
| myoC-8491 | – | CCACUCUGGAGGUGAGUCUGC | 21 | 8237 |
| myoC-8492 | – | UCCACUCUGGAGGUGAGUCUGC | 22 | 8238 |
| myoC-8493 | – | CUCCACUCUGGAGGUGAGUCUGC | 23 | 8239 |
| myoC-8494 | – | UCUCCACUCUGGAGGUGAGUCUGC | 24 | 8240 |
| myoC-8495 | – | UAACAUUGACAUUGGUGC | 18 | 8241 |
| myoC-8496 | – | CUAACAUUGACAUUGGUGC | 19 | 8242 |
| myoC-2062 | – | GCUAACAUUGACAUUGGUGC | 20 | 2193 |
| myoC-8497 | – | GGCUAACAUUGACAUUGGUGC | 21 | 8243 |
| myoC-8498 | – | AGGCUAACAUUGACAUUGGUGC | 22 | 8244 |
| myoC-8499 | – | GAGGCUAACAUUGACAUUGGUGC | 23 | 8245 |
| myoC-8500 | – | AGAGGCUAACAUUGACAUUGGUGC | 24 | 8246 |
| myoC-8501 | – | GUCGAAAACCUUGGAAUC | 18 | 8247 |
| myoC-8502 | – | GGUCGAAAACCUUGGAAUC | 19 | 8248 |
| myoC-1026 | – | CGGUCGAAAACCUUGGAAUC | 20 | 1326 |
| myoC-8503 | – | ACGGUCGAAAACCUUGGAAUC | 21 | 8249 |
| myoC-8504 | – | GACGGUCGAAAACCUUGGAAUC | 22 | 8250 |

TABLE 10G-continued

| 7th Tier | | | | |
|---|---|---|---|---|
| gRNA Name | DNA Strand | Targeting Domain | Target Site Length | Seq ID |
| myoC-8505 | - | AGACGGUCGAAAACCUUGGAAUC | 23 | 8251 |
| myoC-8506 | - | AAGACGGUCGAAAACCUUGGAAUC | 24 | 8252 |
| myoC-8507 | - | AACUGUGUUUCUCCACUC | 18 | 8253 |
| myoC-8508 | - | AAACUGUGUUUCUCCACUC | 19 | 8254 |
| myoC-1156 | - | CAAACUGUGUUUCUCCACUC | 20 | 1456 |
| myoC-8509 | - | GCAAACUGUGUUUCUCCACUC | 21 | 8255 |
| myoC-8510 | - | AGCAAACUGUGUUUCUCCACUC | 22 | 8256 |
| myoC-8511 | - | GAGCAAACUGUGUUUCUCCACUC | 23 | 8257 |
| myoC-8512 | - | AGAGCAAACUGUGUUUCUCCACUC | 24 | 8258 |
| myoC-8513 | - | ACUGAUCACGUCAGACUC | 18 | 8259 |
| myoC-8514 | - | CACUGAUCACGUCAGACUC | 19 | 8260 |
| myoC-1963 | - | UCACUGAUCACGUCAGACUC | 20 | 2122 |
| myoC-8515 | - | CUCACUGAUCACGUCAGACUC | 21 | 8261 |
| myoC-8516 | - | CCUCACUGAUCACGUCAGACUC | 22 | 8262 |
| myoC-8517 | - | UCCUCACUGAUCACGUCAGACUC | 23 | 8263 |
| myoC-8518 | - | GUCCUCACUGAUCACGUCAGACUC | 24 | 8264 |
| myoC-8519 | - | UUACUAGUAAUUUAGCUC | 18 | 8265 |
| myoC-8520 | - | AUUACUAGUAAUUUAGCUC | 19 | 8266 |
| myoC-8521 | - | UAUUACUAGUAAUUUAGCUC | 20 | 8267 |
| myoC-8522 | - | GUAUUACUAGUAAUUUAGCUC | 21 | 8268 |
| myoC-8523 | - | AGUAUUACUAGUAAUUUAGCUC | 22 | 8269 |
| myoC-8524 | - | AAGUAUUACUAGUAAUUUAGCUC | 23 | 8270 |
| myoC-8525 | - | CAAGUAUUACUAGUAAUUUAGCUC | 24 | 8271 |
| myoC-4908 | - | GGCUGUGCCACCAGGCUC | 18 | 4654 |
| myoC-4909 | - | GGGCUGUGCCACCAGGCUC | 19 | 4655 |
| myoC-1661 | - | CGGGCUGUGCCACCAGGCUC | 20 | 1923 |
| myoC-4910 | - | UCGGGCUGUGCCACCAGGCUC | 21 | 4656 |
| myoC-4911 | - | CUCGGGCUGUGCCACCAGGCUC | 22 | 4657 |
| myoC-4912 | - | GCUCGGGCUGUGCCACCAGGCUC | 23 | 4658 |
| myoC-4913 | - | UGCUCGGGCUGUGCCACCAGGCUC | 24 | 4659 |
| myoC-8526 | - | AUCAGUUCAAGGGAAGUC | 18 | 8272 |
| myoC-8527 | - | AAUCAGUUCAAGGGAAGUC | 19 | 8273 |
| myoC-1144 | - | AAAUCAGUUCAAGGGAAGUC | 20 | 1444 |
| myoC-8528 | - | AAAAUCAGUUCAAGGGAAGUC | 21 | 8274 |
| myoC-8529 | - | AAAAAUCAGUUCAAGGGAAGUC | 22 | 8275 |
| myoC-8530 | - | AAAAAAUCAGUUCAAGGGAAGUC | 23 | 8276 |
| myoC-8531 | - | GAAAAAAUCAGUUCAAGGGAAGUC | 24 | 8277 |

TABLE 10G-continued

| 7th Tier | | | | |
|---|---|---|---|---|
| gRNA Name | DNA Strand | Targeting Domain | Target Site Length | Seq ID |
| myoC-8532 | - | GAUUAUUAACCUACAGUC | 18 | 8278 |
| myoC-8533 | - | GGAUUAUUAACCUACAGUC | 19 | 8279 |
| myoC-2042 | - | GGGAUUAUUAACCUACAGUC | 20 | 2174 |
| myoC-8534 | - | AGGGAUUAUUAACCUACAGUC | 21 | 8280 |
| myoC-8535 | - | CAGGGAUUAUUAACCUACAGUC | 22 | 8281 |
| myoC-8536 | - | GCAGGGAUUAUUAACCUACAGUC | 23 | 8282 |
| myoC-8537 | - | AGCAGGGAUUAUUAACCUACAGUC | 24 | 8283 |
| myoC-8538 | - | AGAAAGACAGAUUCAUUC | 18 | 8284 |
| myoC-8539 | - | AAGAAAGACAGAUUCAUUC | 19 | 8285 |
| myoC-1992 | - | CAAGAAAGACAGAUUCAUUC | 20 | 2143 |
| myoC-8540 | - | GCAAGAAAGACAGAUUCAUUC | 21 | 8286 |
| myoC-8541 | - | AGCAAGAAAGACAGAUUCAUUC | 22 | 8287 |
| myoC-8542 | - | GAGCAAGAAAGACAGAUUCAUUC | 23 | 8288 |
| myoC-8543 | - | UGAGCAAGAAAGACAGAUUCAUUC | 24 | 8289 |
| myoC-8544 | - | CGAGAGCCACAAUGCUUC | 18 | 8290 |
| myoC-8545 | - | CCGAGAGCCACAAUGCUUC | 19 | 8291 |
| myoC-1061 | - | ACCGAGAGCCACAAUGCUUC | 20 | 1361 |
| myoC-8546 | - | GACCGAGAGCCACAAUGCUUC | 21 | 8292 |
| myoC-8547 | - | GGACCGAGAGCCACAAUGCUUC | 22 | 8293 |
| myoC-8548 | - | AGGACCGAGAGCCACAAUGCUUC | 23 | 8294 |
| myoC-8549 | - | CAGGACCGAGAGCCACAAUGCUUC | 24 | 8295 |
| myoC-8550 | - | GGGGGAAAAAAUCAGUUC | 18 | 8296 |
| myoC-8551 | - | GGGGGGAAAAAAUCAGUUC | 19 | 8297 |
| myoC-2008 | - | UGGGGGGAAAAAAUCAGUUC | 20 | 2150 |
| myoC-8552 | - | GUGGGGGGAAAAAAUCAGUUC | 21 | 8298 |
| myoC-8553 | - | UGUGGGGGGAAAAAAUCAGUUC | 22 | 8299 |
| myoC-8554 | - | UUGUGGGGGGAAAAAAUCAGUUC | 23 | 8300 |
| myoC-8555 | - | AUUGUGGGGGGAAAAAAUCAGUUC | 24 | 8301 |
| myoC-8556 | - | CCACGUGAUCCUGGGUUC | 18 | 8302 |
| myoC-8557 | - | UCCACGUGAUCCUGGGUUC | 19 | 8303 |
| myoC-1999 | - | GUCCACGUGAUCCUGGGUUC | 20 | 2147 |
| myoC-8558 | - | AGUCCACGUGAUCCUGGGUUC | 21 | 8304 |
| myoC-8559 | - | UAGUCCACGUGAUCCUGGGUUC | 22 | 8305 |
| myoC-8560 | - | AUAGUCCACGUGAUCCUGGGUUC | 23 | 8306 |
| myoC-8561 | - | UAUAGUCCACGUGAUCCUGGGUUC | 24 | 8307 |
| myoC-8562 | - | CACAGUCCAUAGCAAAAG | 18 | 8308 |
| myoC-8563 | - | UCACAGUCCAUAGCAAAAG | 19 | 8309 |
| myoC-8564 | - | UUCACAGUCCAUAGCAAAAG | 20 | 8310 |

TABLE 10G-continued

| 7th Tier | | | | |
|---|---|---|---|---|
| gRNA Name | DNA Strand | Targeting Domain | Target Site Length | Seq ID |
| myoC-8565 | - | UUUCACAGUCCAUAGCAAAAG | 21 | 8311 |
| myoC-8566 | - | UUUUCACAGUCCAUAGCAAAAG | 22 | 8312 |
| myoC-8567 | - | GUUUUCACAGUCCAUAGCAAAAG | 23 | 8313 |
| myoC-8568 | - | AGUUUUCACAGUCCAUAGCAAAAG | 24 | 8314 |
| myoC-8569 | - | GGGUUUAUUAAUGUAAAG | 18 | 8315 |
| myoC-8570 | - | UGGGUUUAUUAAUGUAAAG | 19 | 8316 |
| myoC-2040 | - | UUGGGUUUAUUAAUGUAAAG | 20 | 2173 |
| myoC-8571 | - | UUUGGGUUUAUUAAUGUAAAG | 21 | 8317 |
| myoC-8572 | - | CUUUGGGUUUAUUAAUGUAAAG | 22 | 8318 |
| myoC-8573 | - | UCUUUGGGUUUAUUAAUGUAAAG | 23 | 8319 |
| myoC-8574 | - | CUCUUUGGGUUUAUUAAUGUAAAG | 24 | 8320 |
| myoC-8575 | - | AAACUGGGCCAGAGCAAG | 18 | 8321 |
| myoC-8576 | - | AAAACUGGGCCAGAGCAAG | 19 | 8322 |
| myoC-1068 | - | AAAAACUGGGCCAGAGCAAG | 20 | 1368 |
| myoC-8577 | - | CAAAAACUGGGCCAGAGCAAG | 21 | 8323 |
| myoC-8578 | - | UCAAAAACUGGGCCAGAGCAAG | 22 | 8324 |
| myoC-8579 | - | UUCAAAAACUGGGCCAGAGCAAG | 23 | 8325 |
| myoC-8580 | - | AUUCAAAAACUGGGCCAGAGCAAG | 24 | 8326 |
| myoC-8581 | - | AAAUCAGUUCAAGGGAAG | 18 | 8327 |
| myoC-8582 | - | AAAAUCAGUUCAAGGGAAG | 19 | 8328 |
| myoC-2011 | - | AAAAAUCAGUUCAAGGGAAG | 20 | 2151 |
| myoC-8583 | - | AAAAAAUCAGUUCAAGGGAAG | 21 | 8329 |
| myoC-8584 | - | GAAAAAAUCAGUUCAAGGGAAG | 22 | 8330 |
| myoC-8585 | - | GGAAAAAAUCAGUUCAAGGGAAG | 23 | 8331 |
| myoC-8586 | - | GGGAAAAAAUCAGUUCAAGGGAAG | 24 | 8332 |
| myoC-8587 | - | GGAGCAGCUGAGCCACAG | 18 | 8333 |
| myoC-8588 | - | UGGAGCAGCUGAGCCACAG | 19 | 8334 |
| myoC-1048 | - | CUGGAGCAGCUGAGCCACAG | 20 | 1348 |
| myoC-8589 | - | GCUGGAGCAGCUGAGCCACAG | 21 | 8335 |
| myoC-8590 | - | AGCUGGAGCAGCUGAGCCACAG | 22 | 8336 |
| myoC-8591 | - | GAGCUGGAGCAGCUGAGCCACAG | 23 | 8337 |
| myoC-8592 | - | AGAGCUGGAGCAGCUGAGCCACAG | 24 | 8338 |
| myoC-8593 | - | GAGGCAGAGCUGGAGCAG | 18 | 8339 |
| myoC-8594 | - | GGAGGCAGAGCUGGAGCAG | 19 | 8340 |
| myoC-1948 | - | AGGAGGCAGAGCUGGAGCAG | 20 | 2115 |
| myoC-8595 | - | AAGGAGGCAGAGCUGGAGCAG | 21 | 8341 |
| myoC-8596 | - | GAAGGAGGCAGAGCUGGAGCAG | 22 | 8342 |

TABLE 10G-continued

| 7th Tier | | | | |
|---|---|---|---|---|
| gRNA Name | DNA Strand | Targeting Domain | Target Site Length | Seq ID |
| myoC-8597 | - | GGAAGGAGGCAGAGCUGGAGCAG | 23 | 8343 |
| myoC-8598 | - | GGGAAGGAGGCAGAGCUGGAGCAG | 24 | 8344 |
| myoC-8599 | - | GUGUCUGCAUAUGAGCAG | 18 | 8345 |
| myoC-8600 | - | UGUGUCUGCAUAUGAGCAG | 19 | 8346 |
| myoC-8601 | - | AUGUGUCUGCAUAUGAGCAG | 20 | 8347 |
| myoC-8602 | - | GAUGUGUCUGCAUAUGAGCAG | 21 | 8348 |
| myoC-8603 | - | AGAUGUGUCUGCAUAUGAGCAG | 22 | 8349 |
| myoC-8604 | - | GAGAUGUGUCUGCAUAUGAGCAG | 23 | 8350 |
| myoC-8605 | - | UGAGAUGUGUCUGCAUAUGAGCAG | 24 | 8351 |
| myoC-8606 | - | GAGUGACCUGCAGCGCAG | 18 | 8352 |
| myoC-8607 | - | GGAGUGACCUGCAGCGCAG | 19 | 8353 |
| myoC-1120 | - | CGGAGUGACCUGCAGCGCAG | 20 | 1420 |
| myoC-8608 | - | ACGGAGUGACCUGCAGCGCAG | 21 | 8354 |
| myoC-8609 | - | CACGGAGUGACCUGCAGCGCAG | 22 | 8355 |
| myoC-8610 | - | GCACGGAGUGACCUGCAGCGCAG | 23 | 8356 |
| myoC-8611 | - | AGCACGGAGUGACCUGCAGCGCAG | 24 | 8357 |
| myoC-8612 | - | AGAUUCAUUCAAGGGCAG | 18 | 8358 |
| myoC-8613 | - | CAGAUUCAUUCAAGGGCAG | 19 | 8359 |
| myoC-1126 | - | ACAGAUUCAUUCAAGGGCAG | 20 | 1426 |
| myoC-8614 | - | GACAGAUUCAUUCAAGGGCAG | 21 | 8360 |
| myoC-8615 | - | AGACAGAUUCAUUCAAGGGCAG | 22 | 8361 |
| myoC-8616 | - | AAGACAGAUUCAUUCAAGGGCAG | 23 | 8362 |
| myoC-8617 | - | AAAGACAGAUUCAUUCAAGGGCAG | 24 | 8363 |
| myoC-8618 | - | GAGGGGAAGGAGGCAGAG | 18 | 8364 |
| myoC-8619 | - | AGAGGGGAAGGAGGCAGAG | 19 | 8365 |
| myoC-1946 | - | GAGAGGGGAAGGAGGCAGAG | 20 | 2114 |
| myoC-8620 | - | UGAGAGGGGAAGGAGGCAGAG | 21 | 8366 |
| myoC-8621 | - | UUGAGAGGGGAAGGAGGCAGAG | 22 | 8367 |
| myoC-8622 | - | GUUGAGAGGGGAAGGAGGCAGAG | 23 | 8368 |
| myoC-8623 | - | UGUUGAGAGGGGAAGGAGGCAGAG | 24 | 8369 |
| myoC-4980 | - | GAAGGUAAGAAUGCAGAG | 18 | 4726 |
| myoC-4981 | - | AGAAGGUAAGAAUGCAGAG | 19 | 4727 |
| myoC-3185 | - | GAGAAGGUAAGAAUGCAGAG | 20 | 2931 |
| myoC-4982 | - | AGAGAAGGUAAGAAUGCAGAG | 21 | 4728 |
| myoC-4983 | - | CAGAGAAGGUAAGAAUGCAGAG | 22 | 4729 |
| myoC-4984 | - | CCAGAGAAGGUAAGAAUGCAGAG | 23 | 4730 |
| myoC-4985 | - | UCCAGAGAAGGUAAGAAUGCAGAG | 24 | 4731 |
| myoC-8624 | - | GAGGGGGGAUGUUGAGAG | 18 | 8370 |

TABLE 10G-continued

| 7th Tier | | | | |
|---|---|---|---|---|
| gRNA Name | DNA Strand | Targeting Domain | Target Site Length | Seq ID |
| myoC-8625 | - | UGAGGGGGGAUGUUGAGAG | 19 | 8371 |
| myoC-1042 | - | GUGAGGGGGGAUGUUGAGAG | 20 | 1342 |
| myoC-8626 | - | UGUGAGGGGGGAUGUUGAGAG | 21 | 8372 |
| myoC-8627 | - | CUGUGAGGGGGGAUGUUGAGAG | 22 | 8373 |
| myoC-8628 | - | UCUGUGAGGGGGGAUGUUGAGAG | 23 | 8374 |
| myoC-8629 | - | CUCUGUGAGGGGGGAUGUUGAGAG | 24 | 8375 |
| myoC-8630 | - | UGCAGCGCAGGGGAGGAG | 18 | 8376 |
| myoC-8631 | - | CUGCAGCGCAGGGGAGGAG | 19 | 8377 |
| myoC-1985 | - | CCUGCAGCGCAGGGGAGGAG | 20 | 2137 |
| myoC-8632 | - | ACCUGCAGCGCAGGGGAGGAG | 21 | 8378 |
| myoC-8633 | - | GACCUGCAGCGCAGGGGAGGAG | 22 | 8379 |
| myoC-8634 | - | UGACCUGCAGCGCAGGGGAGGAG | 23 | 8380 |
| myoC-8635 | - | GUGACCUGCAGCGCAGGGGAGGAG | 24 | 8381 |
| myoC-8636 | - | AGCUGAGCCACAGGGGAG | 18 | 8382 |
| myoC-8637 | - | CAGCUGAGCCACAGGGGAG | 19 | 8383 |
| myoC-1953 | - | GCAGCUGAGCCACAGGGGAG | 20 | 2117 |
| myoC-8638 | - | AGCAGCUGAGCCACAGGGGAG | 21 | 8384 |
| myoC-8639 | - | GAGCAGCUGAGCCACAGGGGAG | 22 | 8385 |
| myoC-8640 | - | GGAGCAGCUGAGCCACAGGGGAG | 23 | 8386 |
| myoC-8641 | - | UGGAGCAGCUGAGCCACAGGGGAG | 24 | 8387 |
| myoC-8642 | - | ACCUGCAGCGCAGGGGAG | 18 | 8388 |
| myoC-8643 | - | GACCUGCAGCGCAGGGGAG | 19 | 8389 |
| myoC-1984 | - | UGACCUGCAGCGCAGGGGAG | 20 | 2136 |
| myoC-8644 | - | GUGACCUGCAGCGCAGGGGAG | 21 | 8390 |
| myoC-8645 | - | AGUGACCUGCAGCGCAGGGGAG | 22 | 8391 |
| myoC-8646 | - | GAGUGACCUGCAGCGCAGGGGAG | 23 | 8392 |
| myoC-8647 | - | GGAGUGACCUGCAGCGCAGGGGAG | 24 | 8393 |
| myoC-8648 | - | GCCACAGGGGAGGUGGAG | 18 | 8394 |
| myoC-8649 | - | AGCCACAGGGGAGGUGGAG | 19 | 8395 |
| myoC-1053 | - | GAGCCACAGGGGAGGUGGAG | 20 | 1353 |
| myoC-8650 | - | UGAGCCACAGGGGAGGUGGAG | 21 | 8396 |
| myoC-8651 | - | CUGAGCCACAGGGGAGGUGGAG | 22 | 8397 |
| myoC-8652 | - | GCUGAGCCACAGGGGAGGUGGAG | 23 | 8398 |
| myoC-8653 | - | AGCUGAGCCACAGGGGAGGUGGAG | 24 | 8399 |
| myoC-5004 | - | GGAGGUAGCAAGGCUGAG | 18 | 4750 |
| myoC-5005 | - | AGGAGGUAGCAAGGCUGAG | 19 | 4751 |
| myoC-1657 | - | CAGGAGGUAGCAAGGCUGAG | 20 | 1920 |

TABLE 10G-continued

7th Tier

| gRNA Name | DNA Strand | Targeting Domain | Target Site Length | Seq ID |
|---|---|---|---|---|
| myoC-5006 | - | CCAGGAGGUAGCAAGGCUGAG | 21 | 4752 |
| myoC-5007 | - | GCCAGGAGGUAGCAAGGCUGAG | 22 | 4753 |
| myoC-5008 | - | AGCCAGGAGGUAGCAAGGCUGAG | 23 | 4754 |
| myoC-5009 | - | CAGCCAGGAGGUAGCAAGGCUGAG | 24 | 4755 |
| myoC-8654 | - | UUUAAAGCUAGGGGUGAG | 18 | 8400 |
| myoC-8655 | - | UUUUAAAGCUAGGGGUGAG | 19 | 8401 |
| myoC-2071 | - | GUUUUAAAGCUAGGGGUGAG | 20 | 2202 |
| myoC-8656 | - | UGUUUUAAAGCUAGGGGUGAG | 21 | 8402 |
| myoC-8657 | - | UUGUUUUAAAGCUAGGGGUGAG | 22 | 8403 |
| myoC-8658 | - | GUUGUUUUAAAGCUAGGGGUGAG | 23 | 8404 |
| myoC-8659 | - | AGUUGUUUUAAAGCUAGGGGUGAG | 24 | 8405 |
| myoC-8660 | - | CCUGUGAUUCUCUGUGAG | 18 | 8406 |
| myoC-8661 | - | CCCUGUGAUUCUCUGUGAG | 19 | 8407 |
| myoC-1037 | - | UCCCUGUGAUUCUCUGUGAG | 20 | 1337 |
| myoC-8662 | - | UUCCCUGUGAUUCUCUGUGAG | 21 | 8408 |
| myoC-8663 | - | CUUCCCUGUGAUUCUCUGUGAG | 22 | 8409 |
| myoC-8664 | - | ACUUCCCUGUGAUUCUCUGUGAG | 23 | 8410 |
| myoC-8665 | - | CACUUCCCUGUGAUUCUCUGUGAG | 24 | 8411 |
| myoC-8666 | - | GUGAGGGGGGAUGUUGAG | 18 | 8412 |
| myoC-8667 | - | UGUGAGGGGGGAUGUUGAG | 19 | 8413 |
| myoC-1040 | - | CUGUGAGGGGGGAUGUUGAG | 20 | 1340 |
| myoC-8668 | - | UCUGUGAGGGGGGAUGUUGAG | 21 | 8414 |
| myoC-8669 | - | CUCUGUGAGGGGGGAUGUUGAG | 22 | 8415 |
| myoC-8670 | - | UCUCUGUGAGGGGGGAUGUUGAG | 23 | 8416 |
| myoC-8671 | - | UUCUCUGUGAGGGGGGAUGUUGAG | 24 | 8417 |
| myoC-8672 | - | ACGGAGUGACCUGCAGCG | 18 | 8418 |
| myoC-8673 | - | CACGGAGUGACCUGCAGCG | 19 | 8419 |
| myoC-1978 | - | GCACGGAGUGACCUGCAGCG | 20 | 2134 |
| myoC-8674 | - | AGCACGGAGUGACCUGCAGCG | 21 | 8420 |
| myoC-8675 | - | CAGCACGGAGUGACCUGCAGCG | 22 | 8421 |
| myoC-8676 | - | ACAGCACGGAGUGACCUGCAGCG | 23 | 8422 |
| myoC-8677 | - | GACAGCACGGAGUGACCUGCAGCG | 24 | 8423 |
| myoC-5048 | - | AGCCAGGAGGUAGCAAGG | 18 | 4794 |
| myoC-5049 | - | CAGCCAGGAGGUAGCAAGG | 19 | 4795 |
| myoC-1655 | - | GCAGCCAGGAGGUAGCAAGG | 20 | 1918 |
| myoC-5050 | - | AGCAGCCAGGAGGUAGCAAGG | 21 | 4796 |
| myoC-5051 | - | CAGCAGCCAGGAGGUAGCAAGG | 22 | 4797 |
| myoC-5052 | - | GCAGCAGCCAGGAGGUAGCAAGG | 23 | 4798 |

TABLE 10G-continued

| 7th Tier | | | | |
|---|---|---|---|---|
| gRNA Name | DNA Strand | Targeting Domain | Target Site Length | Seq ID |
| myoC-5053 | – | AGCAGCAGCCAGGAGGUAGCAAGG | 24 | 4799 |
| myoC-8678 | – | CCCGUUUCUUUUAACAGG | 18 | 8424 |
| myoC-8679 | – | UCCCGUUUCUUUUAACAGG | 19 | 8425 |
| myoC-2024 | – | AUCCCGUUUCUUUUAACAGG | 20 | 2159 |
| myoC-8680 | – | AAUCCCGUUUCUUUUAACAGG | 21 | 8426 |
| myoC-8681 | – | CAAUCCCGUUUCUUUUAACAGG | 22 | 8427 |
| myoC-8682 | – | GCAAUCCCGUUUCUUUUAACAGG | 23 | 8428 |
| myoC-8683 | – | GGCAAUCCCGUUUCUUUUAACAGG | 24 | 8429 |
| myoC-8684 | – | GGGGGACAGGAAGGCAGG | 18 | 8430 |
| myoC-8685 | – | AGGGGGACAGGAAGGCAGG | 19 | 8431 |
| myoC-1961 | – | GAGGGGGACAGGAAGGCAGG | 20 | 2120 |
| myoC-8686 | – | GGAGGGGGACAGGAAGGCAGG | 21 | 8432 |
| myoC-8687 | – | UGGAGGGGGACAGGAAGGCAGG | 22 | 8433 |
| myoC-8688 | – | GUGGAGGGGGACAGGAAGGCAGG | 23 | 8434 |
| myoC-8689 | – | GGUGGAGGGGGACAGGAAGGCAGG | 24 | 8435 |
| myoC-8690 | – | GUUGAGAGGGGAAGGAGG | 18 | 8436 |
| myoC-8691 | – | UGUUGAGAGGGGAAGGAGG | 19 | 8437 |
| myoC-1945 | – | AUGUUGAGAGGGGAAGGAGG | 20 | 2113 |
| myoC-8692 | – | GAUGUUGAGAGGGGAAGGAGG | 21 | 8438 |
| myoC-8693 | – | GGAUGUUGAGAGGGGAAGGAGG | 22 | 8439 |
| myoC-8694 | – | GGGAUGUUGAGAGGGGAAGGAGG | 23 | 8440 |
| myoC-8695 | – | GGGGAUGUUGAGAGGGGAAGGAGG | 24 | 8441 |
| myoC-3687 | – | GAGAAUCUGGCCAGGAGG | 18 | 3433 |
| myoC-3688 | – | UGAGAAUCUGGCCAGGAGG | 19 | 3434 |
| myoC-1651 | – | AUGAGAAUCUGGCCAGGAGG | 20 | 1916 |
| myoC-3689 | – | AAUGAGAAUCUGGCCAGGAGG | 21 | 3435 |
| myoC-3690 | – | AAAUGAGAAUCUGGCCAGGAGG | 22 | 3436 |
| myoC-3691 | – | AAAAUGAGAAUCUGGCCAGGAGG | 23 | 3437 |
| myoC-3692 | – | GAAAAUGAGAAUCUGGCCAGGAGG | 24 | 3438 |
| myoC-8696 | – | AUCCUGGGUUCUAGGAGG | 18 | 8442 |
| myoC-8697 | – | GAUCCUGGGUUCUAGGAGG | 19 | 8443 |
| myoC-2001 | – | UGAUCCUGGGUUCUAGGAGG | 20 | 2148 |
| myoC-8698 | – | GUGAUCCUGGGUUCUAGGAGG | 21 | 8444 |
| myoC-8699 | – | CGUGAUCCUGGGUUCUAGGAGG | 22 | 8445 |
| myoC-8700 | – | ACGUGAUCCUGGGUUCUAGGAGG | 23 | 8446 |
| myoC-8701 | – | CACGUGAUCCUGGGUUCUAGGAGG | 24 | 8447 |
| myoC-8702 | – | GCUGAGCCACAGGGGAGG | 18 | 8448 |

TABLE 10G-continued

| 7th Tier | | | | |
|---|---|---|---|---|
| gRNA Name | DNA Strand | Targeting Domain | Target Site Length | Seq ID |
| myoC-8703 | − | AGCUGAGCCACAGGGGAGG | 19 | 8449 |
| myoC-1050 | − | CAGCUGAGCCACAGGGGAGG | 20 | 1350 |
| myoC-8704 | − | GCAGCUGAGCCACAGGGGAGG | 21 | 8450 |
| myoC-8705 | − | AGCAGCUGAGCCACAGGGGAGG | 22 | 8451 |
| myoC-8706 | − | GAGCAGCUGAGCCACAGGGGAGG | 23 | 8452 |
| myoC-8707 | − | GGAGCAGCUGAGCCACAGGGGAGG | 24 | 8453 |
| myoC-8708 | − | UUAAAGCUAGGGGUGAGG | 18 | 8454 |
| myoC-8709 | − | UUUAAAGCUAGGGGUGAGG | 19 | 8455 |
| myoC-2072 | − | UUUUAAAGCUAGGGGUGAGG | 20 | 2203 |
| myoC-8710 | − | GUUUUAAAGCUAGGGGUGAGG | 21 | 8456 |
| myoC-8711 | − | UGUUUUAAAGCUAGGGGUGAGG | 22 | 8457 |
| myoC-8712 | − | UUGUUUUAAAGCUAGGGGUGAGG | 23 | 8458 |
| myoC-8713 | − | GUUGUUUUAAAGCUAGGGGUGAGG | 24 | 8459 |
| myoC-8714 | − | UUGGCUUAUGCAAGACGG | 18 | 8460 |
| myoC-8715 | − | CUUGGCUUAUGCAAGACGG | 19 | 8461 |
| myoC-1923 | − | ACUUGGCUUAUGCAAGACGG | 20 | 2101 |
| myoC-8716 | − | GACUUGGCUUAUGCAAGACGG | 21 | 8462 |
| myoC-8717 | − | GGACUUGGCUUAUGCAAGACGG | 22 | 8463 |
| myoC-8718 | − | UGGACUUGGCUUAUGCAAGACGG | 23 | 8464 |
| myoC-8719 | − | GUGGACUUGGCUUAUGCAAGACGG | 24 | 8465 |
| myoC-8720 | − | GAGAAAUAAAAGGACCGG | 18 | 8466 |
| myoC-8721 | − | GGAGAAAUAAAAGGACCGG | 19 | 8467 |
| myoC-8722 | − | AGGAGAAAUAAAAGGACCGG | 20 | 8468 |
| myoC-8723 | − | AAGGAGAAAUAAAAGGACCGG | 21 | 8469 |
| myoC-8724 | − | AAAGGAGAAAUAAAAGGACCGG | 22 | 8470 |
| myoC-8725 | − | AAAAGGAGAAAUAAAAGGACCGG | 23 | 8471 |
| myoC-8726 | − | CAAAAGGAGAAAUAAAAGGACCGG | 24 | 8472 |
| myoC-8727 | − | GUGACCUGCAGCGCAGGG | 18 | 8473 |
| myoC-8728 | − | AGUGACCUGCAGCGCAGGG | 19 | 8474 |
| myoC-1982 | − | GAGUGACCUGCAGCGCAGGG | 20 | 2135 |
| myoC-8729 | − | GGAGUGACCUGCAGCGCAGGG | 21 | 8475 |
| myoC-8730 | − | CGGAGUGACCUGCAGCGCAGGG | 22 | 8476 |
| myoC-8731 | − | ACGGAGUGACCUGCAGCGCAGGG | 23 | 8477 |
| myoC-8732 | − | CACGGAGUGACCUGCAGCGCAGGG | 24 | 8478 |
| myoC-8733 | − | UAAAGCUAGGGGUGAGGG | 18 | 8479 |
| myoC-8734 | − | UUAAAGCUAGGGGUGAGGG | 19 | 8480 |
| myoC-2073 | − | UUUAAAGCUAGGGGUGAGGG | 20 | 2204 |
| myoC-8735 | − | UUUUAAAGCUAGGGGUGAGGG | 21 | 8481 |

TABLE 10G-continued

| 7th Tier | | | | |
|---|---|---|---|---|
| gRNA Name | DNA Strand | Targeting Domain | Target Site Length | Seq ID |
| myoC-8736 | - | GUUUUAAAGCUAGGGGUGAGGG | 22 | 8482 |
| myoC-8737 | - | UGUUUUAAAGCUAGGGGUGAGGG | 23 | 8483 |
| myoC-8738 | - | UUGUUUUAAAGCUAGGGGUGAGGG | 24 | 8484 |
| myoC-8739 | - | GUUGUUUUAAAGCUAGGG | 18 | 8485 |
| myoC-8740 | - | AGUUGUUUUAAAGCUAGGG | 19 | 8486 |
| myoC-2067 | - | CAGUUGUUUUAAAGCUAGGG | 20 | 2198 |
| myoC-8741 | - | ACAGUUGUUUUAAAGCUAGGG | 21 | 8487 |
| myoC-8742 | - | CACAGUUGUUUUAAAGCUAGGG | 22 | 8488 |
| myoC-8743 | - | ACACAGUUGUUUUAAAGCUAGGG | 23 | 8489 |
| myoC-8744 | - | UACACAGUUGUUUUAAAGCUAGGG | 24 | 8490 |
| myoC-8745 | - | UGACCUGCAGCGCAGGGG | 18 | 8491 |
| myoC-8746 | - | GUGACCUGCAGCGCAGGGG | 19 | 8492 |
| myoC-1121 | - | AGUGACCUGCAGCGCAGGGG | 20 | 1421 |
| myoC-8747 | - | GAGUGACCUGCAGCGCAGGGG | 21 | 8493 |
| myoC-8748 | - | GGAGUGACCUGCAGCGCAGGGG | 22 | 8494 |
| myoC-8749 | - | CGGAGUGACCUGCAGCGCAGGGG | 23 | 8495 |
| myoC-8750 | - | ACGGAGUGACCUGCAGCGCAGGGG | 24 | 8496 |
| myoC-8751 | - | GGGGGAUGUUGAGAGGGG | 18 | 8497 |
| myoC-8752 | - | GGGGGGAUGUUGAGAGGGG | 19 | 8498 |
| myoC-1943 | - | AGGGGGGAUGUUGAGAGGGG | 20 | 2112 |
| myoC-8753 | - | GAGGGGGGAUGUUGAGAGGGG | 21 | 8499 |
| myoC-8754 | - | UGAGGGGGGAUGUUGAGAGGGG | 22 | 8500 |
| myoC-8755 | - | GUGAGGGGGGAUGUUGAGAGGGG | 23 | 8501 |
| myoC-8756 | - | UGUGAGGGGGGAUGUUGAGAGGGG | 24 | 8502 |
| myoC-8757 | - | GCAGGGCUAUAUUGUGGG | 18 | 8503 |
| myoC-8758 | - | GGCAGGGCUAUAUUGUGGG | 19 | 8504 |
| myoC-1140 | - | AGGCAGGGCUAUAUUGUGGG | 20 | 1440 |
| myoC-8759 | - | GAGGCAGGGCUAUAUUGUGGG | 21 | 8505 |
| myoC-8760 | - | GGAGGCAGGGCUAUAUUGUGGG | 22 | 8506 |
| myoC-8761 | - | AGGAGGCAGGGCUAUAUUGUGGG | 23 | 8507 |
| myoC-8762 | - | UAGGAGGCAGGGCUAUAUUGUGGG | 24 | 8508 |
| myoC-5103 | - | GGUAAGAAUGCAGAGUGG | 18 | 4849 |
| myoC-5104 | - | AGGUAAGAAUGCAGAGUGG | 19 | 4850 |
| myoC-3188 | - | AAGGUAAGAAUGCAGAGUGG | 20 | 2934 |
| myoC-5105 | - | GAAGGUAAGAAUGCAGAGUGG | 21 | 4851 |
| myoC-5106 | - | AGAAGGUAAGAAUGCAGAGUGG | 22 | 4852 |
| myoC-5107 | - | GAGAAGGUAAGAAUGCAGAGUGG | 23 | 4853 |

TABLE 10G-continued

| 7th Tier | | | | |
|---|---|---|---|---|
| gRNA Name | DNA Strand | Targeting Domain | Target Site Length | Seq ID |
| myoC-5108 | - | AGAGAAGGUAAGAAUGCAGAGUGG | 24 | 4854 |
| myoC-8763 | - | GAGCCACAGGGGAGGUGG | 18 | 8509 |
| myoC-8764 | - | UGAGCCACAGGGGAGGUGG | 19 | 8510 |
| myoC-1051 | - | CUGAGCCACAGGGGAGGUGG | 20 | 1351 |
| myoC-8765 | - | GCUGAGCCACAGGGGAGGUGG | 21 | 8511 |
| myoC-8766 | - | AGCUGAGCCACAGGGGAGGUGG | 22 | 8512 |
| myoC-8767 | - | CAGCUGAGCCACAGGGGAGGUGG | 23 | 8513 |
| myoC-8768 | - | GCAGCUGAGCCACAGGGGAGGUGG | 24 | 8514 |
| myoC-8769 | - | GGCAGGGCUAUAUUGUGG | 18 | 8515 |
| myoC-8770 | - | AGGCAGGGCUAUAUUGUGG | 19 | 8516 |
| myoC-1139 | - | GAGGCAGGGCUAUAUUGUGG | 20 | 1439 |
| myoC-8771 | - | GGAGGCAGGGCUAUAUUGUGG | 21 | 8517 |
| myoC-8772 | - | AGGAGGCAGGGCUAUAUUGUGG | 22 | 8518 |
| myoC-8773 | - | UAGGAGGCAGGGCUAUAUUGUGG | 23 | 8519 |
| myoC-8774 | - | CUAGGAGGCAGGGCUAUAUUGUGG | 24 | 8520 |
| myoC-8775 | - | CAAUAACCAAAAAGAAUG | 18 | 8521 |
| myoC-8776 | - | CCAAUAACCAAAAAGAAUG | 19 | 8522 |
| myoC-1970 | - | GCCAAUAACCAAAAAGAAUG | 20 | 2128 |
| myoC-8777 | - | UGCCAAUAACCAAAAAGAAUG | 21 | 8523 |
| myoC-8778 | - | UUGCCAAUAACCAAAAAGAAUG | 22 | 8524 |
| myoC-8779 | - | UUUGCCAAUAACCAAAAAGAAUG | 23 | 8525 |
| myoC-8780 | - | AUUUGCCAAUAACCAAAAAGAAUG | 24 | 8526 |
| myoC-8781 | - | AGCCUGUGAAUUUGAAUG | 18 | 8527 |
| myoC-8782 | - | AAGCCUGUGAAUUUGAAUG | 19 | 8528 |
| myoC-1170 | - | AAAGCCUGUGAAUUUGAAUG | 20 | 1470 |
| myoC-8783 | - | GAAAGCCUGUGAAUUUGAAUG | 21 | 8529 |
| myoC-8784 | - | AGAAAGCCUGUGAAUUUGAAUG | 22 | 8530 |
| myoC-8785 | - | CAGAAAGCCUGUGAAUUUGAAUG | 23 | 8531 |
| myoC-8786 | - | CCAGAAAGCCUGUGAAUUUGAAUG | 24 | 8532 |
| myoC-8787 | - | UCUCUGUGAGGGGGGAUG | 18 | 8533 |
| myoC-8788 | - | UUCUCUGUGAGGGGGGAUG | 19 | 8534 |
| myoC-1937 | - | AUUCUCUGUGAGGGGGGAUG | 20 | 2109 |
| myoC-8789 | - | GAUUCUCUGUGAGGGGGGAUG | 21 | 8535 |
| myoC-8790 | - | UGAUUCUCUGUGAGGGGGGAUG | 22 | 8536 |
| myoC-8791 | - | GUGAUUCUCUGUGAGGGGGGAUG | 23 | 8537 |
| myoC-8792 | - | UGUGAUUCUCUGUGAGGGGGGAUG | 24 | 8538 |
| myoC-8793 | - | CAAGUUCAGGCUUAACUG | 18 | 8539 |
| myoC-8794 | - | UCAAGUUCAGGCUUAACUG | 19 | 8540 |

TABLE 10G-continued

| 7th Tier | | | | |
|---|---|---|---|---|
| gRNA Name | DNA Strand | Targeting Domain | Target Site Length | Seq ID |
| myoC-2029 | - | CUCAAGUUCAGGCUUAACUG | 20 | 2164 |
| myoC-8795 | - | UCUCAAGUUCAGGCUUAACUG | 21 | 8541 |
| myoC-8796 | - | GUCUCAAGUUCAGGCUUAACUG | 22 | 8542 |
| myoC-8797 | - | UGUCUCAAGUUCAGGCUUAACUG | 23 | 8543 |
| myoC-8798 | - | AUGUCUCAAGUUCAGGCUUAACUG | 24 | 8544 |
| myoC-5146 | - | AGGUAAGAAUGCAGAGUG | 18 | 4892 |
| myoC-5147 | - | AAGGUAAGAAUGCAGAGUG | 19 | 4893 |
| myoC-3189 | - | GAAGGUAAGAAUGCAGAGUG | 20 | 2935 |
| myoC-5148 | - | AGAAGGUAAGAAUGCAGAGUG | 21 | 4894 |
| myoC-5149 | - | GAGAAGGUAAGAAUGCAGAGUG | 22 | 4895 |
| myoC-5150 | - | AGAGAAGGUAAGAAUGCAGAGUG | 23 | 4896 |
| myoC-5151 | - | CAGAGAAGGUAAGAAUGCAGAGUG | 24 | 4897 |
| myoC-8799 | - | UGAGCCACAGGGGAGGUG | 18 | 8545 |
| myoC-8800 | - | CUGAGCCACAGGGGAGGUG | 19 | 8546 |
| myoC-1955 | - | GCUGAGCCACAGGGGAGGUG | 20 | 2118 |
| myoC-8801 | - | AGCUGAGCCACAGGGGAGGUG | 21 | 8547 |
| myoC-8802 | - | CAGCUGAGCCACAGGGGAGGUG | 22 | 8548 |
| myoC-8803 | - | GCAGCUGAGCCACAGGGGAGGUG | 23 | 8549 |
| myoC-8804 | - | AGCAGCUGAGCCACAGGGGAGGUG | 24 | 8550 |
| myoC-8805 | - | GUUUUAAAGCUAGGGGUG | 18 | 8551 |
| myoC-8806 | - | UGUUUUAAAGCUAGGGGUG | 19 | 8552 |
| myoC-2069 | - | UUGUUUUAAAGCUAGGGGUG | 20 | 2200 |
| myoC-8807 | - | GUUGUUUUAAAGCUAGGGGUG | 21 | 8553 |
| myoC-8808 | - | AGUUGUUUUAAAGCUAGGGGUG | 22 | 8554 |
| myoC-8809 | - | CAGUUGUUUUAAAGCUAGGGGUG | 23 | 8555 |
| myoC-8810 | - | ACAGUUGUUUUAAAGCUAGGGGUG | 24 | 8556 |
| myoC-8811 | - | CAACUACUCAGCCCUGUG | 18 | 8557 |
| myoC-8812 | - | GCAACUACUCAGCCCUGUG | 19 | 8558 |
| myoC-1922 | - | GGCAACUACUCAGCCCUGUG | 20 | 2100 |
| myoC-8813 | - | GGGCAACUACUCAGCCCUGUG | 21 | 8559 |
| myoC-8814 | - | UGGGCAACUACUCAGCCCUGUG | 22 | 8560 |
| myoC-8815 | - | CUGGGCAACUACUCAGCCCUGUG | 23 | 8561 |
| myoC-8816 | - | UCUGGGCAACUACUCAGCCCUGUG | 24 | 8562 |
| myoC-8817 | - | UCCCUGUGAUUCUCUGUG | 18 | 8563 |
| myoC-8818 | - | UUCCCUGUGAUUCUCUGUG | 19 | 8564 |
| myoC-1035 | - | CUUCCCUGUGAUUCUCUGUG | 20 | 1335 |
| myoC-8819 | - | ACUUCCCUGUGAUUCUCUGUG | 21 | 8565 |

TABLE 10G-continued

| 7th Tier | | | | |
|---|---|---|---|---|
| gRNA Name | DNA Strand | Targeting Domain | Target Site Length | Seq ID |
| myoC-8820 | - | CACUUCCCUGUGAUUCUCUGUG | 22 | 8566 |
| myoC-8821 | - | ACACUUCCCUGUGAUUCUCUGUG | 23 | 8567 |
| myoC-8822 | - | AACACUUCCCUGUGAUUCUCUGUG | 24 | 8568 |
| myoC-8823 | - | AGGCAGGGCUAUAUUGUG | 18 | 8569 |
| myoC-8824 | - | GAGGCAGGGCUAUAUUGUG | 19 | 8570 |
| myoC-1138 | - | GGAGGCAGGGCUAUAUUGUG | 20 | 1438 |
| myoC-8825 | - | AGGAGGCAGGGCUAUAUUGUG | 21 | 8571 |
| myoC-8826 | - | UAGGAGGCAGGGCUAUAUUGUG | 22 | 8572 |
| myoC-8827 | - | CUAGGAGGCAGGGCUAUAUUGUG | 23 | 8573 |
| myoC-8828 | - | UCUAGGAGGCAGGGCUAUAUUGUG | 24 | 8574 |
| myoC-8829 | - | GGAGGCAGGGCUAUAUUG | 18 | 8575 |
| myoC-8830 | - | AGGAGGCAGGGCUAUAUUG | 19 | 8576 |
| myoC-1136 | - | UAGGAGGCAGGGCUAUAUUG | 20 | 1436 |
| myoC-8831 | - | CUAGGAGGCAGGGCUAUAUUG | 21 | 8577 |
| myoC-8832 | - | UCUAGGAGGCAGGGCUAUAUUG | 22 | 8578 |
| myoC-8833 | - | UUCUAGGAGGCAGGGCUAUAUUG | 23 | 8579 |
| myoC-8834 | - | GUUCUAGGAGGCAGGGCUAUAUUG | 24 | 8580 |
| myoC-8835 | - | GAGAUGCAAGACUGAAAU | 18 | 8581 |
| myoC-8836 | - | UGAGAUGCAAGACUGAAAU | 19 | 8582 |
| myoC-2064 | - | CUGAGAUGCAAGACUGAAAU | 20 | 2195 |
| myoC-8837 | - | CCUGAGAUGCAAGACUGAAAU | 21 | 8583 |
| myoC-8838 | - | GCCUGAGAUGCAAGACUGAAAU | 22 | 8584 |
| myoC-8839 | - | UGCCUGAGAUGCAAGACUGAAAU | 23 | 8585 |
| myoC-8840 | - | GUGCCUGAGAUGCAAGACUGAAAU | 24 | 8586 |
| myoC-8841 | - | GGUCGAAAACCUUGGAAU | 18 | 8587 |
| myoC-8842 | - | CGGUCGAAAACCUUGGAAU | 19 | 8588 |
| myoC-1926 | - | ACGGUCGAAAACCUUGGAAU | 20 | 2103 |
| myoC-8843 | - | GACGGUCGAAAACCUUGGAAU | 21 | 8589 |
| myoC-8844 | - | AGACGGUCGAAAACCUUGGAAU | 22 | 8590 |
| myoC-8845 | - | AAGACGGUCGAAAACCUUGGAAU | 23 | 8591 |
| myoC-8846 | - | CAAGACGGUCGAAAACCUUGGAAU | 24 | 8592 |
| myoC-8847 | - | AAGCCUGUGAAUUUGAAU | 18 | 8593 |
| myoC-8848 | - | AAAGCCUGUGAAUUUGAAU | 19 | 8594 |
| myoC-2046 | - | GAAAGCCUGUGAAUUUGAAU | 20 | 2178 |
| myoC-8849 | - | AGAAAGCCUGUGAAUUUGAAU | 21 | 8595 |
| myoC-8850 | - | CAGAAAGCCUGUGAAUUUGAAU | 22 | 8596 |
| myoC-8851 | - | CCAGAAAGCCUGUGAAUUUGAAU | 23 | 8597 |
| myoC-8852 | - | UCCAGAAAGCCUGUGAAUUUGAAU | 24 | 8598 |

TABLE 10G-continued

| 7th Tier | | | | |
|---|---|---|---|---|
| gRNA Name | DNA Strand | Targeting Domain | Target Site Length | Seq ID |
| myoC-8853 | - | GGUGAGAUGUGUCUGCAU | 18 | 8599 |
| myoC-8854 | - | GGGUGAGAUGUGUCUGCAU | 19 | 8600 |
| myoC-8855 | - | CGGGUGAGAUGUGUCUGCAU | 20 | 8601 |
| myoC-8856 | - | CCGGGUGAGAUGUGUCUGCAU | 21 | 8602 |
| myoC-8857 | - | ACCGGGUGAGAUGUGUCUGCAU | 22 | 8603 |
| myoC-8858 | - | GACCGGGUGAGAUGUGUCUGCAU | 23 | 8604 |
| myoC-8859 | - | GGACCGGGUGAGAUGUGUCUGCAU | 24 | 8605 |
| myoC-8860 | - | AAUCUAUAUUUUAUAUAU | 18 | 8606 |
| myoC-8861 | - | UAAUCUAUAUUUUAUAUAU | 19 | 8607 |
| myoC-2054 | - | GUAAUCUAUAUUUUAUAUAU | 20 | 2185 |
| myoC-8862 | - | UGUAAUCUAUAUUUUAUAUAU | 21 | 8608 |
| myoC-8863 | - | UUGUAAUCUAUAUUUUAUAUAU | 22 | 8609 |
| myoC-8864 | - | UUUGUAAUCUAUAUUUUAUAUAU | 23 | 8610 |
| myoC-8865 | - | CUUUGUAAUCUAUAUUUUAUAUAU | 24 | 8611 |
| myoC-8866 | - | UACUUAGUUUCUCCUUAU | 18 | 8612 |
| myoC-8867 | - | UUACUUAGUUUCUCCUUAU | 19 | 8613 |
| myoC-2017 | - | AUUACUUAGUUUCUCCUUAU | 20 | 2155 |
| myoC-8868 | - | GAUUACUUAGUUUCUCCUUAU | 21 | 8614 |
| myoC-8869 | - | AGAUUACUUAGUUUCUCCUUAU | 22 | 8615 |
| myoC-8870 | - | AAGAUUACUUAGUUUCUCCUUAU | 23 | 8616 |
| myoC-8871 | - | UAAGAUUACUUAGUUUCUCCUUAU | 24 | 8617 |
| myoC-8872 | - | AAACUGUGUUUCUCCACU | 18 | 8618 |
| myoC-8873 | - | CAAACUGUGUUUCUCCACU | 19 | 8619 |
| myoC-2033 | - | GCAAACUGUGUUUCUCCACU | 20 | 2168 |
| myoC-8874 | - | AGCAAACUGUGUUUCUCCACU | 21 | 8620 |
| myoC-8875 | - | GAGCAAACUGUGUUUCUCCACU | 22 | 8621 |
| myoC-8876 | - | AGAGCAAACUGUGUUUCUCCACU | 23 | 8622 |
| myoC-8877 | - | UAGAGCAAACUGUGUUUCUCCACU | 24 | 8623 |
| myoC-8878 | - | UUUAUACUCAAAACUACU | 18 | 8624 |
| myoC-8879 | - | AUUUAUACUCAAAACUACU | 19 | 8625 |
| myoC-2052 | - | UAUUUAUACUCAAAACUACU | 20 | 2183 |
| myoC-8880 | - | AUAUUUAUACUCAAAACUACU | 21 | 8626 |
| myoC-8881 | - | AAUAUUUAUACUCAAAACUACU | 22 | 8627 |
| myoC-8882 | - | AAAUAUUUAUACUCAAAACUACU | 23 | 8628 |
| myoC-8883 | - | GAAAUAUUUAUACUCAAAACUACU | 24 | 8629 |
| myoC-8884 | - | ACUAGUAAUUUAGCUCCU | 18 | 8630 |
| myoC-8885 | - | UACUAGUAAUUUAGCUCCU | 19 | 8631 |

TABLE 10G-continued

| 7th Tier | | | | |
|---|---|---|---|---|
| gRNA Name | DNA Strand | Targeting Domain | Target Site Length | Seq ID |
| myoC-8886 | - | UUACUAGUAAUUUAGCUCCU | 20 | 8632 |
| myoC-8887 | - | AUUACUAGUAAUUUAGCUCCU | 21 | 8633 |
| myoC-8888 | - | UAUUACUAGUAAUUUAGCUCCU | 22 | 8634 |
| myoC-8889 | - | GUAUUACUAGUAAUUUAGCUCCU | 23 | 8635 |
| myoC-8890 | - | AGUAUUACUAGUAAUUUAGCUCCU | 24 | 8636 |
| myoC-5251 | - | CCAGGAGGUAGCAAGGCU | 18 | 4997 |
| myoC-5252 | - | GCCAGGAGGUAGCAAGGCU | 19 | 4998 |
| myoC-1656 | - | AGCCAGGAGGUAGCAAGGCU | 20 | 1919 |
| myoC-5253 | - | CAGCCAGGAGGUAGCAAGGCU | 21 | 4999 |
| myoC-5254 | - | GCAGCCAGGAGGUAGCAAGGCU | 22 | 5000 |
| myoC-5255 | - | AGCAGCCAGGAGGUAGCAAGGCU | 23 | 5001 |
| myoC-5256 | - | CAGCAGCCAGGAGGUAGCAAGGCU | 24 | 5002 |
| myoC-8891 | - | ACUUCCCUGUGAUUCUCU | 18 | 8637 |
| myoC-8892 | - | CACUUCCCUGUGAUUCUCU | 19 | 8638 |
| myoC-1931 | - | ACACUUCCCUGUGAUUCUCU | 20 | 2107 |
| myoC-8893 | - | AACACUUCCCUGUGAUUCUCU | 21 | 8639 |
| myoC-8894 | - | GAACACUUCCCUGUGAUUCUCU | 22 | 8640 |
| myoC-8895 | - | UGAACACUUCCCUGUGAUUCUCU | 23 | 8641 |
| myoC-8896 | - | GUGAACACUUCCCUGUGAUUCUCU | 24 | 8642 |
| myoC-8897 | - | UAGGAACUCUUUUUCUCU | 18 | 8643 |
| myoC-8898 | - | UUAGGAACUCUUUUUCUCU | 19 | 8644 |
| myoC-2019 | - | AUUAGGAACUCUUUUUCUCU | 20 | 2156 |
| myoC-8899 | - | UAUUAGGAACUCUUUUUCUCU | 21 | 8645 |
| myoC-8900 | - | UUAUUAGGAACUCUUUUUCUCU | 22 | 8646 |
| myoC-8901 | - | CUUAUUAGGAACUCUUUUUCUCU | 23 | 8647 |
| myoC-8902 | - | CCUUAUUAGGAACUCUUUUUCUCU | 24 | 8648 |
| myoC-8903 | - | CACGUGAUCCUGGGUUCU | 18 | 8649 |
| myoC-8904 | - | CCACGUGAUCCUGGGUUCU | 19 | 8650 |
| myoC-1132 | - | UCCACGUGAUCCUGGGUUCU | 20 | 1432 |
| myoC-8905 | - | GUCCACGUGAUCCUGGGUUCU | 21 | 8651 |
| myoC-8906 | - | AGUCCACGUGAUCCUGGGUUCU | 22 | 8652 |
| myoC-8907 | - | UAGUCCACGUGAUCCUGGGUUCU | 23 | 8653 |
| myoC-8908 | - | AUAGUCCACGUGAUCCUGGGUUCU | 24 | 8654 |
| myoC-8909 | - | UUGCAGCUCUCGUGUUCU | 18 | 8655 |
| myoC-8910 | - | CUUGCAGCUCUCGUGUUCU | 19 | 8656 |
| myoC-1930 | - | CCUUGCAGCUCUCGUGUUCU | 20 | 2106 |
| myoC-8911 | - | CCCUUGCAGCUCUCGUGUUCU | 21 | 8657 |
| myoC-8912 | - | ACCCUUGCAGCUCUCGUGUUCU | 22 | 8658 |

TABLE 10G-continued

| 7th Tier | | | | |
|---|---|---|---|---|
| gRNA Name | DNA Strand | Targeting Domain | Target Site Length | Seq ID |
| myoC-8913 | - | GACCCUUGCAGCUCUCGUGUUCU | 23 | 8659 |
| myoC-8914 | - | AGACCCUUGCAGCUCUCGUGUUCU | 24 | 8660 |
| myoC-8915 | - | AUUUGAAAACAUCUUUCU | 18 | 8661 |
| myoC-8916 | - | UAUUUGAAAACAUCUUUCU | 19 | 8662 |
| myoC-2056 | - | AUAUUUGAAAACAUCUUUCU | 20 | 2187 |
| myoC-8917 | - | UAUAUUUGAAAACAUCUUUCU | 21 | 8663 |
| myoC-8918 | - | AUAUAUUUGAAAACAUCUUUCU | 22 | 8664 |
| myoC-8919 | - | UAUAUAUUUGAAAACAUCUUUCU | 23 | 8665 |
| myoC-8920 | - | UUAUAUAUUUGAAAACAUCUUUCU | 24 | 8666 |
| myoC-8921 | - | AAUCAGUUCAAGGGAAGU | 18 | 8667 |
| myoC-8922 | - | AAAUCAGUUCAAGGGAAGU | 19 | 8668 |
| myoC-1143 | - | AAAAUCAGUUCAAGGGAAGU | 20 | 1443 |
| myoC-8923 | - | AAAAAUCAGUUCAAGGGAAGU | 21 | 8669 |
| myoC-8924 | - | AAAAAAUCAGUUCAAGGGAAGU | 22 | 8670 |
| myoC-8925 | - | GAAAAAAUCAGUUCAAGGGAAGU | 23 | 8671 |
| myoC-8926 | - | GGAAAAAAUCAGUUCAAGGGAAGU | 24 | 8672 |
| myoC-8927 | - | UGAGUCUGCCAGGGCAGU | 18 | 8673 |
| myoC-8928 | - | GUGAGUCUGCCAGGGCAGU | 19 | 8674 |
| myoC-2037 | - | GGUGAGUCUGCCAGGGCAGU | 20 | 2171 |
| myoC-8929 | - | AGGUGAGUCUGCCAGGGCAGU | 21 | 8675 |
| myoC-8930 | - | GAGGUGAGUCUGCCAGGGCAGU | 22 | 8676 |
| myoC-8931 | - | GGAGGUGAGUCUGCCAGGGCAGU | 23 | 8677 |
| myoC-8932 | - | UGGAGGUGAGUCUGCCAGGGCAGU | 24 | 8678 |
| myoC-8933 | - | CAUGCACACACACAGAGU | 18 | 8679 |
| myoC-8934 | - | GCAUGCACACACACAGAGU | 19 | 8680 |
| myoC-2060 | - | GGCAUGCACACACACAGAGU | 20 | 2191 |
| myoC-8935 | - | UGGCAUGCACACACACAGAGU | 21 | 8681 |
| myoC-8936 | - | UUGGCAUGCACACACACAGAGU | 22 | 8682 |
| myoC-8937 | - | CUUGGCAUGCACACACACAGAGU | 23 | 8683 |
| myoC-8938 | - | UCUUGGCAUGCACACACACAGAGU | 24 | 8684 |
| myoC-5289 | - | AAGGUAAGAAUGCAGAGU | 18 | 5035 |
| myoC-5290 | - | GAAGGUAAGAAUGCAGAGU | 19 | 5036 |
| myoC-3191 | - | AGAAGGUAAGAAUGCAGAGU | 20 | 2937 |
| myoC-5291 | - | GAGAAGGUAAGAAUGCAGAGU | 21 | 5037 |
| myoC-5292 | - | AGAGAAGGUAAGAAUGCAGAGU | 22 | 5038 |
| myoC-5293 | - | CAGAGAAGGUAAGAAUGCAGAGU | 23 | 5039 |
| myoC-5294 | - | CCAGAGAAGGUAAGAAUGCAGAGU | 24 | 5040 |

TABLE 10G-continued

| 7th Tier | | | | |
|---|---|---|---|---|
| gRNA Name | DNA Strand | Targeting Domain | Target Site Length | Seq ID |
| myoC-3765 | - | AGAAUCUGGCCAGGAGGU | 18 | 3511 |
| myoC-3766 | - | GAGAAUCUGGCCAGGAGGU | 19 | 3512 |
| myoC-197 | - | UGAGAAUCUGGCCAGGAGGU | 20 | 583 |
| myoC-3767 | - | AUGAGAAUCUGGCCAGGAGGU | 21 | 3513 |
| myoC-3768 | - | AAUGAGAAUCUGGCCAGGAGGU | 22 | 3514 |
| myoC-3769 | - | AAAUGAGAAUCUGGCCAGGAGGU | 23 | 3515 |
| myoC-3770 | - | AAAAUGAGAAUCUGGCCAGGAGGU | 24 | 3516 |
| myoC-8939 | - | UGUUUUAAAGCUAGGGGU | 18 | 8685 |
| myoC-8940 | - | UUGUUUUAAAGCUAGGGGU | 19 | 8686 |
| myoC-2068 | - | GUUGUUUUAAAGCUAGGGGU | 20 | 2199 |
| myoC-8941 | - | AGUUGUUUUAAAGCUAGGGGU | 21 | 8687 |
| myoC-8942 | - | CAGUUGUUUUAAAGCUAGGGGU | 22 | 8688 |
| myoC-8943 | - | ACAGUUGUUUUAAAGCUAGGGGU | 23 | 8689 |
| myoC-8944 | - | CACAGUUGUUUUAAAGCUAGGGGU | 24 | 8690 |
| myoC-8945 | - | UUCCCUGUGAUUCUCUGU | 18 | 8691 |
| myoC-8946 | - | CUUCCCUGUGAUUCUCUGU | 19 | 8692 |
| myoC-1932 | - | ACUUCCCUGUGAUUCUCUGU | 20 | 2108 |
| myoC-8947 | - | CACUUCCCUGUGAUUCUCUGU | 21 | 8693 |
| myoC-8948 | - | ACACUUCCCUGUGAUUCUCUGU | 22 | 8694 |
| myoC-8949 | - | AACACUUCCCUGUGAUUCUCUGU | 23 | 8695 |
| myoC-8950 | - | GAACACUUCCCUGUGAUUCUCUGU | 24 | 8696 |
| myoC-8951 | - | AAAAGAGAGGGAUAGUGU | 18 | 8697 |
| myoC-8952 | - | AAAAAGAGAGGGAUAGUGU | 19 | 8698 |
| myoC-1990 | - | GAAAAAGAGAGGGAUAGUGU | 20 | 2141 |
| myoC-8953 | - | AGAAAAAGAGAGGGAUAGUGU | 21 | 8699 |
| myoC-8954 | - | AAGAAAAAGAGAGGGAUAGUGU | 22 | 8700 |
| myoC-8955 | - | GAAGAAAAAGAGAGGGAUAGUGU | 23 | 8701 |
| myoC-8956 | - | AGAAGAAAAAGAGAGGGAUAGUGU | 24 | 8702 |
| myoC-8957 | - | GAGGCAGGGCUAUAUUGU | 18 | 8703 |
| myoC-8958 | - | GGAGGCAGGGCUAUAUUGU | 19 | 8704 |
| myoC-1137 | - | AGGAGGCAGGGCUAUAUUGU | 20 | 1437 |
| myoC-8959 | - | UAGGAGGCAGGGCUAUAUUGU | 21 | 8705 |
| myoC-8960 | - | CUAGGAGGCAGGGCUAUAUUGU | 22 | 8706 |
| myoC-8961 | - | UCUAGGAGGCAGGGCUAUAUUGU | 23 | 8707 |
| myoC-8962 | - | UUCUAGGAGGCAGGGCUAUAUUGU | 24 | 8708 |
| myoC-8963 | - | GCACAAGACAGAUGAAUU | 18 | 8709 |
| myoC-8964 | - | AGCACAAGACAGAUGAAUU | 19 | 8710 |
| myoC-8965 | - | UAGCACAAGACAGAUGAAUU | 20 | 8711 |

TABLE 10G-continued

| 7th Tier | | | | |
|---|---|---|---|---|
| gRNA Name | DNA Strand | Targeting Domain | Target Site Length | Seq ID |
| myoC-8966 | - | CUAGCACAAGACAGAUGAAUU | 21 | 8712 |
| myoC-8967 | - | GCUAGCACAAGACAGAUGAAUU | 22 | 8713 |
| myoC-8968 | - | AGCUAGCACAAGACAGAUGAAUU | 23 | 8714 |
| myoC-8969 | - | CAGCUAGCACAAGACAGAUGAAUU | 24 | 8715 |
| myoC-8970 | - | UUUACAAGCUGAGUAAUU | 18 | 8716 |
| myoC-8971 | - | CUUUACAAGCUGAGUAAUU | 19 | 8717 |
| myoC-2015 | - | CCUUUACAAGCUGAGUAAUU | 20 | 2153 |
| myoC-8972 | - | UCCUUUACAAGCUGAGUAAUU | 21 | 8718 |
| myoC-8973 | - | UUCCUUUACAAGCUGAGUAAUU | 22 | 8719 |
| myoC-8974 | - | UUUCCUUUACAAGCUGAGUAAUU | 23 | 8720 |
| myoC-8975 | - | UUUUCCUUUACAAGCUGAGUAAUU | 24 | 8721 |
| myoC-8976 | - | ACAGAGUAAGAACUGAUU | 18 | 8722 |
| myoC-8977 | - | CACAGAGUAAGAACUGAUU | 19 | 8723 |
| myoC-2061 | - | ACACAGAGUAAGAACUGAUU | 20 | 2192 |
| myoC-8978 | - | CACACAGAGUAAGAACUGAUU | 21 | 8724 |
| myoC-8979 | - | ACACACAGAGUAAGAACUGAUU | 22 | 8725 |
| myoC-8980 | - | CACACACAGAGUAAGAACUGAUU | 23 | 8726 |
| myoC-8981 | - | ACACACACAGAGUAAGAACUGAUU | 24 | 8727 |
| myoC-8982 | - | GAUGUUUACUAUCUGAUU | 18 | 8728 |
| myoC-8983 | - | CGAUGUUUACUAUCUGAUU | 19 | 8729 |
| myoC-2027 | - | GCGAUGUUUACUAUCUGAUU | 20 | 2162 |
| myoC-8984 | - | AGCGAUGUUUACUAUCUGAUU | 21 | 8730 |
| myoC-8985 | - | CAGCGAUGUUUACUAUCUGAUU | 22 | 8731 |
| myoC-8986 | - | UCAGCGAUGUUUACUAUCUGAUU | 23 | 8732 |
| myoC-8987 | - | UUCAGCGAUGUUUACUAUCUGAUU | 24 | 8733 |
| myoC-8988 | - | AGGAGGCAGGGCUAUAUU | 18 | 8734 |
| myoC-8989 | - | UAGGAGGCAGGGCUAUAUU | 19 | 8735 |
| myoC-2002 | - | CUAGGAGGCAGGGCUAUAUU | 20 | 2149 |
| myoC-8990 | - | UCUAGGAGGCAGGGCUAUAUU | 21 | 8736 |
| myoC-8991 | - | UUCUAGGAGGCAGGGCUAUAUU | 22 | 8737 |
| myoC-8992 | - | GUUCUAGGAGGCAGGGCUAUAUU | 23 | 8738 |
| myoC-8993 | - | GGUUCUAGGAGGCAGGGCUAUAUU | 24 | 8739 |
| myoC-8994 | - | ACUUAGUUUCUCCUUAUU | 18 | 8740 |
| myoC-8995 | - | UACUUAGUUUCUCCUUAUU | 19 | 8741 |
| myoC-1147 | - | UUACUUAGUUUCUCCUUAUU | 20 | 1447 |
| myoC-8996 | - | AUUACUUAGUUUCUCCUUAUU | 21 | 8742 |
| myoC-8997 | - | GAUUACUUAGUUUCUCCUUAUU | 22 | 8743 |

TABLE 10G-continued

| 7th Tier | | | | |
|---|---|---|---|---|
| gRNA Name | DNA Strand | Targeting Domain | Target Site Length | Seq ID |
| myoC-8998 | - | AGAUUACUUAGUUUCUCCUUAUU | 23 | 8744 |
| myoC-8999 | - | AAGAUUACUUAGUUUCUCCUUAUU | 24 | 8745 |
| myoC-9000 | - | AGUUGUCAAUUGUCCCUU | 18 | 8746 |
| myoC-9001 | - | AAGUUGUCAAUUGUCCCUU | 19 | 8747 |
| myoC-9002 | - | AAAGUUGUCAAUUGUCCCUU | 20 | 8748 |
| myoC-9003 | - | GAAAGUUGUCAAUUGUCCCUU | 21 | 8749 |
| myoC-9004 | - | AGAAAGUUGUCAAUUGUCCCUU | 22 | 8750 |
| myoC-9005 | - | UAGAAAGUUGUCAAUUGUCCCUU | 23 | 8751 |
| myoC-9006 | - | GUAGAAAGUUGUCAAUUGUCCCUU | 24 | 8752 |
| myoC-9007 | - | CCGAGAGCCACAAUGCUU | 18 | 8753 |
| myoC-9008 | - | ACCGAGAGCCACAAUGCUU | 19 | 8754 |
| myoC-1966 | - | GACCGAGAGCCACAAUGCUU | 20 | 2125 |
| myoC-9009 | - | GGACCGAGAGCCACAAUGCUU | 21 | 8755 |
| myoC-9010 | - | AGGACCGAGAGCCACAAUGCUU | 22 | 8756 |
| myoC-9011 | - | CAGGACCGAGAGCCACAAUGCUU | 23 | 8757 |
| myoC-9012 | - | CCAGGACCGAGAGCCACAAUGCUU | 24 | 8758 |
| myoC-9013 | - | AAAUAAGAAUAGAAUCUU | 18 | 8759 |
| myoC-9014 | - | CAAAUAAGAAUAGAAUCUU | 19 | 8760 |
| myoC-2032 | - | UCAAAUAAGAAUAGAAUCUU | 20 | 2167 |
| myoC-9015 | - | AUCAAAUAAGAAUAGAAUCUU | 21 | 8761 |
| myoC-9016 | - | AAUCAAAUAAGAAUAGAAUCUU | 22 | 8762 |
| myoC-9017 | - | CAAUCAAAUAAGAAUAGAAUCUU | 23 | 8763 |
| myoC-9018 | - | CCAAUCAAAUAAGAAUAGAAUCUU | 24 | 8764 |
| myoC-9019 | - | GAGUCUGCCAGGGCAGUU | 18 | 8765 |
| myoC-9020 | - | UGAGUCUGCCAGGGCAGUU | 19 | 8766 |
| myoC-1160 | - | GUGAGUCUGCCAGGGCAGUU | 20 | 1460 |
| myoC-9021 | - | GGUGAGUCUGCCAGGGCAGUU | 21 | 8767 |
| myoC-9022 | - | AGGUGAGUCUGCCAGGGCAGUU | 22 | 8768 |
| myoC-9023 | - | GAGGUGAGUCUGCCAGGGCAGUU | 23 | 8769 |
| myoC-9024 | - | GGAGGUGAGUCUGCCAGGGCAGUU | 24 | 8770 |
| myoC-9025 | - | UCUGUGAGGGGGGAUGUU | 18 | 8771 |
| myoC-9026 | - | CUCUGUGAGGGGGGAUGUU | 19 | 8772 |
| myoC-1938 | - | UCUCUGUGAGGGGGGAUGUU | 20 | 2110 |
| myoC-9027 | - | UUCUCUGUGAGGGGGGAUGUU | 21 | 8773 |
| myoC-9028 | - | AUUCUCUGUGAGGGGGGAUGUU | 22 | 8774 |
| myoC-9029 | - | GAUUCUCUGUGAGGGGGGAUGUU | 23 | 8775 |
| myoC-9030 | - | UGAUUCUCUGUGAGGGGGGAUGUU | 24 | 8776 |
| myoC-9031 | - | UUAAAAUGACCUUUAUUU | 18 | 8777 |

TABLE 10G-continued

| 7th Tier | | | | |
|---|---|---|---|---|
| gRNA Name | DNA Strand | Targeting Domain | Target Site Length | Seq ID |
| myoC-9032 | - | GUUAAAAUGACCUUUAUUU | 19 | 8778 |
| myoC-9033 | - | UGUUAAAAUGACCUUUAUUU | 20 | 8779 |
| myoC-9034 | - | AUGUUAAAAUGACCUUUAUUU | 21 | 8780 |
| myoC-9035 | - | GAUGUUAAAAUGACCUUUAUUU | 22 | 8781 |
| myoC-9036 | - | UGAUGUUAAAAUGACCUUUAUUU | 23 | 8782 |
| myoC-9037 | - | UUGAUGUUAAAAUGACCUUUAUUU | 24 | 8783 |
| myoC-9038 | - | AUAUUUGAAAACAUCUUU | 18 | 8784 |
| myoC-9039 | - | UAUAUUUGAAAACAUCUUU | 19 | 8785 |
| myoC-2055 | - | AUAUAUUUGAAAACAUCUUU | 20 | 2186 |
| myoC-9040 | - | UAUAUAUUUGAAAACAUCUUU | 21 | 8786 |
| myoC-9041 | - | UUAUAUAUUUGAAAACAUCUUU | 22 | 8787 |
| myoC-9042 | - | UUUAUAUAUUUGAAAACAUCUUU | 23 | 8788 |
| myoC-9043 | - | UUUUAUAUAUUUGAAAACAUCUUU | 24 | 8789 |
| myoC-9044 | - | UUGAAAAACUAUCCUUUU | 18 | 8790 |
| myoC-9045 | - | UUUGAAAAACUAUCCUUUU | 19 | 8791 |
| myoC-9046 | - | UUUUGAAAAACUAUCCUUUU | 20 | 8792 |
| myoC-9047 | - | CUUUUGAAAAACUAUCCUUUU | 21 | 8793 |
| myoC-9048 | - | CCUUUUGAAAAACUAUCCUUUU | 22 | 8794 |
| myoC-9049 | - | CCCUUUUGAAAAACUAUCCUUUU | 23 | 8795 |
| myoC-9050 | - | UCCCUUUUGAAAAACUAUCCUUUU | 24 | 8796 |
| myoC-9051 | - | GACUAUAUGAUUGGUUUU | 18 | 8797 |
| myoC-9052 | - | UGACUAUAUGAUUGGUUUU | 19 | 8798 |
| myoC-2026 | - | CUGACUAUAUGAUUGGUUUU | 20 | 2161 |
| myoC-9053 | - | GCUGACUAUAUGAUUGGUUUU | 21 | 8799 |
| myoC-9054 | - | UGCUGACUAUAUGAUUGGUUUU | 22 | 8800 |
| myoC-9055 | - | UUGCUGACUAUAUGAUUGGUUUU | 23 | 8801 |
| myoC-9056 | - | CUUGCUGACUAUAUGAUUGGUUUU | 24 | 8802 |

Table 11A provides exemplary targeting domains for knocking down the MYOC gene selected according to the first tier parameters. The targeting domains bind within 3454-2454 bp upstream of transcription start site or 500 bp upstream and downstream of transcription start site, have a high level of orthogonality and start with a 5'G. It is contemplated herein that in an embodiment the targeting domain hybridizes to the target domain through complementary base pairing. Any of the targeting domains in the table can be used with a *N. meningitidis* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 11A

| 1st Tier | | | | |
|---|---|---|---|---|
| gRNA Name | DNA Strand | Targeting Domain | Target Site Length | Seq ID |
| myoC-2699 | + | GAGGAGGCUUGGAAGAC | 17 | 2643 |
| myoC-3140 | + | GAGGAAACACUGUCCCC | 17 | 2891 |
| myoC-826 | + | GAGAGGAAACCUCUGCC | 17 | 1023 |
| myoC-5354 | - | GAUGCCAGCUGUCCAGC | 17 | 5100 |
| myoC-9057 | - | GCGCUGCAGCUGGCCUG | 17 | 8803 |

TABLE 11A-continued

| 1st Tier | | | | |
|---|---|---|---|---|
| gRNA Name | DNA Strand | Targeting Domain | Target Site Length | Seq ID |
| myoC-3125 | + | GGGUUGCCUUCACGCUGCCA | 20 | 2879 |
| myoC-3082 | + | GCCUGGCUCUGCUCUGGGCA | 20 | 2844 |
| myoC-9058 | + | GCGCUGUGACUGAUGGAGGA | 20 | 8804 |
| myoC-2153 | + | GAGGAGGAGGCUUGGAAGAC | 20 | 2263 |
| myoC-9059 | - | GUUAUCACUCUCUAGGGACC | 20 | 8805 |
| myoC-5355 | + | GCACAGAAGAACCUCAUUGC | 20 | 5101 |
| myoC-5356 | - | GGUUCUUCUGUGCACGUUGC | 20 | 5102 |

Table 11B provides exemplary targeting domains for knocking down the MYOC gene selected according to the second tier parameters. The targeting domains bind within 3454-2454 bp upstream of transcription start site or 500 bp upstream and downstream of transcription start site and have a high level of orthogonality. It is contemplated herein that in an embodiment the targeting domain hybridizes to the target domain through complementary base pairing. Any of the targeting domains in the table can be used with a *N. meningitidis* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 11B

| 2nd Tier | | | | |
|---|---|---|---|---|
| gRNA Name | DNA Strand | Targeting Domain | Target Site Length | Seq ID |
| myoC-3153 | + | UUGCCUUCACGCUGCCA | 17 | 2903 |
| myoC-9060 | + | CUGUGACUGAUGGAGGA | 17 | 8806 |
| myoC-9061 | + | AACGGCCUAGGAAAUGA | 17 | 8807 |
| myoC-5357 | - | AGAGAGACAGCAGCACC | 17 | 5103 |
| myoC-9062 | - | AUCACUCUCUAGGGACC | 17 | 8808 |
| myoC-5358 | + | CAGAAGAACCUCAUUGC | 17 | 5104 |
| myoC-5359 | - | UCUUCUGUGCACGUUGC | 17 | 5105 |
| myoC-9063 | - | CGGGGCUGGGAGUUUUC | 17 | 8809 |
| myoC-5360 | + | UCAUUGCAGAGGCUUGG | 17 | 5106 |
| myoC-9064 | + | ACAACACUGAACAUCUG | 17 | 8810 |
| myoC-3152 | + | CACCAGGACUACUGGUG | 17 | 2902 |
| myoC-9065 | + | CACGAAGGUAGGGCAGU | 17 | 8811 |
| myoC-3111 | + | UCUCCAGCUCAGAUGCACCA | 20 | 2866 |
| myoC-9066 | + | AUUAACGGCCUAGGAAAUGA | 20 | 8812 |
| myoC-5361 | - | UACAGAGAGACAGCAGCACC | 20 | 5107 |

TABLE 11B-continued

| 2nd Tier | | | | |
|---|---|---|---|---|
| gRNA Name | DNA Strand | Targeting Domain | Target Site Length | Seq ID |
| myoC-3112 | + | UCUGAGGAAACACUGUCCCC | 20 | 2867 |
| myoC-749 | + | CUGGAGAGGAAACCUCUGCC | 20 | 1110 |
| myoC-9067 | - | UCACGGGGCUGGGAGUUUUC | 20 | 8813 |
| myoC-2108 | - | CCAGGCACCUCUCAGCACAG | 20 | 2230 |
| myoC-5362 | + | ACCUCAUUGCAGAGGCUUGG | 20 | 5108 |
| myoC-9068 | - | ACAGCGCUGCAGCUGGCCUG | 20 | 8814 |
| myoC-9069 | + | UGAACAACACUGAACAUCUG | 20 | 8815 |
| myoC-3124 | + | UUACACCAGGACUACUGGUG | 20 | 2878 |
| myoC-9070 | + | CUCCACGAAGGUAGGGCAGU | 20 | 8816 |

Table 11C provides exemplary targeting domains for knocking down the MYOC gene selected according to the third tier parameters. The targeting domains bind within 3454-2454 bp upstream of transcription start site or 500 bp upstream and downstream of transcription start site and start with a 5'G. It is contemplated herein that in an embodiment the targeting domain hybridizes to the target domain through complementary base pairing. Any of the targeting domains in the table can be used with a *N. meningitidis* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 11C

| 3rd Tier | | | | |
|---|---|---|---|---|
| gRNA Name | DNA Strand | Targeting Domain | Target Site Length | Seq ID |
| myoC-2654 | - | GGCACCUCUCAGCACAG | 17 | 2610 |
| myoC-9071 | - | GAGCCUUUUUAUCUUUU | 17 | 8817 |
| myoC-5363 | + | GAUUCUCAUUUUCUUGCCUU | 20 | 5109 |

Table 11D provides exemplary targeting domains for knocking down the MYOC gene selected according to the fourth tier parameters. The targeting domains bind within 3454-2454 bp upstream of transcription start site or 500 bp upstream and downstream of transcription start site. It is contemplated herein that in an embodiment the targeting domain hybridizes to the target domain through complementary base pairing. Any of the targeting domains in the table can be used with a *N. meningitidis* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 11D

| 4th Tier | | | | |
|---|---|---|---|---|
| gRNA Name | DNA Strand | Targeting Domain | Target Site Length | Seq ID |
| myoC-3139 | + | CCAGCUCAGAUGCACCA | 17 | 2890 |
| myoC-3084 | + | UGGCUCUGCUCUGGGCA | 17 | 2850 |
| myoC-820 | + | AGGACACCCAGGACCCC | 17 | 1138 |
| myoC-1788 | + | CUCUCCAGGGAGCUGAG | 17 | 2017 |
| myoC-5364 | + | UCUCAUUUUCUUGCCUU | 17 | 5110 |
| myoC-743 | + | CUCAGGACACCCAGGACCCC | 20 | 1107 |
| myoC-5365 | - | UGAGAUGCCAGCUGUCCAGC | 20 | 5111 |
| myoC-1678 | + | AGGCUCUCCAGGGAGCUGAG | 20 | 1939 |
| myoC-9072 | - | UGUGAGCCUUUUUAUCUUUU | 20 | 8818 |

Table 11E provides exemplary targeting domains for knocking down the MYOC gene selected according to the fifth tier parameters. The targeting domains bind within 2484-903 bp upstream of transcription start site or the additional 500 bp upstream and downstream of transcription start site (extending to 1 kb up and downstream of the transcription start site). It is contemplated herein that in an embodiment the targeting domain hybridizes to the target domain through complementary base pairing. Any of the targeting domains in the table can be used with a *N. meningitidis* eiCas9 molecule or eiCas9 fusion protein (e.g., an eiCas9 fused to a transcription repressor domain) to alter the MYOC gene (e.g., reduce or eliminate MYOC gene expression, MYOC protein function, or the level of MYOC protein). One or more gRNA may be used to target an eiCas9 to the promoter region of the MYOC gene.

TABLE 11E

| 5th Tier | | | | |
|---|---|---|---|---|
| gRNA Name | DNA Strand | Targeting Domain | Target Site Length | Seq ID |
| myoC-3150 | + | UUUUCAAAUAUAUAAAA | 17 | 2900 |
| myoC-3128 | - | AGUGUAUGAGCAAGAAA | 17 | 2881 |
| myoC-3147 | + | CUUUAAGCCACUUGAAA | 17 | 2897 |
| myoC-2810 | + | UCUUCCUGUUAAAAGAA | 17 | 2725 |
| myoC-3149 | + | AAACAAAUGAUAAUGAA | 17 | 2899 |
| myoC-2542 | - | GCAGUGGGAAUUGACCA | 17 | 2525 |
| myoC-3132 | - | UCCUAAGAGUAAAGCCA | 17 | 2884 |
| myoC-9073 | - | UCCAGGACCGAGAGCCA | 17 | 8819 |
| myoC-9074 | + | UGAGGACUGAUGGAGCA | 17 | 8820 |
| myoC-9075 | - | AGCUCCUGAGAGCUUCA | 17 | 8821 |
| myoC-2780 | + | UGUGGCUGUUGGGUUCA | 17 | 2702 |
| myoC-9076 | - | AGGCAAUCAUUAUUUCA | 17 | 8822 |
| myoC-9077 | - | CUCAGCCCUGUGGUGGA | 17 | 8823 |

TABLE 11E-continued

| 5th Tier | | | | |
|---|---|---|---|---|
| gRNA Name | DNA Strand | Targeting Domain | Target Site Length | Seq ID |
| myoC-9078 | + | UGACUUGCUCAGAAUUA | 17 | 8824 |
| myoC-9079 | + | CAUAUAGUCAGCAAGAC | 17 | 8825 |
| myoC-3136 | - | AGUGGUAAUAACAGUAC | 17 | 2887 |
| myoC-9080 | + | AGAUUUCCCCCCUCACC | 17 | 8826 |
| myoC-9081 | - | AUUUAUUGGCUAUUGCC | 17 | 8827 |
| myoC-3126 | - | GUUCUGUGAACACUUCC | 17 | 2880 |
| myoC-3151 | + | AGCAUUCCUAUAGAAGC | 17 | 2901 |
| myoC-5371 | + | CCUUGCUACCUCCUGGC | 17 | 5117 |
| myoC-2521 | - | GAGCAAGUGGAAAAUGC | 17 | 2512 |
| myoC-9082 | - | GGGUGAGGGGGGAAAUC | 17 | 8828 |
| myoC-3146 | + | AGAAACACAGUUUGCUC | 17 | 2896 |
| myoC-3141 | + | AGAAAGAAAACCGAGUC | 17 | 2892 |
| myoC-9083 | + | UUUCCUCAUUCAAAUUC | 17 | 8829 |
| myoC-3137 | - | CUUUCUGAGAAGAGUUC | 17 | 2888 |
| myoC-2586 | - | GGUUUAUUAAUGUAAAG | 17 | 2553 |
| myoC-3138 | - | CACACACACAGAGUAAG | 17 | 2889 |
| myoC-3130 | - | UCAAGGGAAGUCGGGAG | 17 | 2882 |
| myoC-9084 | + | AUACUUGAAGGUGAUCG | 17 | 8830 |
| myoC-3085 | + | UGCUUUCCAACCUCCUG | 17 | 2851 |
| myoC-3144 | + | GAUAGUAAACAUCGCUG | 17 | 2894 |
| myoC-9085 | + | ACCUAGGCUUGAAUCUG | 17 | 8831 |
| myoC-3142 | + | UCUCCCGACUUCCCUUG | 17 | 2893 |
| myoC-9086 | - | CCUUUUUUGAACCUUUG | 17 | 8832 |
| myoC-9087 | + | GACUGUAGGUUAAUAAU | 17 | 8833 |
| myoC-3133 | - | CCUAGGUCUUGCUGACU | 17 | 2885 |
| myoC-3134 | - | UUUCAGCGAUGUUUACU | 17 | 2886 |
| myoC-9088 | - | CUAGUAAUUUAGCUCCU | 17 | 8834 |
| myoC-3131 | - | AGGUAGUAACUGAGGCU | 17 | 2883 |
| myoC-9089 | - | UUGUAAAUGUCUCAAGU | 17 | 8835 |
| myoC-9090 | - | UGCAGAGACUAACUGGU | 17 | 8836 |
| myoC-3148 | + | AAUAUAGUAUAAAAUGU | 17 | 2898 |
| myoC-9091 | + | UUGGCAAAUGCCAUUGU | 17 | 8837 |
| myoC-5364 | + | UCUCAUUUUCUUGCCUU | 17 | 5110 |
| myoC-3145 | + | CUAAAGAUUCUAUUCUU | 17 | 2895 |
| myoC-3122 | + | AUGUUUUCAAAUAUAUAAAA | 20 | 2876 |
| myoC-3100 | - | GAUAGUGUAUGAGCAAGAAA | 20 | 2857 |
| myoC-3119 | + | UAACUUUAAGCCACUUGAAA | 20 | 2873 |

TABLE 11E-continued

| 5th Tier | | | | |
|---|---|---|---|---|
| gRNA Name | DNA Strand | Targeting Domain | Target Site Length | Seq ID |
| myoC-2264 | + | UUUUCUUCCUGUUAAAAGAA | 20 | 2345 |
| myoC-3121 | + | AGGAAACAAAUGAUAAUGAA | 20 | 2875 |
| myoC-1996 | - | AGGGCAGUGGGAAUUGACCA | 20 | 2145 |
| myoC-3104 | - | CAUUCCUAAGAGUAAAGCCA | 20 | 2860 |
| myoC-9092 | - | GACUCCAGGACCGAGAGCCA | 20 | 8838 |
| myoC-9093 | + | CAGUGAGGACUGAUGGAGCA | 20 | 8839 |
| myoC-9094 | - | UUUAGCUCCUGAGAGCUUCA | 20 | 8840 |
| myoC-2234 | + | AAAUGUGGCUGUUGGGUUCA | 20 | 2322 |
| myoC-9095 | - | CAAAGGCAAUCAUUAUUUCA | 20 | 8841 |
| myoC-9096 | - | CUACUCAGCCCUGUGGUGGA | 20 | 8842 |
| myoC-9097 | + | UUGUGACUUGCUCAGAAUUA | 20 | 8843 |
| myoC-9098 | + | AAUCAUAUAGUCAGCAAGAC | 20 | 8844 |
| myoC-3108 | - | CAAAGUGGUAAUAACAGUAC | 20 | 2863 |
| myoC-9099 | + | GGCAGAUUUCCCCCCUCACC | 20 | 8845 |
| myoC-9100 | - | UAUAUUUAUUGGCUAUUGCC | 20 | 8846 |
| myoC-3098 | - | CGUGUUCUGUGAACACUUCC | 20 | 2856 |
| myoC-3123 | + | GAGAGCAUUCCUAUAGAAGC | 20 | 2877 |
| myoC-5388 | + | CAGCCUUGCUACCUCCUGGC | 20 | 5134 |
| myoC-1975 | - | CCAGAGCAAGUGGAAAAUGC | 20 | 2132 |
| myoC-9101 | - | UAGGGGUGAGGGGGGAAAUC | 20 | 8847 |
| myoC-3118 | + | UGGAGAAACACAGUUUGCUC | 20 | 2872 |
| myoC-3113 | + | ACCAGAAAGAAAACCGAGUC | 20 | 2868 |
| myoC-9102 | + | UUUUUUCCUCAUUCAAAUUC | 20 | 8848 |
| myoC-3109 | - | CAUCUUUCUGAGAAGAGUUC | 20 | 2864 |
| myoC-2040 | - | UUGGGUUUAUUAAUGUAAAG | 20 | 2173 |

TABLE 11E-continued

| 5th Tier | | | | |
|---|---|---|---|---|
| gRNA Name | DNA Strand | Targeting Domain | Target Site Length | Seq ID |
| myoC-3110 | - | AUGCACACACACAGAGUAAG | 20 | 2865 |
| myoC-3102 | - | AGUUCAAGGGAAGUCGGGAG | 20 | 2858 |
| myoC-9103 | + | GUAAUACUUGAAGGUGAUCG | 20 | 8849 |
| myoC-3083 | + | UGCUGCUUUCCAACCUCCUG | 20 | 2845 |
| myoC-3116 | + | UCAGAUAGUAAACAUCGCUG | 20 | 2870 |
| myoC-9104 | + | AAGACCUAGGCUUGAAUCUG | 20 | 8850 |
| myoC-3114 | + | AGGUCUCCCGACUUCCCUUG | 20 | 2869 |
| myoC-9105 | - | UAUCCUUUUUUGAACCUUUG | 20 | 8851 |
| myoC-9106 | + | CUGGACUGUAGGUUAAUAAU | 20 | 8852 |
| myoC-3105 | - | AAGCCUAGGUCUUGCUGACU | 20 | 2861 |
| myoC-3106 | - | UCAUUUCAGCGAUGUUUACU | 20 | 2862 |
| myoC-8886 | - | UUACUAGUAAUUUAGCUCCU | 20 | 8632 |
| myoC-3103 | - | ACAAGGUAGUAACUGAGGCU | 20 | 2859 |
| myoC-9107 | - | CAUUUGUAAAUGUCUCAAGU | 20 | 8853 |
| myoC-9108 | - | GAAUGCAGAGACUAACUGGU | 20 | 8854 |
| myoC-3120 | + | UGUAAUAUAGUAUAAAAUGU | 20 | 2874 |
| myoC-9109 | + | UUAUUGGCAAAUGCCAUUGU | 20 | 8855 |
| myoC-5363 | + | GAUUCUCAUUUUCUUGCCUU | 20 | 5109 |
| myoC-3117 | + | GCUCUAAAGAUUCUAUUCUU | 20 | 2871 |

Table 12A provides exemplary targeting domains for the mutational hotspot 477-502 target site in the MYOC gene selected according to the first tier parameters. The targeting domains bind within 200 bp upstream from the mutational hotspot 477-502 target site, have a high level of orthogonality and start with a 5'G. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 12A

| 1st Tier | | | | |
|---|---|---|---|---|
| gRNA Name | DNA Strand | Targeting Domain | Target Site Length | SEQ ID NO |
| MYOC-hotspot200up-1 | + | GCUGCUGACGGUGUACA | 17 | 909 |
| MYOC-hotspot200up-2 | + | GCGGUUCUUGAAUGGGA | 17 | 446 |
| MYOC-hotspot200up-3 | - | GCUUAUGACACAGGCAC | 17 | 451 |
| MYOC-hotspot200up-4 | + | GACGGUAGCAUCUGCUG | 17 | 907 |
| MYOC-hotspot200up-5 | - | GGAACUCGAACAAACCU | 17 | 884 |
| MYOC-hotspot200up-6 | + | GUAGCUGCUGACGGUGUACA | 20 | 790 |

TABLE 12A-continued

| 1st Tier | | | | |
|---|---|---|---|---|
| gRNA Name | DNA Strand | Targeting Domain | Target Site Length | SEQ ID NO |
| MYOC-hotspot200up-7 | − | GUCAACUUUGCUUAUGACAC | 20 | 439 |
| MYOC-hotspot200up-8 | + | GGUUCUUGAAUGGGAUGGUC | 20 | 449 |
| MYOC-hotspot200up-9 | + | GUUGACGGUAGCAUCUGCUG | 20 | 788 |
| MYOC-hotspot200up-10 | − | GCCAAUGCCUUCAUCAUCUG | 20 | 768 |
| MYOC-hotspot200up-11 | + | GCCACAGAUGAUGAAGGCAU | 20 | 792 |

Table 12B provides exemplary targeting domains for the mutational hotspot 477-502 target site in the MYOC gene selected according to the second tier parameters. The targeting domains bind within 200 bp upstream from the mutational hotspot 477-502 target site and have a high level of orthogonality. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 12B

| 2nd Tier | | | | |
|---|---|---|---|---|
| gRNA Name | DNA Strand | Targeting Domain | Target Site Length | SEQ ID NO |
| MYOC-hotspot200up-12 | + | UUAUAGCGGUUCUUGAA | 17 | 473 |
| MYOC-hotspot200up-13 | + | UGGCGACUGACUGCUUA | 17 | 912 |
| MYOC-hotspot200up-14 | − | AACUUUGCUUAUGACAC | 17 | 464 |
| MYOC-hotspot200up-15 | − | UGGAACUCGAACAAACC | 17 | 883 |
| MYOC-hotspot200up-16 | + | ACGGAUGUUUGUCUCCC | 17 | 913 |
| MYOC-hotspot200up-17 | + | UCUUGAAUGGGAUGGUC | 17 | 475 |
| MYOC-hotspot200up-18 | + | UGCUGCUGUACUUAUAG | 17 | 472 |
| MYOC-hotspot200up-19 | + | UAUAGCGGUUCUUGAAU | 17 | 474 |
| MYOC-hotspot200up-20 | + | UACUUAUAGCGGUUCUUGAA | 20 | 461 |
| MYOC-hotspot200up-21 | + | AUAGCGGUUCUUGAAUGGGA | 20 | 443 |
| MYOC-hotspot200up-22 | + | CAAGGUGCCACAGAUGAUGA | 20 | 791 |
| MYOC-hotspot200up-23 | + | CAUUGGCGACUGACUGCUUA | 20 | 793 |
| MYOC-hotspot200up-24 | − | UUUGCUUAUGACACAGGCAC | 20 | 453 |
| MYOC-hotspot200up-25 | − | AUCUGGAACUCGAACAAACC | 20 | 766 |
| MYOC-hotspot200up-26 | + | CUUACGGAUGUUUGUCUCCC | 20 | 794 |
| MYOC-hotspot200up-27 | + | ACUUAUAGCGGUUCUUGAAU | 20 | 462 |
| MYOC-hotspot200up-28 | − | UCUGGAACUCGAACAAACCU | 20 | 767 |

Table 12C provides exemplary targeting domains for the mutational hotspot 477-502 target site in the MYOC gene selected according to the third tier parameters. The targeting domains bind within 200 bp upstream from the mutational hotspot 477-502 target site and start with a 5'G. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 12C

| 3rd Tier | | | | |
|---|---|---|---|---|
| gRNA Name | DNA Strand | Targeting Domain | Target Site Length | SEQ ID NO |
| MYOC-hotspot200up-29 | + | GGUGCCACAGAUGAUGA | 17 | 910 |
| MYOC-hotspot200up-30 | + | GUCAUAAGCAAAGUUGA | 17 | 447 |
| MYOC-hotspot200up-31 | + | GUUCUUGAAUGGGAUGGUCA | 20 | 450 |

Table 12D provides exemplary targeting domains for the mutational hotspot 477-502 target site in the MYOC gene selected according to the fourth tier parameters. The targeting domains bind within 200 bp upstream from the mutational hotspot 477-502 target site. It is contemplated herein that in an embodiment the targeting domain hybridizes to the target domain through complementary base pairing. Any of the targeting domains in the table can be used with a *S. pyogenes* Cas9 molecule that generates a double stranded break (Cas9 nuclease) or a single-stranded break (Cas9 nickase).

TABLE 12D

| 4th Tier | | | | |
|---|---|---|---|---|
| gRNA Name | DNA Strand | Targeting Domain | Target Site Length | SEQ ID NO |
| MYOC-hotspot200up-32 | + | CUUGAAUGGGAUGGUCA | 17 | 476 |
| MYOC-hotspot200up-33 | + | UGAGGUGUAGCUGCUGA | 17 | 908 |
| MYOC-hotspot200up-34 | - | AAUGCCUUCAUCAUCUG | 17 | 885 |
| MYOC-hotspot200up-35 | + | ACAGAUGAUGAAGGCAU | 17 | 911 |
| MYOC-hotspot200up-36 | + | UGCUGAGGUGUAGCUGCUGA | 20 | 789 |
| MYOC-hotspot200up-37 | + | UGUGUCAUAAGCAAAGUUGA | 20 | 463 |

Table 13A provides exemplary targeting domains for the mutational hotspot 477-502 target site in the MYOC gene selected according to the first tier parameters. The targeting domains bind within 200 bp upstream from the mutational hotspot 477-502 target site, have a high level of orthogonality, start with a 5'G, and PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 13A

| 1st Tier | | | | |
|---|---|---|---|---|
| gRNA Name | DNA Strand | Targeting Domain | Target Site Length | SEQ ID NO |
| MYOC-hotspot200up-38 | + | GUACUUAUAGCGGUUCUUGAA | 21 | 3535 |
| MYOC-hotspot200up-39 | + | GCUGUACUUAUAGCGGUUCUUGAA | 24 | 3536 |
| MYOC-hotspot200up-40 | + | GCUGCUGUACUUAUAGCGGUUC | 22 | 3553 |
| MYOC-hotspot200up-41 | + | GCGGUUCUUGAAUGGGAUGGU | 21 | 3564 |
| MYOC-hotspot200up-42 | + | GAUGUUUGUCUCCCAGGUUUGU | 22 | 3566 |
| MYOC-hotspot200up-43 | + | GGAUGUUUGUCUCCCAGGUUUGU | 23 | 3567 |

Table 13B provides exemplary targeting domains for the mutational hotspot 477-502 target site in the MYOC gene selected according to the second tier parameters. The targeting domains bind within 200 bp upstream from the mutational hotspot 477-502 target site, have a high level of orthogonality and PAM is NNGRRT. It is contemplated herein that in an embodiment the targeting domain hybridizes to the target domain through complementary base pairing. Any of the targeting domains in the table can be used with a *S. aureus* Cas9 molecule that generates a double stranded break (Cas9 nuclease) or a single-stranded break (Cas9 nickase).

TABLE 13B

2nd Tier

| gRNA Name | DNA Strand | Targeting Domain | Target Site Length | SEQ ID NO |
|---|---|---|---|---|
| MYOC-hotspot200up-44 | + | UGUACUUAUAGCGGUUCUUGAA | 22 | 3612 |
| MYOC-hotspot200up-45 | + | CUGUACUUAUAGCGGUUCUUGAA | 23 | 3613 |
| MYOC-hotspot200up-46 | + | CUGCUGUACUUAUAGCGGUUC | 21 | 3658 |
| MYOC-hotspot200up-47 | + | UGCUGCUGUACUUAUAGCGGUUC | 23 | 3659 |
| MYOC-hotspot200up-48 | + | AUGCUGCUGUACUUAUAGCGGUUC | 24 | 3660 |
| MYOC-hotspot200up-49 | + | AGCGGUUCUUGAAUGGGAUGGU | 22 | 3680 |
| MYOC-hotspot200up-50 | + | UAGCGGUUCUUGAAUGGGAUGGU | 23 | 3681 |
| MYOC-hotspot200up-51 | + | AUAGCGGUUCUUGAAUGGGAUGGU | 24 | 3682 |
| MYOC-hotspot200up-52 | + | AUGUUUGUCUCCCAGGUUUGU | 21 | 3690 |
| MYOC-hotspot200up-53 | + | CGGAUGUUUGUCUCCCAGGUUUGU | 24 | 3691 |

Table 13C provides exemplary targeting domains for the mutational hotspot 477-502 target site in the MYOC gene selected according to the third tier parameters. The targeting domains bind within 200 bp upstream from the mutational hotspot 477-502 target site, start with a 5' G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 13C

3rd Tier

| gRNA Name | DNA Strand | Targeting Domain | Target Site Length | SEQ ID NO |
|---|---|---|---|---|
| MYOC-hotspot200up-54 | + | GCUGUACUUAUAGCGGUUC | 19 | 3552 |
| MYOC-hotspot200up-55 | + | GUUCUUGAAUGGGAUGGU | 18 | 3562 |
| MYOC-hotspot200up-56 | + | GGUUCUUGAAUGGGAUGGU | 19 | 3563 |
| MYOC-hotspot200up-57 | + | GUUUGUCUCCCAGGUUUGU | 19 | 3565 |
| MYOC-hotspot200up-58 | + | GCAUUGGCGACUGACUGCUU | 20 | 2793 |
| MYOC-hotspot200up-59 | + | GGCAUUGGCGACUGACUGCUU | 21 | 3571 |
| MYOC-hotspot200up-60 | + | GAAGGCAUUGGCGACUGACUGCUU | 24 | 3572 |

Table 13D provides exemplary targeting domains for the mutational hotspot 477-502 target site in the MYOC gene selected according to the fourth tier parameters. The targeting domains bind within 200 bp upstream from the mutational hotspot 477-502 target site, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 13D

4th Tier

| gRNA Name | DNA Strand | Targeting Domain | Target Site Length | SEQ ID NO |
|---|---|---|---|---|
| MYOC-hotspot200up-61 | + | CUUAUAGCGGUUCUUGAA | 18 | 3610 |
| MYOC-hotspot200up-62 | + | ACUUAUAGCGGUUCUUGAA | 19 | 3611 |
| MYOC-hotspot200up-20 | + | UACUUAUAGCGGUUCUUGAA | 20 | 461 |
| MYOC-hotspot200up-63 | + | CUGUACUUAUAGCGGUUC | 18 | 3657 |
| MYOC-hotspot200up-64 | + | UGCUGUACUUAUAGCGGUUC | 20 | 1856 |
| MYOC-hotspot200up-65 | + | CGGUUCUUGAAUGGGAUGGU | 20 | 1854 |
| MYOC-hotspot200up-66 | + | UUUGUCUCCCAGGUUUGU | 18 | 3689 |
| MYOC-hotspot200up-67 | + | UGUUUGUCUCCCAGGUUUGU | 20 | 2792 |
| MYOC-hotspot200up-68 | + | AUUGGCGACUGACUGCUU | 18 | 3695 |
| MYOC-hotspot200up-69 | + | CAUUGGCGACUGACUGCUU | 19 | 3696 |
| MYOC-hotspot200up-70 | + | AGGCAUUGGCGACUGACUGCUU | 22 | 3697 |
| MYOC-hotspot200up-71 | + | AAGGCAUUGGCGACUGACUGCUU | 23 | 3698 |

Table 13E provides exemplary targeting domains for the mutational hotspot 477-502 target site in the MYOC gene selected according to the fifth tier parameters. The targeting domains bind within 200 bp upstream from the mutational hotspot 477-502 target site, and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 13E

5th Tier

| gRNA Name | DNA Strand | Targeting Domain | Target Site Length | SEQ ID NO |
|---|---|---|---|---|
| MYOC-hotspot200up-72 | + | ACUUAUAGCGGUUCUUGA | 18 | 3906 |
| MYOC-hotspot200up-73 | + | UACUUAUAGCGGUUCUUGA | 19 | 3907 |
| MYOC-hotspot200up-74 | + | GUACUUAUAGCGGUUCUUGA | 20 | 1855 |
| MYOC-hotspot200up-75 | + | UGUACUUAUAGCGGUUCUUGA | 21 | 3908 |
| MYOC-hotspot200up-76 | + | CUGUACUUAUAGCGGUUCUUGA | 22 | 3909 |
| MYOC-hotspot200up-77 | + | GCUGUACUUAUAGCGGUUCUUGA | 23 | 3910 |
| MYOC-hotspot200up-78 | + | UGCUGUACUUAUAGCGGUUCUUGA | 24 | 3911 |
| MYOC-hotspot200up-79 | + | UACAAGGUGCCACAGAUG | 18 | 4158 |
| MYOC-hotspot200up-80 | + | GUACAAGGUGCCACAGAUG | 19 | 4159 |

TABLE 13E-continued

| 5th Tier | | | | |
|---|---|---|---|---|
| gRNA Name | DNA Strand | Targeting Domain | Target Site Length | SEQ ID NO |
| MYOC-hotspot200up-81 | + | UGUACAAGGUGCCACAGAUG | 20 | 2794 |
| MYOC-hotspot200up-82 | + | GUGUACAAGGUGCCACAGAUG | 21 | 4160 |
| MYOC-hotspot200up-83 | + | GGUGUACAAGGUGCCACAGAUG | 22 | 4161 |
| MYOC-hotspot200up-84 | + | CGGUGUACAAGGUGCCACAGAUG | 23 | 4162 |
| MYOC-hotspot200up-85 | + | ACGGUGUACAAGGUGCCACAGAUG | 24 | 4163 |
| MYOC-hotspot200up-86 | + | AGUUGACGGUAGCAUCUG | 18 | 4178 |
| MYOC-hotspot200up-87 | + | AAGUUGACGGUAGCAUCUG | 19 | 4179 |
| MYOC-hotspot200up-88 | + | AAAGUUGACGGUAGCAUCUG | 20 | 1853 |
| MYOC-hotspot200up-89 | + | CAAAGUUGACGGUAGCAUCUG | 21 | 4180 |
| MYOC-hotspot200up-90 | + | GCAAAGUUGACGGUAGCAUCUG | 22 | 4181 |
| MYOC-hotspot200up-91 | + | AGCAAAGUUGACGGUAGCAUCUG | 23 | 4182 |
| MYOC-hotspot200up-92 | + | AAGCAAAGUUGACGGUAGCAUCUG | 24 | 4183 |
| MYOC-hotspot200up-93 | - | CUGGAACUCGAACAAACC | 18 | 4537 |
| MYOC-hotspot200up-94 | - | UCUGGAACUCGAACAAACC | 19 | 4538 |
| MYOC-hotspot200up-25 | - | AUCUGGAACUCGAACAAACC | 20 | 766 |
| MYOC-hotspot200up-95 | - | ACCCUGACCAUCCCAUUC | 18 | 4673 |
| MYOC-hotspot200up-96 | - | GACCCUGACCAUCCCAUUC | 19 | 4674 |
| MYOC-hotspot200up-97 | - | AGACCCUGACCAUCCCAUUC | 20 | 1846 |
| MYOC-hotspot200up-98 | - | AAGACCCUGACCAUCCCAUUC | 21 | 4675 |
| MYOC-hotspot200up-99 | - | CAAGACCCUGACCAUCCCAUUC | 22 | 4676 |
| MYOC-hotspot200up-100 | - | GCAAGACCCUGACCAUCCCAUUC | 23 | 4677 |
| MYOC-hotspot200up-101 | - | AGCAAGACCCUGACCAUCCCAUUC | 24 | 4678 |
| MYOC-hotspot200up-102 | - | UGGAACUCGAACAAACCU | 18 | 4978 |
| MYOC-hotspot200up-103 | - | CUGGAACUCGAACAAACCU | 19 | 4979 |
| MYOC-hotspot200up-28 | - | UCUGGAACUCGAACAAACCU | 20 | 767 |

Table 14A provides exemplary targeting domains for the mutational hotspot 477-502 target site in the MYOC gene selected according to the second tier parameters. The targeting domains bind within 200 bp upstream from the mutational hotspot 477-502 target site, have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 14A

| 2nd Tier | | | | |
|---|---|---|---|---|
| gRNA Name | DNA Strand | Targeting Domain | Target Site Length | SEQ ID NO |
| MYOC-hotspot200up-104 | - | UCAGCAGAUGCUACCGUCAA | 20 | 5129 |

Table 14B provides exemplary targeting domains for the mutational hotspot 477-502 target site in the MYOC gene selected according to the third tier parameters. The targeting domains bind within 200 bp upstream from the mutational hotspot 477-502 target site and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 14B

| 3rd Tier | | | | |
|---|---|---|---|---|
| gRNA Name | DNA Strand | Targeting Domain | Target Site Length | SEQ ID NO |
| MYOC-hotspot200up-105 | - | GCAGAUGCUACCGUCAA | 17 | 5112 |

Table 14C provides exemplary targeting domains for the mutational hotspot 477-502 target site in the MYOC gene selected according to the fourth tier parameters. The targeting domains bind within 200 bp upstream from the mutational hotspot 477-502 target site. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 14C

| 4th Tier | | | | |
|---|---|---|---|---|
| gRNA Name | DNA Strand | Targeting Domain | Target Site Length | SEQ ID NO |
| MYOC-hotspot200up-106 | + | UGAAGGCAUUGGCGACU | 17 | 5124 |
| MYOC-hotspot200up-107 | + | UGAUGAAGGCAUUGGCGACU | 20 | 5140 |

Table 15A provides exemplary targeting domains for the mutational hotspot 477-502 target site in the MYOC gene selected according to the first tier parameters. The targeting domains bind within 200 bp downstream from the mutational hotspot 477-502 target site, have a high level of orthogonality and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 15A

| 1st Tier | | | | |
|---|---|---|---|---|
| gRNA Name | DNA Strand | Targeting Domain | Target Site Length | SEQ ID NO |
| MYOC-hotspot200down-1 | - | GCUGUACAGGCAAUGGCAGA | 20 | 771 |
| MYOC-hotspot200down-2 | - | GAAAAGCCUCCAAGCUGUAC | 20 | 769 |
| MYOC-hotspot200down-3 | + | GGUGACCAUGUUCAUCCUUC | 20 | 852 |

Table 15B provides exemplary targeting domains for the mutational hotspot 477-502 target site in the MYOC gene selected according to the second tier parameters. The targeting domains bind within 200 bp downstream from the mutational hotspot 477-502 target site and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 15B

| 2nd Tier | | | | |
|---|---|---|---|---|
| gRNA Name | DNA Strand | Targeting Domain | Target Site Length | SEQ ID NO |
| MYOC-hotspot200down-4 | + | AUUCCUGAAUAGUUAGA | 17 | 971 |
| MYOC-hotspot200down-5 | - | CAGGAAUUGUAGUCUGA | 17 | 949 |
| MYOC-hotspot200down-6 | - | AAGCCUCCAAGCUGUAC | 17 | 887 |
| MYOC-hotspot200down-7 | - | UCACCAUCUAACUAUUC | 17 | 947 |
| MYOC-hotspot200down-8 | + | UUGCCUGUACAGCUUGG | 17 | 906 |
| MYOC-hotspot200down-9 | - | CCUCCAAGCUGUACAGGCAA | 20 | 770 |
| MYOC-hotspot200down-10 | - | UUAAUCCAGAAGGAUGAACA | 20 | 826 |
| MYOC-hotspot200down-11 | - | CAAGUUUUCAUUAAUCCAGA | 20 | 825 |
| MYOC-hotspot200down-12 | + | ACAAUUCCUGAAUAGUUAGA | 20 | 851 |
| MYOC-hotspot200down-13 | - | AUUCAGGAAUUGUAGUCUGA | 20 | 829 |
| MYOC-hotspot200down-14 | + | CCCUUCAGCCUGCUCCCCCC | 20 | 785 |
| MYOC-hotspot200down-15 | + | AGUCAAAGCUGCCUGGGCCC | 20 | 1802 |
| MYOC-hotspot200down-16 | - | AAGGAGAUGCUCAGGGCUCC | 20 | 774 |
| MYOC-hotspot200down-17 | + | AAAGCUGCCUGGGCCCUGGC | 20 | 1803 |
| MYOC-hotspot200down-18 | - | UGGUCACCAUCUAACUAUUC | 20 | 827 |
| MYOC-hotspot200down-19 | + | CCAUUGCCUGUACAGCUUGG | 20 | 787 |
| MYOC-hotspot200down-20 | + | CUUCUGGAUUAAUGAAAACU | 20 | 853 |
| MYOC-hotspot200down-21 | - | AGGAGAUGCUCAGGGCUCCU | 20 | 775 |
| MYOC-hotspot200down-22 | + | CUGCCAUUGCCUGUACAGCU | 20 | 786 |

Table 15C provides exemplary targeting domains for the mutational hotspot 477-502 target site in the MYOC gene selected according to the third tier parameters. The targeting domains bind within 200 bp downstream from the mutational hotspot 477-502 target site and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 15C

| 3rd Tier | | | | |
|---|---|---|---|---|
| gRNA Name | DNA Strand | Targeting Domain | Target Site Length | SEQ ID NO |
| MYOC-hotspot200down-23 | - | GGGGGGAGCAGGCUGAA | 17 | 899 |
| MYOC-hotspot200down-24 | - | GGAGAGCCAGCCAGCCA | 17 | 901 |
| MYOC-hotspot200down-25 | - | GCAGAAGGAGAUGCUCA | 17 | 891 |
| MYOC-hotspot200down-26 | - | GUUUUCAUUAAUCCAGA | 17 | 945 |
| MYOC-hotspot200down-27 | - | GUACAGGCAAUGGCAGA | 17 | 889 |
| MYOC-hotspot200down-28 | - | GGGAGAGCCAGCCAGCC | 17 | 900 |
| MYOC-hotspot200down-29 | - | GAGAUGCUCAGGGCUCC | 17 | 892 |

TABLE 15C-continued

| 3rd Tier | | | | |
|---|---|---|---|---|
| gRNA Name | DNA Strand | Targeting Domain | Target Site Length | SEQ ID NO |
| MYOC-hotspot200down-30 | − | GGGCUCCUGGGGGGAGC | 17 | 897 |
| MYOC-hotspot200down-31 | + | GCUGCCUGGGCCCUGGC | 17 | 1801 |
| MYOC-hotspot200down-32 | − | GGCAGAAGGAGAUGCUC | 17 | 890 |
| MYOC-hotspot200down-33 | + | GACCAUGUUCAUCCUUC | 17 | 972 |
| MYOC-hotspot200down-34 | − | GAUGCUCAGGGCUCCUG | 17 | 894 |
| MYOC-hotspot200down-35 | − | GAGCCAGCCAGCCAGGGCCC | 20 | 784 |
| MYOC-hotspot200down-36 | − | GAAGGGAGAGCCAGCCAGCC | 20 | 782 |
| MYOC-hotspot200down-37 | + | GGAAAGCAGUCAAAGCUGCC | 20 | 854 |
| MYOC-hotspot200down-38 | − | GAGAUGCUCAGGGCUCCUGG | 20 | 777 |
| MYOC-hotspot200down-39 | − | GGAGAUGCUCAGGGCUCCUG | 20 | 776 |
| MYOC-hotspot200down-40 | + | GAAAGCAGUCAAAGCUGCCU | 20 | 855 |

Table 15D provides exemplary targeting domains for the mutational hotspot 477-502 target site in the MYOC gene selected according to the fourth tier parameters. The targeting domains bind within 200 bp downstream from the mutational hotspot 477-502 target site. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 15D

| 4th Tier | | | | |
|---|---|---|---|---|
| gRNA Name | DNA Strand | Targeting Domain | Target Site Length | SEQ ID NO |
| MYOC-hotspot200down-41 | − | CCAAGCUGUACAGGCAA | 17 | 888 |
| MYOC-hotspot200down-42 | − | AUCCAGAAGGAUGAACA | 17 | 946 |
| MYOC-hotspot200down-43 | − | UGGGGGGAGCAGGCUGA | 17 | 898 |
| MYOC-hotspot200down-44 | + | UUCAGCCUGCUCCCCCC | 17 | 904 |
| MYOC-hotspot200down-45 | − | CCAGCCAGCCAGGGCCC | 17 | 902 |
| MYOC-hotspot200down-46 | + | CAAAGCUGCCUGGGCCC | 17 | 1805 |
| MYOC-hotspot200down-47 | + | AAGCAGUCAAAGCUGCC | 17 | 974 |
| MYOC-hotspot200down-48 | + | CCUGGGCCCUGGCUGGC | 17 | 903 |
| MYOC-hotspot200down-49 | − | UGCUCAGGGCUCCUGGG | 17 | 896 |
| MYOC-hotspot200down-50 | − | AUGCUCAGGGCUCCUGG | 17 | 895 |
| MYOC-hotspot200down-51 | − | UCAGGAAUUGUAGUCUG | 17 | 948 |
| MYOC-hotspot200down-52 | + | CUGGAUUAAUGAAAACU | 17 | 973 |
| MYOC-hotspot200down-53 | + | AGCAGUCAAAGCUGCCU | 17 | 975 |
| MYOC-hotspot200down-54 | − | AGAUGCUCAGGGCUCCU | 17 | 893 |
| MYOC-hotspot200down-55 | + | CCAUUGCCUGUACAGCU | 17 | 905 |
| MYOC-hotspot200down-56 | − | CCUGGGGGGAGCAGGCUGAA | 20 | 781 |

TABLE 15D-continued

| 4th Tier | | | | |
|---|---|---|---|---|
| gRNA Name | DNA Strand | Targeting Domain | Target Site Length | SEQ ID NO |
| MYOC-hotspot200down-57 | − | AAGGGAGAGCCAGCCAGCCA | 20 | 783 |
| MYOC-hotspot200down-58 | − | AUGGCAGAAGGAGAUGCUCA | 20 | 773 |
| MYOC-hotspot200down-59 | − | UCCUGGGGGGAGCAGGCUGA | 20 | 780 |
| MYOC-hotspot200down-60 | − | UCAGGGCUCCUGGGGGGAGC | 20 | 779 |
| MYOC-hotspot200down-61 | + | CUGCCUGGGCCCUGGCUGGC | 20 | 1804 |
| MYOC-hotspot200down-62 | − | AAUGGCAGAAGGAGAUGCUC | 20 | 772 |
| MYOC-hotspot200down-63 | − | AGAUGCUCAGGGCUCCUGGG | 20 | 778 |
| MYOC-hotspot200down-64 | − | UAUUCAGGAAUUGUAGUCUG | 20 | 828 |

Table 16A provides exemplary targeting domains for the mutational hotspot 477-502 target site in the MYOC gene selected according to the first tier parameters. The targeting domains bind within 200 bp downstream from the mutational hotspot 477-502 target site, have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 16A

| 1st Tier | | | | |
|---|---|---|---|---|
| gRNA Name | DNA Strand | Targeting Domain | Target Site Length | SEQ ID NO |
| MYOC-hotspot200down-65 | + | GUCUACGCCCUCAGACUACAAUUC | 24 | 3551 |
| MYOC-hotspot200down-66 | + | GAUGGUGACCAUGUUCAUCCUU | 22 | 3570 |

Table 16B provides exemplary targeting domains for the mutational hotspot 477-502 target site in the MYOC gene selected according to the second tier parameters. The targeting domains bind within 200 bp downstream from the mutational hotspot 477-502 target site, have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 16B

| 2nd Tier | | | | |
|---|---|---|---|---|
| gRNA Name | DNA Strand | Targeting Domain | Target Site Length | SEQ ID NO |
| MYOC-hotspot200down-67 | + | UACGCCCUCAGACUACAAUUC | 21 | 3654 |
| MYOC-hotspot200down-68 | + | CUACGCCCUCAGACUACAAUUC | 22 | 3655 |
| MYOC-hotspot200down-69 | + | UCUACGCCCUCAGACUACAAUUC | 23 | 3656 |
| MYOC-hotspot200down-70 | + | AUGGUGACCAUGUUCAUCCUU | 21 | 3692 |
| MYOC-hotspot200down-71 | + | AGAUGGUGACCAUGUUCAUCCUU | 23 | 3693 |

TABLE 16B-continued

| 2nd Tier | | | | |
|---|---|---|---|---|
| gRNA Name | DNA Strand | Targeting Domain | Target Site Length | SEQ ID NO |
| MYOC-hotspot200down-72 | + | UAGAUGGUGACCAUGUUCAUCCUU | 24 | 3694 |
| MYOC-hotspot200down-73 | - | AUGGUCACCAUCUAACUAUUC | 21 | 3740 |
| MYOC-hotspot200down-74 | - | CAUGGUCACCAUCUAACUAUUC | 22 | 3741 |
| MYOC-hotspot200down-75 | - | ACAUGGUCACCAUCUAACUAUUC | 23 | 3742 |
| MYOC-hotspot200down-76 | - | AACAUGGUCACCAUCUAACUAUUC | 24 | 3743 |

Table 16C provides exemplary targeting domains for the mutational hotspot 477-502 target site in the MYOC gene selected according to the third tier parameters. The targeting domains bind within 200 bp downstream from the mutational hotspot 477-502 target site, start with a 5' G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 16C

| 3rd Tier | | | | |
|---|---|---|---|---|
| gRNA Name | DNA Strand | Targeting Domain | Target Site Length | SEQ ID NO |
| MYOC-hotspot200down-77 | + | GCCCUCAGACUACAAUUC | 18 | 3550 |
| MYOC-hotspot200down-78 | + | GUGACCAUGUUCAUCCUU | 18 | 3568 |
| MYOC-hotspot200down-79 | + | GGUGACCAUGUUCAUCCUU | 19 | 3569 |
| MYOC-hotspot200down-80 | - | GUCACCAUCUAACUAUUC | 18 | 3586 |
| MYOC-hotspot200down-81 | - | GGUCACCAUCUAACUAUUC | 19 | 3587 |

Table 16D provides exemplary targeting domains for the mutational hotspot 477-502 target site in the MYOC gene selected according to the fourth tier parameters. The targeting domains bind within 200 bp downstream from the mutational hotspot 477-502 target site, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 16D

| 4th Tier | | | | |
|---|---|---|---|---|
| gRNA Name | DNA Strand | Targeting Domain | Target Site Length | SEQ ID NO |
| MYOC-hotspot200down-82 | + | CGCCCUCAGACUACAAUUC | 19 | 3653 |
| MYOC-hotspot200down-83 | + | ACGCCCUCAGACUACAAUUC | 20 | 2816 |
| MYOC-hotspot200down-84 | + | UGGUGACCAUGUUCAUCCUU | 20 | 2815 |
| MYOC-hotspot200down-18 | - | UGGUCACCAUCUAACUAUUC | 20 | 827 |
| MYOC-hotspot200down-85 | - | AAGUUUUCAUUAAUCCAG | 18 | 3761 |
| MYOC-hotspot200down-86 | - | CAAGUUUUCAUUAAUCCAG | 19 | 3762 |

TABLE 16D-continued

| 4th Tier | | | | |
|---|---|---|---|---|
| gRNA Name | DNA Strand | Targeting Domain | Target Site Length | SEQ ID NO |
| MYOC-hotspot200down-87 | - | CCAAGUUUUCAUUAAUCCAG | 20 | 2804 |
| MYOC-hotspot200down-88 | - | UCCAAGUUUUCAUUAAUCCAG | 21 | 3763 |
| MYOC-hotspot200down-89 | - | UUCCAAGUUUUCAUUAAUCCAG | 22 | 3764 |
| MYOC-hotspot200down-90 | - | UUUCCAAGUUUUCAUUAAUCCAG | 23 | 3765 |
| MYOC-hotspot200down-91 | - | CUUUCCAAGUUUUCAUUAAUCCAG | 24 | 3766 |

Table 16E provides exemplary targeting domains for the mutational hotspot 477-502 target site in the MYOC gene selected according to the fifth tier parameters. The targeting domains bind within 200 bp downstream from the mutational hotspot 477-502 target site, and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 16E

| 5th Tier | | | | |
|---|---|---|---|---|
| gRNA Name | DNA Strand | Targeting Domain | Target Site Length | SEQ ID NO |
| MYOC-hotspot200down-92 | + | GUUCAUCCUUCUGGAUUA | 18 | 3918 |
| MYOC-hotspot200down-93 | + | UGUUCAUCCUUCUGGAUUA | 19 | 3919 |
| MYOC-hotspot200down-94 | + | AUGUUCAUCCUUCUGGAUUA | 20 | 2814 |
| MYOC-hotspot200down-95 | + | CAUGUUCAUCCUUCUGGAUUA | 21 | 3920 |
| MYOC-hotspot200down-96 | + | CCAUGUUCAUCCUUCUGGAUUA | 22 | 3921 |
| MYOC-hotspot200down-97 | + | ACCAUGUUCAUCCUUCUGGAUUA | 23 | 3922 |
| MYOC-hotspot200down-98 | + | GACCAUGUUCAUCCUUCUGGAUUA | 24 | 3923 |
| MYOC-hotspot200down-99 | + | UUCUGGAUUAAUGAAAAC | 18 | 3931 |
| MYOC-hotspot200down-100 | + | CUUCUGGAUUAAUGAAAAC | 19 | 3932 |
| MYOC-hotspot200down-101 | + | CCUUCUGGAUUAAUGAAAAC | 20 | 2813 |
| MYOC-hotspot200down-102 | + | UCCUUCUGGAUUAAUGAAAAC | 21 | 3933 |
| MYOC-hotspot200down-103 | + | AUCCUUCUGGAUUAAUGAAAAC | 22 | 3934 |
| MYOC-hotspot200down-104 | + | CAUCCUUCUGGAUUAAUGAAAAC | 23 | 3935 |
| MYOC-hotspot200down-105 | + | UCAUCCUUCUGGAUUAAUGAAAAC | 24 | 3936 |
| MYOC-hotspot200down-106 | + | CUUCAGCCUGCUCCCCCC | 18 | 3956 |
| MYOC-hotspot200down-107 | + | CCUUCAGCCUGCUCCCCCC | 19 | 3957 |
| MYOC-hotspot200down-14 | + | CCCUUCAGCCUGCUCCCCCC | 20 | 785 |
| MYOC-hotspot200down-108 | + | UCCCUUCAGCCUGCUCCCCCC | 21 | 3958 |
| MYOC-hotspot200down-109 | + | CUCCCUUCAGCCUGCUCCCCCC | 22 | 3959 |
| MYOC-hotspot200down-110 | + | UCUCCCUUCAGCCUGCUCCCCCC | 23 | 3960 |
| MYOC-hotspot200down-111 | + | CUCUCCCUUCAGCCUGCUCCCCCC | 24 | 3961 |
| MYOC-hotspot200down-112 | + | CCUUCAGCCUGCUCCCCC | 18 | 3962 |

TABLE 16E-continued

| 5th Tier | | | | |
|---|---|---|---|---|
| gRNA Name | DNA Strand | Targeting Domain | Target Site Length | SEQ ID NO |
| MYOC-hotspot200down-113 | + | CCCUUCAGCCUGCUCCCCC | 19 | 3963 |
| MYOC-hotspot200down-114 | + | UCCCUUCAGCCUGCUCCCCC | 20 | 2811 |
| MYOC-hotspot200down-115 | + | CUCCCUUCAGCCUGCUCCCCC | 21 | 3964 |
| MYOC-hotspot200down-116 | + | UCUCCCUUCAGCCUGCUCCCCC | 22 | 3965 |
| MYOC-hotspot200down-117 | + | CUCUCCCUUCAGCCUGCUCCCCC | 23 | 3966 |
| MYOC-hotspot200down-118 | + | GCUCUCCCUUCAGCCUGCUCCCCC | 24 | 3967 |
| MYOC-hotspot200down-119 | + | CUGCUCCCCCCAGGAGCC | 18 | 3974 |
| MYOC-hotspot200down-120 | + | CCUGCUCCCCCCAGGAGCC | 19 | 3975 |
| MYOC-hotspot200down-121 | + | GCCUGCUCCCCCCAGGAGCC | 20 | 2810 |
| MYOC-hotspot200down-122 | + | AGCCUGCUCCCCCCAGGAGCC | 21 | 3976 |
| MYOC-hotspot200down-123 | + | CAGCCUGCUCCCCCCAGGAGCC | 22 | 3977 |
| MYOC-hotspot200down-124 | + | UCAGCCUGCUCCCCCCAGGAGCC | 23 | 3978 |
| MYOC-hotspot200down-125 | + | UUCAGCCUGCUCCCCCCAGGAGCC | 24 | 3979 |
| MYOC-hotspot200down-126 | + | UGCCAUUGCCUGUACAGC | 18 | 4011 |
| MYOC-hotspot200down-127 | + | CUGCCAUUGCCUGUACAGC | 19 | 4012 |
| MYOC-hotspot200down-128 | + | UCUGCCAUUGCCUGUACAGC | 20 | 2809 |
| MYOC-hotspot200down-129 | + | UUCUGCCAUUGCCUGUACAGC | 21 | 4013 |
| MYOC-hotspot200down-130 | + | CUUCUGCCAUUGCCUGUACAGC | 22 | 4014 |
| MYOC-hotspot200down-131 | + | CCUUCUGCCAUUGCCUGUACAGC | 23 | 4015 |
| MYOC-hotspot200down-132 | + | UCCUUCUGCCAUUGCCUGUACAGC | 24 | 4016 |
| MYOC-hotspot200down-133 | + | GAAAGCAGUCAAAGCUGC | 18 | 4052 |
| MYOC-hotspot200down-134 | + | GGAAAGCAGUCAAAGCUGC | 19 | 4053 |
| MYOC-hotspot200down-135 | + | UGGAAAGCAGUCAAAGCUGC | 20 | 2812 |
| MYOC-hotspot200down-136 | + | UUGGAAAGCAGUCAAAGCUGC | 21 | 4054 |
| MYOC-hotspot200down-137 | + | CUUGGAAAGCAGUCAAAGCUGC | 22 | 4055 |
| MYOC-hotspot200down-138 | + | ACUUGGAAAGCAGUCAAAGCUGC | 23 | 4056 |
| MYOC-hotspot200down-139 | + | AACUUGGAAAGCAGUCAAAGCUGC | 24 | 4057 |
| MYOC-hotspot200down-140 | + | UCUGGAUUAAUGAAAACU | 18 | 4252 |
| MYOC-hotspot200down-141 | + | UUCUGGAUUAAUGAAAACU | 19 | 4253 |
| MYOC-hotspot200down-20 | + | CUUCUGGAUUAAUGAAAACU | 20 | 853 |
| MYOC-hotspot200down-142 | + | CCUUCUGGAUUAAUGAAAACU | 21 | 4254 |
| MYOC-hotspot200down-143 | + | UCCUUCUGGAUUAAUGAAAACU | 22 | 4255 |
| MYOC-hotspot200down-144 | + | AUCCUUCUGGAUUAAUGAAAACU | 23 | 4256 |
| MYOC-hotspot200down-145 | + | CAUCCUUCUGGAUUAAUGAAAACU | 24 | 4257 |
| MYOC-hotspot200down-146 | + | GCCAUUGCCUGUACAGCU | 18 | 4265 |
| MYOC-hotspot200down-147 | + | UGCCAUUGCCUGUACAGCU | 19 | 4266 |
| MYOC-hotspot200down-22 | + | CUGCCAUUGCCUGUACAGCU | 20 | 786 |

TABLE 16E-continued

| 5th Tier | | | | |
|---|---|---|---|---|
| gRNA Name | DNA Strand | Targeting Domain | Target Site Length | SEQ ID NO |
| MYOC-hotspot200down-148 | + | UCUGCCAUUGCCUGUACAGCU | 21 | 4267 |
| MYOC-hotspot200down-149 | + | UUCUGCCAUUGCCUGUACAGCU | 22 | 4268 |
| MYOC-hotspot200down-150 | + | CUUCUGCCAUUGCCUGUACAGCU | 23 | 4269 |
| MYOC-hotspot200down-151 | + | CCUUCUGCCAUUGCCUGUACAGCU | 24 | 4270 |
| MYOC-hotspot200down-152 | - | UGGGGGGAGCAGGCUGAA | 18 | 4370 |
| MYOC-hotspot200down-153 | - | CUGGGGGGAGCAGGCUGAA | 19 | 4371 |
| MYOC-hotspot200down-56 | - | CCUGGGGGGAGCAGGCUGAA | 20 | 781 |
| MYOC-hotspot200down-154 | - | UCCUGGGGGGAGCAGGCUGAA | 21 | 4372 |
| MYOC-hotspot200down-155 | - | CUCCUGGGGGGAGCAGGCUGAA | 22 | 4373 |
| MYOC-hotspot200down-156 | - | GCUCCUGGGGGGAGCAGGCUGAA | 23 | 4374 |
| MYOC-hotspot200down-157 | - | GGCUCCUGGGGGGAGCAGGCUGAA | 24 | 4375 |
| MYOC-hotspot200down-158 | - | UGUACAGGCAAUGGCAGA | 18 | 4408 |
| MYOC-hotspot200down-159 | - | CUGUACAGGCAAUGGCAGA | 19 | 4409 |
| MYOC-hotspot200down-1 | - | GCUGUACAGGCAAUGGCAGA | 20 | 771 |
| MYOC-hotspot200down-160 | - | AGCUGUACAGGCAAUGGCAGA | 21 | 4410 |
| MYOC-hotspot200down-161 | - | AAGCUGUACAGGCAAUGGCAGA | 22 | 4411 |
| MYOC-hotspot200down-162 | - | CAAGCUGUACAGGCAAUGGCAGA | 23 | 4412 |
| MYOC-hotspot200down-163 | - | CCAAGCUGUACAGGCAAUGGCAGA | 24 | 4413 |
| MYOC-hotspot200down-164 | - | CUGGGGGGAGCAGGCUGA | 18 | 4453 |
| MYOC-hotspot200down-165 | - | CCUGGGGGGAGCAGGCUGA | 19 | 4454 |
| MYOC-hotspot200down-59 | - | UCCUGGGGGGAGCAGGCUGA | 20 | 780 |
| MYOC-hotspot200down-166 | - | CUCCUGGGGGGAGCAGGCUGA | 21 | 4455 |
| MYOC-hotspot200down-167 | - | GCUCCUGGGGGGAGCAGGCUGA | 22 | 4456 |
| MYOC-hotspot200down-168 | - | GGCUCCUGGGGGGAGCAGGCUGA | 23 | 4457 |
| MYOC-hotspot200down-169 | - | GGGCUCCUGGGGGGAGCAGGCUGA | 24 | 4458 |
| MYOC-hotspot200down-170 | - | GGAGAUGCUCAGGGCUCC | 18 | 4599 |
| MYOC-hotspot200down-171 | - | AGGAGAUGCUCAGGGCUCC | 19 | 4600 |
| MYOC-hotspot200down-16 | - | AAGGAGAUGCUCAGGGCUCC | 20 | 774 |
| MYOC-hotspot200down-172 | - | GAAGGAGAUGCUCAGGGCUCC | 21 | 4601 |
| MYOC-hotspot200down-173 | - | AGAAGGAGAUGCUCAGGGCUCC | 22 | 4602 |
| MYOC-hotspot200down-174 | - | CAGAAGGAGAUGCUCAGGGCUCC | 23 | 4603 |
| MYOC-hotspot200down-175 | - | GCAGAAGGAGAUGCUCAGGGCUCC | 24 | 4604 |
| MYOC-hotspot200down-176 | - | AAGGGAGAGCCAGCCAGC | 18 | 4618 |
| MYOC-hotspot200down-177 | - | GAAGGGAGAGCCAGCCAGC | 19 | 4619 |
| MYOC-hotspot200down-178 | - | UGAAGGGAGAGCCAGCCAGC | 20 | 2802 |
| MYOC-hotspot200down-179 | - | CUGAAGGGAGAGCCAGCCAGC | 21 | 4620 |
| MYOC-hotspot200down-180 | - | GCUGAAGGGAGAGCCAGCCAGC | 22 | 4621 |

TABLE 16E-continued

| 5th Tier | | | | |
|---|---|---|---|---|
| gRNA Name | DNA Strand | Targeting Domain | Target Site Length | SEQ ID NO |
| MYOC-hotspot200down-181 | - | GGCUGAAGGGAGAGCCAGCCAGC | 23 | 4622 |
| MYOC-hotspot200down-182 | - | AGGCUGAAGGGAGAGCCAGCCAGC | 24 | 4623 |
| MYOC-hotspot200down-183 | - | UCCAAGUUUUCAUUAAUC | 18 | 4642 |
| MYOC-hotspot200down-184 | - | UUCCAAGUUUUCAUUAAUC | 19 | 4643 |
| MYOC-hotspot200down-185 | - | UUUCCAAGUUUUCAUUAAUC | 20 | 2803 |
| MYOC-hotspot200down-186 | - | CUUUCCAAGUUUUCAUUAAUC | 21 | 4644 |
| MYOC-hotspot200down-187 | - | GCUUUCCAAGUUUUCAUUAAUC | 22 | 4645 |
| MYOC-hotspot200down-188 | - | UGCUUUCCAAGUUUUCAUUAAUC | 23 | 4646 |
| MYOC-hotspot200down-189 | - | CUGCUUUCCAAGUUUUCAUUAAUC | 24 | 4647 |
| MYOC-hotspot200down-190 | - | AGGAGAUGCUCAGGGCUC | 18 | 4660 |
| MYOC-hotspot200down-191 | - | AAGGAGAUGCUCAGGGCUC | 19 | 4661 |
| MYOC-hotspot200down-192 | - | GAAGGAGAUGCUCAGGGCUC | 20 | 2798 |
| MYOC-hotspot200down-193 | - | AGAAGGAGAUGCUCAGGGCUC | 21 | 4662 |
| MYOC-hotspot200down-194 | - | CAGAAGGAGAUGCUCAGGGCUC | 22 | 4663 |
| MYOC-hotspot200down-195 | - | GCAGAAGGAGAUGCUCAGGGCUC | 23 | 4664 |
| MYOC-hotspot200down-196 | - | GGCAGAAGGAGAUGCUCAGGGCUC | 24 | 4665 |
| MYOC-hotspot200down-197 | - | CUGUACAGGCAAUGGCAG | 18 | 4720 |
| MYOC-hotspot200down-198 | - | GCUGUACAGGCAAUGGCAG | 19 | 4721 |
| MYOC-hotspot200down-199 | - | AGCUGUACAGGCAAUGGCAG | 20 | 2796 |
| MYOC-hotspot200down-200 | - | AAGCUGUACAGGCAAUGGCAG | 21 | 4722 |
| MYOC-hotspot200down-201 | - | CAAGCUGUACAGGCAAUGGCAG | 22 | 4723 |
| MYOC-hotspot200down-202 | - | CCAAGCUGUACAGGCAAUGGCAG | 23 | 4724 |
| MYOC-hotspot200down-203 | - | UCCAAGCUGUACAGGCAAUGGCAG | 24 | 4725 |
| MYOC-hotspot200down-204 | - | UUUCAUUAAUCCAGAAGG | 18 | 4800 |
| MYOC-hotspot200down-205 | - | UUUUCAUUAAUCCAGAAGG | 19 | 4801 |
| MYOC-hotspot200down-206 | - | GUUUUCAUUAAUCCAGAAGG | 20 | 2805 |
| MYOC-hotspot200down-207 | - | AGUUUUCAUUAAUCCAGAAGG | 21 | 4802 |
| MYOC-hotspot200down-208 | - | AAGUUUUCAUUAAUCCAGAAGG | 22 | 4803 |
| MYOC-hotspot200down-209 | - | CAAGUUUUCAUUAAUCCAGAAGG | 23 | 4804 |
| MYOC-hotspot200down-210 | - | CCAAGUUUUCAUUAAUCCAGAAGG | 24 | 4805 |
| MYOC-hotspot200down-211 | - | GGGGGAGCAGGCUGAAGG | 18 | 4806 |
| MYOC-hotspot200down-212 | - | GGGGGGAGCAGGCUGAAGG | 19 | 4807 |
| MYOC-hotspot200down-213 | - | UGGGGGGAGCAGGCUGAAGG | 20 | 2801 |
| MYOC-hotspot200down-214 | - | CUGGGGGGAGCAGGCUGAAGG | 21 | 4808 |
| MYOC-hotspot200down-215 | - | CCUGGGGGGAGCAGGCUGAAGG | 22 | 4809 |
| MYOC-hotspot200down-216 | - | UCCUGGGGGGAGCAGGCUGAAGG | 23 | 4810 |
| MYOC-hotspot200down-217 | - | CUCCUGGGGGGAGCAGGCUGAAGG | 24 | 4811 |

TABLE 16E-continued

| 5th Tier | | | | |
|---|---|---|---|---|
| gRNA Name | DNA Strand | Targeting Domain | Target Site Length | SEQ ID NO |
| MYOC-hotspot200down-218 | - | GCUCCUGGGGGGAGCAGG | 18 | 4818 |
| MYOC-hotspot200down-219 | - | GGCUCCUGGGGGGAGCAGG | 19 | 4819 |
| MYOC-hotspot200down-220 | - | GGGCUCCUGGGGGGAGCAGG | 20 | 2799 |
| MYOC-hotspot200down-221 | - | AGGGCUCCUGGGGGGAGCAGG | 21 | 4820 |
| MYOC-hotspot200down-222 | - | CAGGGCUCCUGGGGGGAGCAGG | 22 | 4821 |
| MYOC-hotspot200down-223 | - | UCAGGGCUCCUGGGGGGAGCAGG | 23 | 4822 |
| MYOC-hotspot200down-224 | - | CUCAGGGCUCCUGGGGGGAGCAGG | 24 | 4823 |
| MYOC-hotspot200down-225 | - | AUGCUCAGGGCUCCUGGG | 18 | 4824 |
| MYOC-hotspot200down-226 | - | GAUGCUCAGGGCUCCUGGG | 19 | 4825 |
| MYOC-hotspot200down-63 | - | AGAUGCUCAGGGCUCCUGGG | 20 | 778 |
| MYOC-hotspot200down-227 | - | GAGAUGCUCAGGGCUCCUGGG | 21 | 4826 |
| MYOC-hotspot200down-228 | - | GGAGAUGCUCAGGGCUCCUGGG | 22 | 4827 |
| MYOC-hotspot200down-229 | - | AGGAGAUGCUCAGGGCUCCUGGG | 23 | 4828 |
| MYOC-hotspot200down-230 | - | AAGGAGAUGCUCAGGGCUCCUGGG | 24 | 4829 |
| MYOC-hotspot200down-231 | - | AAGCUGUACAGGCAAUGG | 18 | 4837 |
| MYOC-hotspot200down-232 | - | CAAGCUGUACAGGCAAUGG | 19 | 4838 |
| MYOC-hotspot200down-233 | - | CCAAGCUGUACAGGCAAUGG | 20 | 2795 |
| MYOC-hotspot200down-234 | - | UCCAAGCUGUACAGGCAAUGG | 21 | 4839 |
| MYOC-hotspot200down-235 | - | CUCCAAGCUGUACAGGCAAUGG | 22 | 4840 |
| MYOC-hotspot200down-236 | - | CCUCCAAGCUGUACAGGCAAUGG | 23 | 4841 |
| MYOC-hotspot200down-237 | - | GCCUCCAAGCUGUACAGGCAAUGG | 24 | 4842 |
| MYOC-hotspot200down-238 | - | GAUGCUCAGGGCUCCUGG | 18 | 4843 |
| MYOC-hotspot200down-239 | - | AGAUGCUCAGGGCUCCUGG | 19 | 4844 |
| MYOC-hotspot200down-38 | - | GAGAUGCUCAGGGCUCCUGG | 20 | 777 |
| MYOC-hotspot200down-240 | - | GGAGAUGCUCAGGGCUCCUGG | 21 | 4845 |
| MYOC-hotspot200down-241 | - | AGGAGAUGCUCAGGGCUCCUGG | 22 | 4846 |
| MYOC-hotspot200down-242 | - | AAGGAGAUGCUCAGGGCUCCUGG | 23 | 4847 |
| MYOC-hotspot200down-243 | - | GAAGGAGAUGCUCAGGGCUCCUGG | 24 | 4848 |
| MYOC-hotspot200down-244 | - | AGAUGCUCAGGGCUCCUG | 18 | 4880 |
| MYOC-hotspot200down-245 | - | GAGAUGCUCAGGGCUCCUG | 19 | 4881 |
| MYOC-hotspot200down-39 | - | GGAGAUGCUCAGGGCUCCUG | 20 | 776 |
| MYOC-hotspot200down-246 | - | AGGAGAUGCUCAGGGCUCCUG | 21 | 4882 |
| MYOC-hotspot200down-247 | - | AAGGAGAUGCUCAGGGCUCCUG | 22 | 4883 |
| MYOC-hotspot200down-248 | - | GAAGGAGAUGCUCAGGGCUCCUG | 23 | 4884 |
| MYOC-hotspot200down-249 | - | AGAAGGAGAUGCUCAGGGCUCCUG | 24 | 4885 |
| MYOC-hotspot200down-250 | - | CCUGGGGGGAGCAGGCUG | 18 | 4886 |
| MYOC-hotspot200down-251 | - | UCCUGGGGGGAGCAGGCUG | 19 | 4887 |

TABLE 16E-continued

5th Tier

| gRNA Name | DNA Strand | Targeting Domain | Target Site Length | SEQ ID NO |
|---|---|---|---|---|
| MYOC-hotspot200down-252 | - | CUCCUGGGGGGAGCAGGCUG | 20 | 2800 |
| MYOC-hotspot200down-253 | - | GCUCCUGGGGGGAGCAGGCUG | 21 | 4888 |
| MYOC-hotspot200down-254 | - | GGCUCCUGGGGGGAGCAGGCUG | 22 | 4889 |
| MYOC-hotspot200down-255 | - | GGGCUCCUGGGGGGAGCAGGCUG | 23 | 4890 |
| MYOC-hotspot200down-256 | - | AGGGCUCCUGGGGGGAGCAGGCUG | 24 | 4891 |
| MYOC-hotspot200down-257 | - | GAGAUGCUCAGGGCUCCU | 18 | 4984 |
| MYOC-hotspot200down-258 | - | GGAGAUGCUCAGGGCUCCU | 19 | 4985 |
| MYOC-hotspot200down-21 | - | AGGAGAUGCUCAGGGCUCCU | 20 | 775 |
| MYOC-hotspot200down-259 | - | AAGGAGAUGCUCAGGGCUCCU | 21 | 4986 |
| MYOC-hotspot200down-260 | - | GAAGGAGAUGCUCAGGGCUCCU | 22 | 4987 |
| MYOC-hotspot200down-261 | - | AGAAGGAGAUGCUCAGGGCUCCU | 23 | 4988 |
| MYOC-hotspot200down-262 | - | CAGAAGGAGAUGCUCAGGGCUCCU | 24 | 4989 |
| MYOC-hotspot200down-263 | - | AUGGCAGAAGGAGAUGCU | 18 | 5009 |
| MYOC-hotspot200down-264 | - | AAUGGCAGAAGGAGAUGCU | 19 | 5010 |
| MYOC-hotspot200down-265 | - | CAAUGGCAGAAGGAGAUGCU | 20 | 2797 |
| MYOC-hotspot200down-266 | - | GCAAUGGCAGAAGGAGAUGCU | 21 | 5011 |
| MYOC-hotspot200down-267 | - | GGCAAUGGCAGAAGGAGAUGCU | 22 | 5012 |
| MYOC-hotspot200down-268 | - | AGGCAAUGGCAGAAGGAGAUGCU | 23 | 5013 |
| MYOC-hotspot200down-269 | - | CAGGCAAUGGCAGAAGGAGAUGCU | 24 | 5014 |
| MYOC-hotspot200down-270 | - | AUUCAGGAAUUGUAGUCU | 18 | 5022 |
| MYOC-hotspot200down-271 | - | UAUUCAGGAAUUGUAGUCU | 19 | 5023 |
| MYOC-hotspot200down-272 | - | CUAUUCAGGAAUUGUAGUCU | 20 | 2808 |
| MYOC-hotspot200down-273 | - | ACUAUUCAGGAAUUGUAGUCU | 21 | 5024 |
| MYOC-hotspot200down-274 | - | AACUAUUCAGGAAUUGUAGUCU | 22 | 5025 |
| MYOC-hotspot200down-275 | - | UAACUAUUCAGGAAUUGUAGUCU | 23 | 5026 |
| MYOC-hotspot200down-276 | - | CUAACUAUUCAGGAAUUGUAGUCU | 24 | 5027 |
| MYOC-hotspot200down-277 | - | CUAUUCAGGAAUUGUAGU | 18 | 5041 |
| MYOC-hotspot200down-278 | - | ACUAUUCAGGAAUUGUAGU | 19 | 5042 |
| MYOC-hotspot200down-279 | - | AACUAUUCAGGAAUUGUAGU | 20 | 2807 |
| MYOC-hotspot200down-280 | - | UAACUAUUCAGGAAUUGUAGU | 21 | 5043 |
| MYOC-hotspot200down-281 | - | CUAACUAUUCAGGAAUUGUAGU | 22 | 5044 |
| MYOC-hotspot200down-282 | - | UCUAACUAUUCAGGAAUUGUAGU | 23 | 5045 |
| MYOC-hotspot200down-283 | - | AUCUAACUAUUCAGGAAUUGUAGU | 24 | 5046 |
| MYOC-hotspot200down-284 | - | GGUCACCAUCUAACUAUU | 18 | 5080 |
| MYOC-hotspot200down-285 | - | UGGUCACCAUCUAACUAUU | 19 | 5081 |
| MYOC-hotspot200down-286 | - | AUGGUCACCAUCUAACUAUU | 20 | 2806 |
| MYOC-hotspot200down-287 | - | CAUGGUCACCAUCUAACUAUU | 21 | 5082 |

TABLE 16E-continued

| 5th Tier | | | | |
|---|---|---|---|---|
| gRNA Name | DNA Strand | Targeting Domain | Target Site Length | SEQ ID NO |
| MYOC-hotspot200down-288 | - | ACAUGGUCACCAUCUAACUAUU | 22 | 5083 |
| MYOC-hotspot200down-289 | - | AACAUGGUCACCAUCUAACUAUU | 23 | 5084 |
| MYOC-hotspot200down-290 | - | GAACAUGGUCACCAUCUAACUAUU | 24 | 5085 |

Table 17A provides exemplary targeting domains for the mutational hotspot 477-502 target site in the MYOC gene selected according to the third tier parameters. The targeting domains bind within 200 bp downstream from the mutational hotspot 477-502 target site and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 17A

| 3rd Tier | | | | |
|---|---|---|---|---|
| gRNA Name | DNA Strand | Targeting Domain | Target Site Length | SEQ ID NO |
| MYOC-hotspot200down-291 | + | GUGACCAUGUUCAUCCU | 17 | 2855 |
| MYOC-hotspot200down-292 | - | GCCAGGGCCCAGGCAGCUUU | 20 | 5144 |

Table 17B provides exemplary targeting domains for the mutational hotspot 477-502 target site in the MYOC gene selected according to the fourth tier parameters. The targeting domains bind within 200 bp downstream from the mutational hotspot 477-502 target site. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 17B

| 4th Tier | | | | |
|---|---|---|---|---|
| gRNA Name | DNA Strand | Targeting Domain | Target Site Length | SEQ ID NO |
| MYOC-hotspot200down-293 | - | CAGCCAGCCAGGGCCCA | 17 | 5114 |
| MYOC-hotspot200down-294 | + | CCUUCUGCCAUUGCCUG | 17 | 5122 |
| MYOC-hotspot200down-295 | + | CAUUGCCUGUACAGCUU | 17 | 5127 |
| MYOC-hotspot200down-296 | - | AGGGCCCAGGCAGCUUU | 17 | 5128 |
| MYOC-hotspot200down-297 | - | AGCCAGCCAGCCAGGGCCCA | 20 | 5131 |
| MYOC-hotspot200down-298 | + | UCUCCUUCUGCCAUUGCCUG | 20 | 5138 |
| MYOC-hotspot200down-299 | + | AUGGUGACCAUGUUCAUCCU | 20 | 2849 |
| MYOC-hotspot200down-300 | + | UGCCAUUGCCUGUACAGCUU | 20 | 5143 |

Table 18A provides exemplary targeting domains for correcting a mutation (e.g., I477N) in the MYOC gene selected according to the first tier parameters. The targeting domains bind within 200 bp from a mutation (e.g., I477N), have a high level of orthogonality and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 18A

| 1st Tier | | | | |
|---|---|---|---|---|
| gRNA Name | DNA Strand | Targeting Domain | Target Site Length | SEQ ID NO |
| MYOC-I477N-1 | + | GCUGCUGACGGUGUACA | 17 | 909 |
| MYOC-I477N-2 | + | GCGGUUCUUGAAUGGGA | 17 | 446 |
| MYOC-I477N-3 | - | GCUUAUGACACAGGCAC | 17 | 451 |
| MYOC-I477N-4 | - | GAUUGACUACAACCCCC | 17 | 886 |
| MYOC-I477N-5 | + | GACGGUAGCAUCUGCUG | 17 | 907 |
| MYOC-I477N-6 | - | GGAACUCGAACAAACCU | 17 | 884 |
| MYOC-I477N-7 | + | GGAGGCUUUUCACAUCU | 17 | 445 |
| MYOC-I477N-8 | + | GUAGCUGCUGACGGUGUACA | 20 | 790 |
| MYOC-I477N-9 | + | GGCAAAGAGCUUCUUCUCCA | 20 | 448 |
| MYOC-I477N-10 | - | GCUGUACAGGCAAUGGCAGA | 20 | 771 |
| MYOC-I477N-11 | - | GUCAACUUUGCUUAUGACAC | 20 | 439 |
| MYOC-I477N-12 | - | GAAAAGCCUCCAAGCUGUAC | 20 | 769 |
| MYOC-I477N-13 | + | GACCAUGUUCAAGUUGUCCC | 20 | 441 |
| MYOC-I477N-14 | + | GGUUCUUGAAUGGGAUGGUC | 20 | 449 |
| MYOC-I477N-15 | + | GCAAAGAGCUUCUUCUCCAG | 20 | 442 |
| MYOC-I477N-16 | + | GUUGACGGUAGCAUCUGCUG | 20 | 788 |
| MYOC-I477N-17 | - | GCCAAUGCCUUCAUCAUCUG | 20 | 768 |
| MYOC-I477N-18 | + | GCCACAGAUGAUGAAGGCAU | 20 | 792 |
| MYOC-I477N-19 | - | GGAGAAGAAGCUCUUUGCCU | 20 | 440 |

Table 18B provides exemplary targeting domains for correcting a mutation (e.g., I477N) in the MYOC gene selected according to the second tier parameters. The targeting domains bind within 200 bp from a mutation (e.g., I477N) and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 18B

| 2nd Tier | | | | |
|---|---|---|---|---|
| gRNA Name | DNA Strand | Targeting Domain | Target Site Length | SEQ ID NO |
| MYOC-I477N-20 | + | UUAUAGCGGUUCUUGAA | 17 | 473 |
| MYOC-I477N-21 | + | UGGCGACUGACUGCUUA | 17 | 912 |
| MYOC-I477N-22 | - | AACUUUGCUUAUGACAC | 17 | 464 |

TABLE 18B-continued

| 2nd Tier | | | | |
|---|---|---|---|---|
| gRNA Name | DNA Strand | Targeting Domain | Target Site Length | SEQ ID NO |
| MYOC-I477N-23 | - | AAGCCUCCAAGCUGUAC | 17 | 887 |
| MYOC-I477N-24 | - | UGGAACUCGAACAAACC | 17 | 883 |
| MYOC-I477N-25 | + | ACGGAUGUUUGUCUCCC | 17 | 913 |
| MYOC-I477N-26 | + | UCUUGAAUGGGAUGGUC | 17 | 475 |
| MYOC-I477N-27 | + | UGCUGCUGUACUUAUAG | 17 | 472 |
| MYOC-I477N-28 | + | UUGCCUGUACAGCUUGG | 17 | 906 |
| MYOC-I477N-29 | + | UAUAGCGGUUCUUGAAU | 17 | 474 |
| MYOC-I477N-30 | - | CCUCCAAGCUGUACAGGCAA | 20 | 770 |
| MYOC-I477N-31 | + | UACUUAUAGCGGUUCUUGAA | 20 | 461 |
| MYOC-I477N-32 | - | UGCCUGGGACAACUUGAACA | 20 | 456 |
| MYOC-I477N-33 | + | AUAGCGGUUCUUGAAUGGGA | 20 | 443 |
| MYOC-I477N-34 | + | CAAGGUGCCACAGAUGAUGA | 20 | 791 |
| MYOC-I477N-35 | + | CAUUGGCGACUGACUGCUUA | 20 | 793 |
| MYOC-I477N-36 | - | UUUGCUUAUGACACAGGCAC | 20 | 453 |
| MYOC-I477N-37 | - | AUCUGGAACUCGAACAAACC | 20 | 766 |
| MYOC-I477N-38 | - | CAUGAUUGACUACAACCCCC | 20 | 454 |
| MYOC-I477N-39 | + | CCCUUCAGCCUGCUCCCCCC | 20 | 785 |
| MYOC-I477N-40 | + | AGUCAAAGCUGCCUGGGCCC | 20 | 1802 |
| MYOC-I477N-41 | + | CUUACGGAUGUUUGUCUCCC | 20 | 794 |
| MYOC-I477N-42 | - | AAGGAGAUGCUCAGGGCUCC | 20 | 774 |
| MYOC-I477N-43 | + | AAAGCUGCCUGGGCCCUGGC | 20 | 1803 |
| MYOC-I477N-44 | + | UCAUGCUGCUGUACUUAUAG | 20 | 460 |
| MYOC-I477N-45 | + | CCAUUGCCUGUACAGCUUGG | 20 | 787 |
| MYOC-I477N-46 | + | ACUUAUAGCGGUUCUUGAAU | 20 | 462 |
| MYOC-I477N-47 | - | UCUGGAACUCGAACAAACCU | 20 | 767 |
| MYOC-I477N-48 | - | AGGAGAUGCUCAGGGCUCCU | 20 | 775 |
| MYOC-I477N-49 | + | CUGCCAUUGCCUGUACAGCU | 20 | 786 |
| MYOC-I477N-50 | + | CUUGGAGGCUUUUCACAUCU | 20 | 457 |

Table 18C provides exemplary targeting domains for correcting a mutation (e.g., I477N) in the MYOC gene selected according to the third tier parameters. The targeting domains bind within 200 bp from a mutation (e.g., I477N) and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 18C

| 3rd Tier | | | | |
|---|---|---|---|---|
| gRNA Name | DNA Strand | Targeting Domain | Target Site Length | SEQ ID NO |
| MYOC-I477N-51 | - | GGGGGGAGCAGGCUGAA | 17 | 899 |
| MYOC-I477N-52 | - | GGAGAGCCAGCCAGCCA | 17 | 901 |
| MYOC-I477N-53 | - | GCAGAAGGAGAUGCUCA | 17 | 891 |
| MYOC-I477N-54 | - | GUACAGGCAAUGGCAGA | 17 | 889 |
| MYOC-I477N-55 | + | GGUGCCACAGAUGAUGA | 17 | 910 |
| MYOC-I477N-56 | + | GUCAUAAGCAAAGUUGA | 17 | 447 |
| MYOC-I477N-57 | - | GGGAGAGCCAGCCAGCC | 17 | 900 |
| MYOC-I477N-58 | - | GAGAUGCUCAGGGCUCC | 17 | 892 |
| MYOC-I477N-59 | - | GGGCUCCUGGGGGGAGC | 17 | 897 |
| MYOC-I477N-60 | + | GCUGCCUGGGCCCUGGC | 17 | 1801 |
| MYOC-I477N-61 | - | GGCAGAAGGAGAUGCUC | 17 | 890 |
| MYOC-I477N-62 | - | GAUGCUCAGGGCUCCUG | 17 | 894 |
| MYOC-I477N-63 | - | GAAGAAGCUCUUUGCCU | 17 | 452 |
| MYOC-I477N-64 | + | GUUCUUGAAUGGGAUGGUCA | 20 | 450 |
| MYOC-I477N-65 | - | GAGCCAGCCAGCCAGGGCCC | 20 | 784 |
| MYOC-I477N-66 | - | GAAGGGAGAGCCAGCCAGCC | 20 | 782 |
| MYOC-I477N-67 | + | GGAAAGCAGUCAAAGCUGCC | 20 | 854 |
| MYOC-I477N-68 | - | GAGAUGCUCAGGGCUCCUGG | 20 | 777 |
| MYOC-I477N-69 | - | GGAGAUGCUCAGGGCUCCUG | 20 | 776 |
| MYOC-I477N-70 | + | GAAAGCAGUCAAAGCUGCCU | 20 | 855 |

Table 18D provides exemplary targeting domains for correcting a mutation (e.g., I477N) in the MYOC gene selected according to the fourth tier parameters. The targeting domains bind within 200 bp from a mutation (e.g., I477N). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 18D

| 4th Tier | | | | |
|---|---|---|---|---|
| gRNA Name | DNA Strand | Targeting Domain | Target Site Length | SEQ ID NO |
| MYOC-I477N-71 | - | CCAAGCUGUACAGGCAA | 17 | 888 |
| MYOC-I477N-72 | - | CUGGGACAACUUGAACA | 17 | 466 |
| MYOC-I477N-73 | + | AAAGAGCUUCUUCUCCA | 17 | 469 |
| MYOC-I477N-74 | + | CUUGAAUGGGAUGGUCA | 17 | 476 |
| MYOC-I477N-75 | - | UGGGGGGAGCAGGCUGA | 17 | 898 |
| MYOC-I477N-76 | + | UGAGGUGUAGCUGCUGA | 17 | 908 |
| MYOC-I477N-77 | + | UUCAGCCUGCUCCCCCC | 17 | 904 |
| MYOC-I477N-78 | - | CCAGCCAGCCAGGGCCC | 17 | 902 |
| MYOC-I477N-79 | + | CAAAGCUGCCUGGGCCC | 17 | 1805 |
| MYOC-I477N-80 | + | CAUGUUCAAGUUGUCCC | 17 | 467 |

TABLE 18D-continued

| 4th Tier | | | | |
|---|---|---|---|---|
| gRNA Name | DNA Strand | Targeting Domain | Target Site Length | SEQ ID NO |
| MYOC-I477N-81 | + | AAGCAGUCAAAGCUGCC | 17 | 974 |
| MYOC-I477N-82 | - | AGAAGAAGCUCUUUGCC | 17 | 465 |
| MYOC-I477N-83 | + | CAAAGAGCUUCUUCUCC | 17 | 468 |
| MYOC-I477N-84 | + | CCUGGGCCCUGGCUGGC | 17 | 903 |
| MYOC-I477N-85 | + | AAGAGCUUCUUCUCCAG | 17 | 470 |
| MYOC-I477N-86 | + | AGAGCUUCUUCUCCAGG | 17 | 471 |
| MYOC-I477N-87 | - | UGCUCAGGGCUCCUGGG | 17 | 896 |
| MYOC-I477N-88 | - | AUGCUCAGGGCUCCUGG | 17 | 895 |
| MYOC-I477N-89 | - | AAUGCCUUCAUCAUCUG | 17 | 885 |
| MYOC-I477N-90 | + | ACAGAUGAUGAAGGCAU | 17 | 911 |
| MYOC-I477N-91 | + | AGCAGUCAAAGCUGCCU | 17 | 975 |
| MYOC-I477N-92 | - | AGAUGCUCAGGGCUCCU | 17 | 893 |
| MYOC-I477N-93 | + | CCAUUGCCUGUACAGCU | 17 | 905 |
| MYOC-I477N-94 | - | CCUGGGGGGAGCAGGCUGAA | 20 | 781 |
| MYOC-I477N-95 | - | AAGGGAGAGCCAGCCAGCCA | 20 | 783 |
| MYOC-I477N-96 | - | AUGGCAGAAGGAGAUGCUCA | 20 | 773 |
| MYOC-I477N-97 | - | UCCUGGGGGGAGCAGGCUGA | 20 | 780 |
| MYOC-I477N-98 | + | UGCUGAGGUGUAGCUGCUGA | 20 | 789 |
| MYOC-I477N-99 | + | UGUGUCAUAAGCAAAGUUGA | 20 | 463 |
| MYOC-I477N-100 | - | UGGAGAAGAAGCUCUUUGCC | 20 | 455 |
| MYOC-I477N-101 | + | AGGCAAAGAGCUUCUUCUCC | 20 | 458 |
| MYOC-I477N-102 | - | UCAGGGCUCCUGGGGGGAGC | 20 | 779 |
| MYOC-I477N-103 | + | CUGCCUGGGCCCUGGCUGGC | 20 | 1804 |
| MYOC-I477N-104 | - | AAUGGCAGAAGGAGAUGCUC | 20 | 772 |
| MYOC-I477N-105 | + | CAAAGAGCUUCUUCUCCAGG | 20 | 459 |
| MYOC-I477N-106 | - | AGAUGCUCAGGGCUCCUGGG | 20 | 778 |

Table 19A provides exemplary targeting domains for correcting a mutation (e.g., I477N) in the MYOC gene selected according to the first tier parameters. The targeting domains bind within 200 bp from a mutation (e.g., I477N), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 19A

| 1st Tier | | | | |
|---|---|---|---|---|
| gRNA Name | DNA Strand | Targeting Domain | Target Site Length | SEQ ID NO |
| MYOC-I477N-107 | + | GUACUUAUAGCGGUUCUUGAA | 21 | 3535 |
| MYOC-I477N-108 | + | GCUGUACUUAUAGCGGUUCUUGAA | 24 | 3536 |

TABLE 19A-continued

| 1st Tier | | | | |
|---|---|---|---|---|
| gRNA Name | DNA Strand | Targeting Domain | Target Site Length | SEQ ID NO |
| MYOC-I477N-109 | + | GCUGCUGUACUUAUAGCGGUUC | 22 | 3553 |
| MYOC-I477N-110 | + | GCGGUUCUUGAAUGGGAUGGU | 21 | 3564 |
| MYOC-I477N-111 | + | GAUGUUUGUCUCCCAGGUUUGU | 22 | 3566 |
| MYOC-I477N-112 | + | GGAUGUUUGUCUCCCAGGUUUGU | 23 | 3567 |

Table 19B provides exemplary targeting domains for correcting a mutation (e.g., I477N) in the MYOC gene selected according to the second tier parameters. The targeting domains bind within 200 bp from a mutation (e.g., I477N), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 19B

| 2nd Tier | | | | |
|---|---|---|---|---|
| gRNA Name | DNA Strand | Targeting Domain | Target Site Length | SEQ ID NO |
| MYOC-I477N-113 | + | UGUACUUAUAGCGGUUCUUGAA | 22 | 3612 |
| MYOC-I477N-114 | + | CUGUACUUAUAGCGGUUCUUGAA | 23 | 3613 |
| MYOC-I477N-115 | + | AGGCAAAGAGCUUCUUCUCCA | 21 | 3615 |
| MYOC-I477N-116 | + | CAGGCAAAGAGCUUCUUCUCCA | 22 | 3616 |
| MYOC-I477N-117 | + | CCAGGCAAAGAGCUUCUUCUCCA | 23 | 3617 |
| MYOC-I477N-118 | + | CCCAGGCAAAGAGCUUCUUCUCCA | 24 | 3618 |
| MYOC-I477N-119 | + | CUGCUGUACUUAUAGCGGUUC | 21 | 3658 |
| MYOC-I477N-120 | + | UGCUGCUGUACUUAUAGCGGUUC | 23 | 3659 |
| MYOC-I477N-121 | + | AUGCUGCUGUACUUAUAGCGGUUC | 24 | 3660 |
| MYOC-I477N-122 | + | AGCGGUUCUUGAAUGGGAUGGU | 22 | 3680 |
| MYOC-I477N-123 | + | UAGCGGUUCUUGAAUGGGAUGGU | 23 | 3681 |
| MYOC-I477N-124 | + | AUAGCGGUUCUUGAAUGGGAUGGU | 24 | 3682 |
| MYOC-I477N-125 | + | AUGUUUGUCUCCCAGGUUUGU | 21 | 3690 |
| MYOC-I477N-126 | + | CGGAUGUUUGUCUCCCAGGUUUGU | 24 | 3691 |

Table 19C provides exemplary targeting domains for correcting a mutation (e.g., I477N) in the MYOC gene selected according to the third tier parameters. The targeting domains bind within 200 bp from a mutation (e.g., I477N), start with a 5' G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 19C

| 3rd Tier | | | | |
|---|---|---|---|---|
| gRNA Name | DNA Strand | Targeting Domain | Target Site Length | SEQ ID NO |
| MYOC-I477N-127 | + | GCAAAGAGCUUCUUCUCCA | 19 | 3537 |
| MYOC-I477N-9 | + | GGCAAAGAGCUUCUUCUCCA | 20 | 448 |
| MYOC-I477N-128 | + | GCUGUACUUAUAGCGGUUC | 19 | 3552 |
| MYOC-I477N-129 | + | GUUCUUGAAUGGGAUGGU | 18 | 3562 |
| MYOC-I477N-130 | + | GGUUCUUGAAUGGGAUGGU | 19 | 3563 |
| MYOC-I477N-131 | + | GUUUGUCUCCCAGGUUUGU | 19 | 3565 |
| MYOC-I477N-132 | + | GCAUUGGCGACUGACUGCUU | 20 | 2793 |
| MYOC-I477N-133 | + | GGCAUUGGCGACUGACUGCUU | 21 | 3571 |
| MYOC-I477N-134 | + | GAAGGCAUUGGCGACUGACUGCUU | 24 | 3572 |

Table 19D provides exemplary targeting domains for correcting a mutation (e.g., I477N) in the MYOC gene selected according to the fourth tier parameters. The targeting domains bind within 200 bp from a mutation (e.g., I477N), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 19D

| 4th Tier | | | | |
|---|---|---|---|---|
| gRNA Name | DNA Strand | Targeting Domain | Target Site Length | SEQ ID NO |
| MYOC-I477N-135 | + | CUUAUAGCGGUUCUUGAA | 18 | 3610 |
| MYOC-I477N-136 | + | ACUUAUAGCGGUUCUUGAA | 19 | 3611 |
| MYOC-I477N-31 | + | UACUUAUAGCGGUUCUUGAA | 20 | 461 |
| MYOC-I477N-137 | + | CAAAGAGCUUCUUCUCCA | 18 | 3614 |
| MYOC-I477N-138 | + | CUGUACUUAUAGCGGUUC | 18 | 3657 |
| MYOC-I477N-139 | + | UGCUGUACUUAUAGCGGUUC | 20 | 1856 |
| MYOC-I477N-140 | + | CGGUUCUUGAAUGGGAUGGU | 20 | 1854 |
| MYOC-I477N-141 | + | UUUGUCUCCCAGGUUUGU | 18 | 3689 |
| MYOC-I477N-142 | + | UGUUUGUCUCCCAGGUUUGU | 20 | 2792 |
| MYOC-I477N-143 | + | AUUGGCGACUGACUGCUU | 18 | 3695 |
| MYOC-I477N-144 | + | CAUUGGCGACUGACUGCUU | 19 | 3696 |
| MYOC-I477N-145 | + | AGGCAUUGGCGACUGACUGCUU | 22 | 3697 |
| MYOC-I477N-146 | + | AAGGCAUUGGCGACUGACUGCUU | 23 | 3698 |

Table 19E provides exemplary targeting domains for correcting a mutation (e.g., I477N) in the MYOC gene selected according to the fifth tier parameters. The targeting domains bind within 200 bp from a mutation (e.g., I477N), and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 19E

| 5th Tier | | | | |
|---|---|---|---|---|
| gRNA Name | DNA Strand | Targeting Domain | Target Site Length | SEQ ID NO |
| MYOC-I477N-147 | + | UUCAAGUUGUCCCAGGCA | 18 | 3879 |
| MYOC-I477N-148 | + | GUUCAAGUUGUCCCAGGCA | 19 | 3880 |
| MYOC-I477N-149 | + | UGUUCAAGUUGUCCCAGGCA | 20 | 1858 |
| MYOC-I477N-150 | + | AUGUUCAAGUUGUCCCAGGCA | 21 | 3881 |
| MYOC-I477N-151 | + | CAUGUUCAAGUUGUCCCAGGCA | 22 | 3882 |
| MYOC-I477N-152 | + | CCAUGUUCAAGUUGUCCCAGGCA | 23 | 3883 |
| MYOC-I477N-153 | + | ACCAUGUUCAAGUUGUCCCAGGCA | 24 | 3884 |
| MYOC-I477N-154 | + | ACUUAUAGCGGUUCUUGA | 18 | 3906 |
| MYOC-I477N-155 | + | UACUUAUAGCGGUUCUUGA | 19 | 3907 |
| MYOC-I477N-156 | + | GUACUUAUAGCGGUUCUUGA | 20 | 1855 |
| MYOC-I477N-157 | + | UGUACUUAUAGCGGUUCUUGA | 21 | 3908 |
| MYOC-I477N-158 | + | CUGUACUUAUAGCGGUUCUUGA | 22 | 3909 |
| MYOC-I477N-159 | + | GCUGUACUUAUAGCGGUUCUUGA | 23 | 3910 |
| MYOC-I477N-160 | + | UGCUGUACUUAUAGCGGUUCUUGA | 24 | 3911 |
| MYOC-I477N-161 | + | CUUCAGCCUGCUCCCCCC | 18 | 3956 |
| MYOC-I477N-162 | + | CCUUCAGCCUGCUCCCCCC | 19 | 3957 |
| MYOC-I477N-39 | + | CCCUUCAGCCUGCUCCCCCC | 20 | 785 |
| MYOC-I477N-163 | + | UCCCUUCAGCCUGCUCCCCCC | 21 | 3958 |
| MYOC-I477N-164 | + | CUCCCUUCAGCCUGCUCCCCCC | 22 | 3959 |
| MYOC-I477N-165 | + | UCUCCCUUCAGCCUGCUCCCCCC | 23 | 3960 |
| MYOC-I477N-166 | + | CUCUCCCUUCAGCCUGCUCCCCCC | 24 | 3961 |
| MYOC-I477N-167 | + | CCUUCAGCCUGCUCCCCC | 18 | 3962 |
| MYOC-I477N-168 | + | CCCUUCAGCCUGCUCCCCC | 19 | 3963 |
| MYOC-I477N-169 | + | UCCCUUCAGCCUGCUCCCCC | 20 | 2811 |
| MYOC-I477N-170 | + | CUCCCUUCAGCCUGCUCCCCC | 21 | 3964 |
| MYOC-I477N-171 | + | UCUCCCUUCAGCCUGCUCCCCC | 22 | 3965 |
| MYOC-I477N-172 | + | CUCUCCCUUCAGCCUGCUCCCCC | 23 | 3966 |
| MYOC-I477N-173 | + | GCUCUCCCUUCAGCCUGCUCCCCC | 24 | 3967 |
| MYOC-I477N-174 | + | CUGCUCCCCCCAGGAGCC | 18 | 3974 |
| MYOC-I477N-175 | + | CCUGCUCCCCCCAGGAGCC | 19 | 3975 |
| MYOC-I477N-176 | + | GCCUGCUCCCCCCAGGAGCC | 20 | 2810 |
| MYOC-I477N-177 | + | AGCCUGCUCCCCCCAGGAGCC | 21 | 3976 |
| MYOC-I477N-178 | + | CAGCCUGCUCCCCCCAGGAGCC | 22 | 3977 |
| MYOC-I477N-179 | + | UCAGCCUGCUCCCCCCAGGAGCC | 23 | 3978 |
| MYOC-I477N-180 | + | UUCAGCCUGCUCCCCCCAGGAGCC | 24 | 3979 |
| MYOC-I477N-181 | + | GCAAAGAGCUUCUUCUCC | 18 | 3987 |
| MYOC-I477N-182 | + | GGCAAAGAGCUUCUUCUCC | 19 | 3988 |

TABLE 19E-continued

| 5th Tier | | | | |
|---|---|---|---|---|
| gRNA Name | DNA Strand | Targeting Domain | Target Site Length | SEQ ID NO |
| MYOC-I477N-101 | + | AGGCAAAGAGCUUCUUCUCC | 20 | 458 |
| MYOC-I477N-183 | + | CAGGCAAAGAGCUUCUUCUCC | 21 | 3989 |
| MYOC-I477N-184 | + | CCAGGCAAAGAGCUUCUUCUCC | 22 | 3990 |
| MYOC-I477N-185 | + | CCCAGGCAAAGAGCUUCUUCUCC | 23 | 3991 |
| MYOC-I477N-186 | + | UCCCAGGCAAAGAGCUUCUUCUCC | 24 | 3992 |
| MYOC-I477N-187 | + | UGCCAUUGCCUGUACAGC | 18 | 4011 |
| MYOC-I477N-188 | + | CUGCCAUUGCCUGUACAGC | 19 | 4012 |
| MYOC-I477N-189 | + | UCUGCCAUUGCCUGUACAGC | 20 | 2809 |
| MYOC-I477N-190 | + | UUCUGCCAUUGCCUGUACAGC | 21 | 4013 |
| MYOC-I477N-191 | + | CUUCUGCCAUUGCCUGUACAGC | 22 | 4014 |
| MYOC-I477N-192 | + | CCUUCUGCCAUUGCCUGUACAGC | 23 | 4015 |
| MYOC-I477N-193 | + | UCCUUCUGCCAUUGCCUGUACAGC | 24 | 4016 |
| MYOC-I477N-194 | + | GAAAGCAGUCAAAGCUGC | 18 | 4052 |
| MYOC-I477N-195 | + | GGAAAGCAGUCAAAGCUGC | 19 | 4053 |
| MYOC-I477N-196 | + | UGGAAAGCAGUCAAAGCUGC | 20 | 2812 |
| MYOC-I477N-197 | + | UUGGAGGCUUUUCACAUC | 18 | 4058 |
| MYOC-I477N-198 | + | CUUGGAGGCUUUUCACAUC | 19 | 4059 |
| MYOC-I477N-199 | + | GCUUGGAGGCUUUUCACAUC | 20 | 1860 |
| MYOC-I477N-200 | + | AGCUUGGAGGCUUUUCACAUC | 21 | 4060 |
| MYOC-I477N-201 | + | CAGCUUGGAGGCUUUUCACAUC | 22 | 4061 |
| MYOC-I477N-202 | + | ACAGCUUGGAGGCUUUUCACAUC | 23 | 4062 |
| MYOC-I477N-203 | + | UACAGCUUGGAGGCUUUUCACAUC | 24 | 4063 |
| MYOC-I477N-204 | + | GGCAAAGAGCUUCUUCUC | 18 | 4083 |
| MYOC-I477N-205 | + | AGGCAAAGAGCUUCUUCUC | 19 | 4084 |
| MYOC-I477N-206 | + | CAGGCAAAGAGCUUCUUCUC | 20 | 1857 |
| MYOC-I477N-207 | + | CCAGGCAAAGAGCUUCUUCUC | 21 | 4085 |
| MYOC-I477N-208 | + | CCCAGGCAAAGAGCUUCUUCUC | 22 | 4086 |
| MYOC-I477N-209 | + | UCCCAGGCAAAGAGCUUCUUCUC | 23 | 4087 |
| MYOC-I477N-210 | + | GUCCCAGGCAAAGAGCUUCUUCUC | 24 | 4088 |
| MYOC-I477N-211 | + | UACAAGGUGCCACAGAUG | 18 | 4158 |
| MYOC-I477N-212 | + | GUACAAGGUGCCACAGAUG | 19 | 4159 |
| MYOC-I477N-213 | + | UGUACAAGGUGCCACAGAUG | 20 | 2794 |
| MYOC-I477N-214 | + | GUGUACAAGGUGCCACAGAUG | 21 | 4160 |
| MYOC-I477N-215 | + | GGUGUACAAGGUGCCACAGAUG | 22 | 4161 |
| MYOC-I477N-216 | + | CGGUGUACAAGGUGCCACAGAUG | 23 | 4162 |
| MYOC-I477N-217 | + | ACGGUGUACAAGGUGCCACAGAUG | 24 | 4163 |
| MYOC-I477N-218 | + | AGUUGACGGUAGCAUCUG | 18 | 4178 |

TABLE 19E-continued

5th Tier

| gRNA Name | DNA Strand | Targeting Domain | Target Site Length | SEQ ID NO |
|---|---|---|---|---|
| MYOC-I477N-219 | + | AAGUUGACGGUAGCAUCUG | 19 | 4179 |
| MYOC-I477N-220 | + | AAAGUUGACGGUAGCAUCUG | 20 | 1853 |
| MYOC-I477N-221 | + | CAAAGUUGACGGUAGCAUCUG | 21 | 4180 |
| MYOC-I477N-222 | + | GCAAAGUUGACGGUAGCAUCUG | 22 | 4181 |
| MYOC-I477N-223 | + | AGCAAAGUUGACGGUAGCAUCUG | 23 | 4182 |
| MYOC-I477N-224 | + | AAGCAAAGUUGACGGUAGCAUCUG | 24 | 4183 |
| MYOC-I477N-225 | + | GAGGCUUUUCACAUCUUG | 18 | 4191 |
| MYOC-I477N-226 | + | GGAGGCUUUUCACAUCUUG | 19 | 4192 |
| MYOC-I477N-227 | + | UGGAGGCUUUUCACAUCUUG | 20 | 1859 |
| MYOC-I477N-228 | + | UUGGAGGCUUUUCACAUCUUG | 21 | 4193 |
| MYOC-I477N-229 | + | CUUGGAGGCUUUUCACAUCUUG | 22 | 4194 |
| MYOC-I477N-230 | + | GCUUGGAGGCUUUUCACAUCUUG | 23 | 4195 |
| MYOC-I477N-231 | + | AGCUUGGAGGCUUUUCACAUCUUG | 24 | 4196 |
| MYOC-I477N-232 | + | GCCAUUGCCUGUACAGCU | 18 | 4265 |
| MYOC-I477N-233 | + | UGCCAUUGCCUGUACAGCU | 19 | 4266 |
| MYOC-I477N-49 | + | CUGCCAUUGCCUGUACAGCU | 20 | 786 |
| MYOC-I477N-234 | + | UCUGCCAUUGCCUGUACAGCU | 21 | 4267 |
| MYOC-I477N-235 | + | UUCUGCCAUUGCCUGUACAGCU | 22 | 4268 |
| MYOC-I477N-236 | + | CUUCUGCCAUUGCCUGUACAGCU | 23 | 4269 |
| MYOC-I477N-237 | + | CCUUCUGCCAUUGCCUGUACAGCU | 24 | 4270 |
| MYOC-I477N-238 | + | UGGAGGCUUUUCACAUCU | 18 | 4271 |
| MYOC-I477N-239 | + | UUGGAGGCUUUUCACAUCU | 19 | 4272 |
| MYOC-I477N-50 | + | CUUGGAGGCUUUUCACAUCU | 20 | 457 |
| MYOC-I477N-240 | + | GCUUGGAGGCUUUUCACAUCU | 21 | 4273 |
| MYOC-I477N-241 | + | AGCUUGGAGGCUUUUCACAUCU | 22 | 4274 |
| MYOC-I477N-242 | + | CAGCUUGGAGGCUUUUCACAUCU | 23 | 4275 |
| MYOC-I477N-243 | + | ACAGCUUGGAGGCUUUUCACAUCU | 24 | 4276 |
| MYOC-I477N-244 | - | UGGGGGGAGCAGGCUGAA | 18 | 4370 |
| MYOC-I477N-245 | - | CUGGGGGGAGCAGGCUGAA | 19 | 4371 |
| MYOC-I477N-94 | - | CCUGGGGGGAGCAGGCUGAA | 20 | 781 |
| MYOC-I477N-246 | - | UCCUGGGGGGAGCAGGCUGAA | 21 | 4372 |
| MYOC-I477N-247 | - | CUCCUGGGGGGAGCAGGCUGAA | 22 | 4373 |
| MYOC-I477N-248 | - | GCUCCUGGGGGGAGCAGGCUGAA | 23 | 4374 |
| MYOC-I477N-249 | - | GGCUCCUGGGGGGAGCAGGCUGAA | 24 | 4375 |
| MYOC-I477N-250 | - | UGUACAGGCAAUGGCAGA | 18 | 4408 |
| MYOC-I477N-251 | - | CUGUACAGGCAAUGGCAGA | 19 | 4409 |
| MYOC-I477N-10 | - | GCUGUACAGGCAAUGGCAGA | 20 | 771 |

TABLE 19E-continued

| 5th Tier | | | | |
|---|---|---|---|---|
| gRNA Name | DNA Strand | Targeting Domain | Target Site Length | SEQ ID NO |
| MYOC-I477N-252 | - | AGCUGUACAGGCAAUGGCAGA | 21 | 4410 |
| MYOC-I477N-253 | - | AAGCUGUACAGGCAAUGGCAGA | 22 | 4411 |
| MYOC-I477N-254 | - | CAAGCUGUACAGGCAAUGGCAGA | 23 | 4412 |
| MYOC-I477N-255 | - | CCAAGCUGUACAGGCAAUGGCAGA | 24 | 4413 |
| MYOC-I477N-256 | - | CUGGGGGGAGCAGGCUGA | 18 | 4453 |
| MYOC-I477N-257 | - | CCUGGGGGGAGCAGGCUGA | 19 | 4454 |
| MYOC-I477N-97 | - | UCCUGGGGGGAGCAGGCUGA | 20 | 780 |
| MYOC-I477N-258 | - | CUCCUGGGGGGAGCAGGCUGA | 21 | 4455 |
| MYOC-I477N-259 | - | GCUCCUGGGGGGAGCAGGCUGA | 22 | 4456 |
| MYOC-I477N-260 | - | GGCUCCUGGGGGGAGCAGGCUGA | 23 | 4457 |
| MYOC-I477N-261 | - | GGGCUCCUGGGGGGAGCAGGCUGA | 24 | 4458 |
| MYOC-I477N-262 | - | CUCUUUGCCUGGGACAAC | 18 | 4485 |
| MYOC-I477N-263 | - | GCUCUUUGCCUGGGACAAC | 19 | 4486 |
| MYOC-I477N-264 | - | AGCUCUUUGCCUGGGACAAC | 20 | 1851 |
| MYOC-I477N-265 | - | AAGCUCUUUGCCUGGGACAAC | 21 | 4487 |
| MYOC-I477N-266 | - | GAAGCUCUUUGCCUGGGACAAC | 22 | 4488 |
| MYOC-I477N-267 | - | AGAAGCUCUUUGCCUGGGACAAC | 23 | 4489 |
| MYOC-I477N-268 | - | AAGAAGCUCUUUGCCUGGGACAAC | 24 | 4490 |
| MYOC-I477N-269 | - | CUGGAACUCGAACAAACC | 18 | 4537 |
| MYOC-I477N-270 | - | UCUGGAACUCGAACAAACC | 19 | 4538 |
| MYOC-I477N-37 | - | AUCUGGAACUCGAACAAACC | 20 | 766 |
| MYOC-I477N-271 | - | AUGAUUGACUACAACCCC | 18 | 4569 |
| MYOC-I477N-272 | - | CAUGAUUGACUACAACCCC | 19 | 4570 |
| MYOC-I477N-273 | - | GCAUGAUUGACUACAACCCC | 20 | 1847 |
| MYOC-I477N-274 | - | AGCAUGAUUGACUACAACCCC | 21 | 4571 |
| MYOC-I477N-275 | - | CAGCAUGAUUGACUACAACCCC | 22 | 4572 |
| MYOC-I477N-276 | - | GCAGCAUGAUUGACUACAACCCC | 23 | 4573 |
| MYOC-I477N-277 | - | AGCAGCAUGAUUGACUACAACCCC | 24 | 4574 |
| MYOC-I477N-278 | - | UGAUUGACUACAACCCCC | 18 | 4575 |
| MYOC-I477N-279 | - | AUGAUUGACUACAACCCCC | 19 | 4576 |
| MYOC-I477N-38 | - | CAUGAUUGACUACAACCCCC | 20 | 454 |
| MYOC-I477N-280 | - | GCAUGAUUGACUACAACCCCC | 21 | 4577 |
| MYOC-I477N-281 | - | AGCAUGAUUGACUACAACCCCC | 22 | 4578 |
| MYOC-I477N-282 | - | CAGCAUGAUUGACUACAACCCCC | 23 | 4579 |
| MYOC-I477N-283 | - | GCAGCAUGAUUGACUACAACCCCC | 24 | 4580 |
| MYOC-I477N-284 | - | GAGAAGAAGCUCUUUGCC | 18 | 4587 |
| MYOC-I477N-285 | - | GGAGAAGAAGCUCUUUGCC | 19 | 4588 |

TABLE 19E-continued

| 5th Tier | | | | |
|---|---|---|---|---|
| gRNA Name | DNA Strand | Targeting Domain | Target Site Length | SEQ ID NO |
| MYOC-I477N-100 | - | UGGAGAAGAAGCUCUUUGCC | 20 | 455 |
| MYOC-I477N-286 | - | CUGGAGAAGAAGCUCUUUGCC | 21 | 4589 |
| MYOC-I477N-287 | - | CCUGGAGAAGAAGCUCUUUGCC | 22 | 4590 |
| MYOC-I477N-288 | - | CCCUGGAGAAGAAGCUCUUUGCC | 23 | 4591 |
| MYOC-I477N-289 | - | CCCCUGGAGAAGAAGCUCUUUGCC | 24 | 4592 |
| MYOC-I477N-290 | - | GGAGAUGCUCAGGGCUCC | 18 | 4599 |
| MYOC-I477N-291 | - | AGGAGAUGCUCAGGGCUCC | 19 | 4600 |
| MYOC-I477N-42 | - | AAGGAGAUGCUCAGGGCUCC | 20 | 774 |
| MYOC-I477N-292 | - | GAAGGAGAUGCUCAGGGCUCC | 21 | 4601 |
| MYOC-I477N-293 | - | AGAAGGAGAUGCUCAGGGCUCC | 22 | 4602 |
| MYOC-I477N-294 | - | CAGAAGGAGAUGCUCAGGGCUCC | 23 | 4603 |
| MYOC-I477N-295 | - | GCAGAAGGAGAUGCUCAGGGCUCC | 24 | 4604 |
| MYOC-I477N-296 | - | AAGGGAGAGCCAGCCAGC | 18 | 4618 |
| MYOC-I477N-297 | - | GAAGGGAGAGCCAGCCAGC | 19 | 4619 |
| MYOC-I477N-298 | - | UGAAGGGAGAGCCAGCCAGC | 20 | 2802 |
| MYOC-I477N-299 | - | CUGAAGGGAGAGCCAGCCAGC | 21 | 4620 |
| MYOC-I477N-300 | - | GCUGAAGGGAGAGCCAGCCAGC | 22 | 4621 |
| MYOC-I477N-301 | - | GGCUGAAGGGAGAGCCAGCCAGC | 23 | 4622 |
| MYOC-I477N-302 | - | AGGCUGAAGGGAGAGCCAGCCAGC | 24 | 4623 |
| MYOC-I477N-303 | - | GGAGAAGAAGCUCUUUGC | 18 | 4630 |
| MYOC-I477N-304 | - | UGGAGAAGAAGCUCUUUGC | 19 | 4631 |
| MYOC-I477N-305 | - | CUGGAGAAGAAGCUCUUUGC | 20 | 1850 |
| MYOC-I477N-306 | - | CCUGGAGAAGAAGCUCUUUGC | 21 | 4632 |
| MYOC-I477N-307 | - | CCCUGGAGAAGAAGCUCUUUGC | 22 | 4633 |
| MYOC-I477N-308 | - | CCCCUGGAGAAGAAGCUCUUUGC | 23 | 4634 |
| MYOC-I477N-309 | - | CCCCCUGGAGAAGAAGCUCUUUGC | 24 | 4635 |
| MYOC-I477N-310 | - | AGGAGAUGCUCAGGGCUC | 18 | 4660 |
| MYOC-I477N-311 | - | AAGGAGAUGCUCAGGGCUC | 19 | 4661 |
| MYOC-I477N-312 | - | GAAGGAGAUGCUCAGGGCUC | 20 | 2798 |
| MYOC-I477N-313 | - | AGAAGGAGAUGCUCAGGGCUC | 21 | 4662 |
| MYOC-I477N-314 | - | CAGAAGGAGAUGCUCAGGGCUC | 22 | 4663 |
| MYOC-I477N-315 | - | GCAGAAGGAGAUGCUCAGGGCUC | 23 | 4664 |
| MYOC-I477N-316 | - | GGCAGAAGGAGAUGCUCAGGGCUC | 24 | 4665 |
| MYOC-I477N-317 | - | ACCCUGACCAUCCCAUUC | 18 | 4673 |
| MYOC-I477N-318 | - | GACCCUGACCAUCCCAUUC | 19 | 4674 |
| MYOC-I477N-319 | - | AGACCCUGACCAUCCCAUUC | 20 | 1846 |
| MYOC-I477N-320 | - | AAGACCCUGACCAUCCCAUUC | 21 | 4675 |

TABLE 19E-continued

| 5th Tier | | | | |
|---|---|---|---|---|
| gRNA Name | DNA Strand | Targeting Domain | Target Site Length | SEQ ID NO |
| MYOC-I477N-321 | - | CAAGACCCUGACCAUCCCAUUC | 22 | 4676 |
| MYOC-I477N-322 | - | GCAAGACCCUGACCAUCCCAUUC | 23 | 4677 |
| MYOC-I477N-323 | - | AGCAAGACCCUGACCAUCCCAUUC | 24 | 4678 |
| MYOC-I477N-324 | - | CUGUACAGGCAAUGGCAG | 18 | 4720 |
| MYOC-I477N-325 | - | GCUGUACAGGCAAUGGCAG | 19 | 4721 |
| MYOC-I477N-326 | - | AGCUGUACAGGCAAUGGCAG | 20 | 2796 |
| MYOC-I477N-327 | - | AAGCUGUACAGGCAAUGGCAG | 21 | 4722 |
| MYOC-I477N-328 | - | CAAGCUGUACAGGCAAUGGCAG | 22 | 4723 |
| MYOC-I477N-329 | - | CCAAGCUGUACAGGCAAUGGCAG | 23 | 4724 |
| MYOC-I477N-330 | - | UCCAAGCUGUACAGGCAAUGGCAG | 24 | 4725 |
| MYOC-I477N-331 | - | GACUACAACCCCCUGGAG | 18 | 4738 |
| MYOC-I477N-332 | - | UGACUACAACCCCCUGGAG | 19 | 4739 |
| MYOC-I477N-333 | - | UUGACUACAACCCCCUGGAG | 20 | 1849 |
| MYOC-I477N-334 | - | AUUGACUACAACCCCCUGGAG | 21 | 4740 |
| MYOC-I477N-335 | - | GAUUGACUACAACCCCCUGGAG | 22 | 4741 |
| MYOC-I477N-336 | - | UGAUUGACUACAACCCCCUGGAG | 23 | 4742 |
| MYOC-I477N-337 | - | AUGAUUGACUACAACCCCCUGGAG | 24 | 4743 |
| MYOC-I477N-338 | - | GGGGGAGCAGGCUGAAGG | 18 | 4806 |
| MYOC-I477N-339 | - | GGGGGGAGCAGGCUGAAGG | 19 | 4807 |
| MYOC-I477N-340 | - | UGGGGGGAGCAGGCUGAAGG | 20 | 2801 |
| MYOC-I477N-341 | - | CUGGGGGGAGCAGGCUGAAGG | 21 | 4808 |
| MYOC-I477N-342 | - | CCUGGGGGGAGCAGGCUGAAGG | 22 | 4809 |
| MYOC-I477N-343 | - | UCCUGGGGGGAGCAGGCUGAAGG | 23 | 4810 |
| MYOC-I477N-344 | - | CUCCUGGGGGGAGCAGGCUGAAGG | 24 | 4811 |
| MYOC-I477N-345 | - | GCUCCUGGGGGGAGCAGG | 18 | 4818 |
| MYOC-I477N-346 | - | GGCUCCUGGGGGGAGCAGG | 19 | 4819 |
| MYOC-I477N-347 | - | GGGCUCCUGGGGGGAGCAGG | 20 | 2799 |
| MYOC-I477N-348 | - | AGGGCUCCUGGGGGGAGCAGG | 21 | 4820 |
| MYOC-I477N-349 | - | CAGGGCUCCUGGGGGGAGCAGG | 22 | 4821 |
| MYOC-I477N-350 | - | UCAGGGCUCCUGGGGGGAGCAGG | 23 | 4822 |
| MYOC-I477N-351 | - | CUCAGGGCUCCUGGGGGGAGCAGG | 24 | 4823 |
| MYOC-I477N-352 | - | AUGCUCAGGGCUCCUGGG | 18 | 4824 |
| MYOC-I477N-353 | - | GAUGCUCAGGGCUCCUGGG | 19 | 4825 |
| MYOC-I477N-106 | - | AGAUGCUCAGGGCUCCUGGG | 20 | 778 |
| MYOC-I477N-354 | - | GAGAUGCUCAGGGCUCCUGGG | 21 | 4826 |
| MYOC-I477N-355 | - | GGAGAUGCUCAGGGCUCCUGGG | 22 | 4827 |
| MYOC-I477N-356 | - | AGGAGAUGCUCAGGGCUCCUGGG | 23 | 4828 |

TABLE 19E-continued

| 5th Tier | | | | |
|---|---|---|---|---|
| gRNA Name | DNA Strand | Targeting Domain | Target Site Length | SEQ ID NO |
| MYOC-I477N-357 | - | AAGGAGAUGCUCAGGGCUCCUGGG | 24 | 4829 |
| MYOC-I477N-358 | - | AAGCUGUACAGGCAAUGG | 18 | 4837 |
| MYOC-I477N-359 | - | CAAGCUGUACAGGCAAUGG | 19 | 4838 |
| MYOC-I477N-360 | - | CCAAGCUGUACAGGCAAUGG | 20 | 2795 |
| MYOC-I477N-361 | - | UCCAAGCUGUACAGGCAAUGG | 21 | 4839 |
| MYOC-I477N-362 | - | CUCCAAGCUGUACAGGCAAUGG | 22 | 4840 |
| MYOC-I477N-363 | - | CCUCCAAGCUGUACAGGCAAUGG | 23 | 4841 |
| MYOC-I477N-364 | - | GCCUCCAAGCUGUACAGGCAAUGG | 24 | 4842 |
| MYOC-I477N-365 | - | GAUGCUCAGGGCUCCUGG | 18 | 4843 |
| MYOC-I477N-366 | - | AGAUGCUCAGGGCUCCUGG | 19 | 4844 |
| MYOC-I477N-68 | - | GAGAUGCUCAGGGCUCCUGG | 20 | 777 |
| MYOC-I477N-367 | - | GGAGAUGCUCAGGGCUCCUGG | 21 | 4845 |
| MYOC-I477N-368 | - | AGGAGAUGCUCAGGGCUCCUGG | 22 | 4846 |
| MYOC-I477N-369 | - | AAGGAGAUGCUCAGGGCUCCUGG | 23 | 4847 |
| MYOC-I477N-370 | - | GAAGGAGAUGCUCAGGGCUCCUGG | 24 | 4848 |
| MYOC-I477N-371 | - | AUUGACUACAACCCCCUG | 18 | 4874 |
| MYOC-I477N-372 | - | GAUUGACUACAACCCCCUG | 19 | 4875 |
| MYOC-I477N-373 | - | UGAUUGACUACAACCCCCUG | 20 | 1848 |
| MYOC-I477N-374 | - | AUGAUUGACUACAACCCCCUG | 21 | 4876 |
| MYOC-I477N-375 | - | CAUGAUUGACUACAACCCCCUG | 22 | 4877 |
| MYOC-I477N-376 | - | GCAUGAUUGACUACAACCCCCUG | 23 | 4878 |
| MYOC-I477N-377 | - | AGCAUGAUUGACUACAACCCCCUG | 24 | 4879 |
| MYOC-I477N-378 | - | AGAUGCUCAGGGCUCCUG | 18 | 4880 |
| MYOC-I477N-379 | - | GAGAUGCUCAGGGCUCCUG | 19 | 4881 |
| MYOC-I477N-69 | - | GGAGAUGCUCAGGGCUCCUG | 20 | 776 |
| MYOC-I477N-380 | - | AGGAGAUGCUCAGGGCUCCUG | 21 | 4882 |
| MYOC-I477N-381 | - | AAGGAGAUGCUCAGGGCUCCUG | 22 | 4883 |
| MYOC-I477N-382 | - | GAAGGAGAUGCUCAGGGCUCCUG | 23 | 4884 |
| MYOC-I477N-383 | - | AGAAGGAGAUGCUCAGGGCUCCUG | 24 | 4885 |
| MYOC-I477N-384 | - | CCUGGGGGGAGCAGGCUG | 18 | 4886 |
| MYOC-I477N-385 | - | UCCUGGGGGGAGCAGGCUG | 19 | 4887 |
| MYOC-I477N-386 | - | CUCCUGGGGGGAGCAGGCUG | 20 | 2800 |
| MYOC-I477N-387 | - | GCUCCUGGGGGGAGCAGGCUG | 21 | 4888 |
| MYOC-I477N-388 | - | GGCUCCUGGGGGGAGCAGGCUG | 22 | 4889 |
| MYOC-I477N-389 | - | GGGCUCCUGGGGGGAGCAGGCUG | 23 | 4890 |
| MYOC-I477N-390 | - | AGGGCUCCUGGGGGGAGCAGGCUG | 24 | 4891 |
| MYOC-I477N-391 | - | CAUCAAGCUCUCCAAGAU | 18 | 4939 |

TABLE 19E-continued

| 5th Tier | | | | |
|---|---|---|---|---|
| gRNA Name | DNA Strand | Targeting Domain | Target Site Length | SEQ ID NO |
| MYOC-I477N-392 | - | ACAUCAAGCUCUCCAAGAU | 19 | 4940 |
| MYOC-I477N-393 | - | GACAUCAAGCUCUCCAAGAU | 20 | 1852 |
| MYOC-I477N-394 | - | UGACAUCAAGCUCUCCAAGAU | 21 | 4941 |
| MYOC-I477N-395 | - | AUGACAUCAAGCUCUCCAAGAU | 22 | 4942 |
| MYOC-I477N-396 | - | UAUGACAUCAAGCUCUCCAAGAU | 23 | 4943 |
| MYOC-I477N-397 | - | UUAUGACAUCAAGCUCUCCAAGAU | 24 | 4944 |
| MYOC-I477N-398 | - | UGGAACUCGAACAAACCU | 18 | 4978 |
| MYOC-I477N-399 | - | CUGGAACUCGAACAAACCU | 19 | 4979 |
| MYOC-I477N-47 | - | UCUGGAACUCGAACAAACCU | 20 | 767 |
| MYOC-I477N-400 | - | GAGAUGCUCAGGGCUCCU | 18 | 4984 |
| MYOC-I477N-401 | - | GGAGAUGCUCAGGGCUCCU | 19 | 4985 |
| MYOC-I477N-48 | - | AGGAGAUGCUCAGGGCUCCU | 20 | 775 |
| MYOC-I477N-402 | - | AAGGAGAUGCUCAGGGCUCCU | 21 | 4986 |
| MYOC-I477N-403 | - | GAAGGAGAUGCUCAGGGCUCCU | 22 | 4987 |
| MYOC-I477N-404 | - | AGAAGGAGAUGCUCAGGGCUCCU | 23 | 4988 |
| MYOC-I477N-405 | - | CAGAAGGAGAUGCUCAGGGCUCCU | 24 | 4989 |
| MYOC-I477N-406 | - | AUGGCAGAAGGAGAUGCU | 18 | 5009 |
| MYOC-I477N-407 | - | AAUGGCAGAAGGAGAUGCU | 19 | 5010 |
| MYOC-I477N-408 | - | CAAUGGCAGAAGGAGAUGCU | 20 | 2797 |
| MYOC-I477N-409 | - | GCAAUGGCAGAAGGAGAUGCU | 21 | 5011 |
| MYOC-I477N-410 | - | GGCAAUGGCAGAAGGAGAUGCU | 22 | 5012 |
| MYOC-I477N-411 | - | AGGCAAUGGCAGAAGGAGAUGCU | 23 | 5013 |
| MYOC-I477N-412 | - | CAGGCAAUGGCAGAAGGAGAUGCU | 24 | 5014 |

Table 20A provides exemplary targeting domains for correcting a mutation (e.g., I477N) in the MYOC gene selected according to the first tier parameters. The targeting domains bind within 200 bp from a mutation (e.g., I477N), have a high level of orthogonality and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 20A

| 1st Tier | | | | |
|---|---|---|---|---|
| gRNA Name | DNA Strand | Targeting Domain | Target Site Length | SEQ ID NO |
| MYOC-I477N-413 | - | GAACCGCUAUAAGUACAGCA | 20 | 2842 |

Table 20B provides exemplary targeting domains for correcting a mutation (e.g., I477N) in the MYOC gene selected according to the second tier parameters. The targeting domains bind within 200 bp from a mutation (e.g., I477N) and have a high level of orthogonality. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 20B

| 2nd Tier | | | | |
|---|---|---|---|---|
| gRNA Name | DNA Strand | Targeting Domain | Target Site Length | SEQ ID NO |
| MYOC-I477N-414 | - | UCAGCAGAUGCUACCGUCAA | 20 | 5129 |

Table 20C provides exemplary targeting domains for correcting a mutation (e.g., I477N) in the MYOC gene selected according to the third tier parameters. The targeting domains bind within 200 bp from a mutation (e.g., I477N) and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 20C

3rd Tier

| gRNA Name | DNA Strand | Targeting Domain | Target Site Length | SEQ ID NO |
|---|---|---|---|---|
| MYOC-I477N-415 | - | GCAGAUGCUACCGUCAA | 17 | 5112 |
| MYOC-I477N-416 | - | GCCAGGGCCCAGGCAGCUUU | 20 | 5144 |

Table 20D provides exemplary targeting domains for correcting a mutation (e.g., I477N) in the MYOC gene selected according to the fourth tier parameters. The targeting domains bind within 200 bp from a mutation (e.g., I477N). It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 20D

4th Tier

| gRNA Name | DNA Strand | Targeting Domain | Target Site Length | SEQ ID NO |
|---|---|---|---|---|
| MYOC-I477N-417 | - | CAGCCAGCCAGGGCCCA | 17 | 5114 |
| MYOC-I477N-418 | - | CCGCUAUAAGUACAGCA | 17 | 2843 |

TABLE 20D-continued

4th Tier

| gRNA Name | DNA Strand | Targeting Domain | Target Site Length | SEQ ID NO |
|---|---|---|---|---|
| MYOC-I477N-419 | + | UCAAGUUGUCCCAGGCA | 17 | 1873 |
| MYOC-I477N-420 | + | CCUUCUGCCAUUGCCUG | 17 | 5122 |
| MYOC-I477N-421 | + | AGGCUUUUCACAUCUUG | 17 | 1874 |
| MYOC-I477N-422 | + | UGAAGGCAUUGGCGACU | 17 | 5124 |
| MYOC-I477N-423 | + | CAUUGCCUGUACAGCUU | 17 | 5127 |
| MYOC-I477N-424 | - | AGGGCCCAGGCAGCUUU | 17 | 5128 |
| MYOC-I477N-425 | - | AGCCAGCCAGCCAGGGCCCA | 20 | 5131 |
| MYOC-I477N-149 | + | UGUUCAAGUUGUCCCAGGCA | 20 | 1858 |
| MYOC-I477N-426 | + | UCUCCUUCUGCCAUUGCCUG | 20 | 5138 |
| MYOC-I477N-227 | + | UGGAGGCUUUUCACAUCUUG | 20 | 1859 |
| MYOC-I477N-427 | + | UGAUGAAGGCAUUGGCGACU | 20 | 5140 |
| MYOC-I477N-428 | + | UGCCAUUGCCUGUACAGCUU | 20 | 5143 |

Table 21A provides exemplary targeting domains for correcting a mutation (e.g., P370L) in the MYOC gene selected according to the first tier parameters. The targeting domains bind within 200 bp from a mutation (e.g., P370L), have a high level of orthogonality and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 21A

1st Tier

| gRNA Name | DNA Strand | Targeting Domain | Target Site Length | SEQ ID NO |
|---|---|---|---|---|
| MYOC-P370L-1 | - | GGGAGCCUCUAUUUCCA | 17 | 880 |
| MYOC-P370L-2 | - | GAAUACCGAGACAGUGA | 17 | 392 |
| MYOC-P370L-3 | - | GCAGGGCUACCCUUCUA | 17 | 870 |
| MYOC-P370L-4 | + | GGUAGCCCUGCAUAAAC | 17 | 927 |
| MYOC-P370L-5 | - | GGUGCUGUGGUGUACUC | 17 | 877 |
| MYOC-P370L-6 | + | GCACCCGUGCUUUCCAG | 17 | 923 |
| MYOC-P370L-7 | - | GUGCUGUGGUGUACUCG | 17 | 878 |
| MYOC-P370L-8 | - | GGACAUUGACUUGGCUG | 17 | 402 |

TABLE 21A-continued

| 1st Tier | | | | |
|---|---|---|---|---|
| gRNA Name | DNA Strand | Targeting Domain | Target Site Length | SEQ ID NO |
| MYOC-P370L-9 | − | GGGUGCUGUGGUGUACU | 17 | 876 |
| MYOC-P370L-10 | − | GGAACUCGAACAAACCU | 17 | 884 |
| MYOC-P370L-11 | − | GACAGUUCCCGUAUUCU | 17 | 881 |
| MYOC-P370L-12 | + | GUUCAGUUUGGAGAGGACAA | 20 | 799 |
| MYOC-P370L-13 | + | GCAGUAUGUGAACCUUAGAA | 20 | 806 |
| MYOC-P370L-14 | − | GUAUUCUUGGGGUGGCUACA | 20 | 388 |
| MYOC-P370L-15 | + | GUCCGUGGUAGCCAGCUCCA | 20 | 391 |
| MYOC-P370L-16 | − | GCCUAGGCCACUGGAAAGCA | 20 | 756 |
| MYOC-P370L-17 | + | GGCAGUAUGUGAACCUUAGA | 20 | 805 |
| MYOC-P370L-18 | − | GCUGAAUACCGAGACAGUGA | 20 | 398 |
| MYOC-P370L-19 | + | GUGUAGCCACCCCAAGAAUA | 20 | 390 |
| MYOC-P370L-20 | − | GACUUGGCUGUGGAUGAAGC | 20 | 400 |
| MYOC-P370L-21 | − | GGUCAUUUACAGCACCGAUG | 20 | 389 |
| MYOC-P370L-22 | − | GCCAAUGCCUUCAUCAUCUG | 20 | 768 |
| MYOC-P370L-23 | − | GGACAGUUCCCGUAUUCUUG | 20 | 764 |
| MYOC-P370L-24 | + | GCCACAGAUGAUGAAGGCAU | 20 | 792 |
| MYOC-P370L-25 | + | GUUCGAGUUCCAGAUUCUCU | 20 | 796 |
| MYOC-P370L-26 | + | GGAGAGGACAAUGGCACCUU | 20 | 800 |

Table 21B provides exemplary targeting domains for correcting a mutation (e.g., P370L) in the MYOC gene selected according to the second tier parameters. The targeting domains bind within 200 bp from a mutation (e.g., P370L) and have a high level of orthogonality. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 21B

| 2nd Tier | | | | |
|---|---|---|---|---|
| gRNA Name | DNA Strand | Targeting Domain | Target Site Length | SEQ ID NO |
| MYOC-P370L-27 | − | AGCACCGAUGAGGCCAA | 17 | 433 |
| MYOC-P370L-28 | + | CGUGGUAGCCAGCUCCA | 17 | 397 |
| MYOC-P370L-29 | − | AUCAGCCAGUUUAUGCA | 17 | 869 |
| MYOC-P370L-30 | + | AGUAUGUGAACCUUAGA | 17 | 925 |
| MYOC-P370L-31 | + | UAGCCACCCCAAGAAUA | 17 | 395 |
| MYOC-P370L-32 | + | UGGCGACUGACUGCUUA | 17 | 912 |
| MYOC-P370L-33 | − | CAUACUGCCUAGGCCAC | 17 | 872 |
| MYOC-P370L-34 | + | AGCCACCCCAAGAAUAC | 17 | 435 |
| MYOC-P370L-35 | − | UGGAACUCGAACAAACC | 17 | 883 |
| MYOC-P370L-36 | + | UUCUGGACUCAGCGCCC | 17 | 921 |

TABLE 21B-continued

| 2nd Tier | | | | |
|---|---|---|---|---|
| gRNA Name | DNA Strand | Targeting Domain | Target Site Length | SEQ ID NO |
| MYOC-P370L-37 | + | ACGGAUGUUUGUCUCCC | 17 | 913 |
| MYOC-P370L-38 | + | CCGUGGUAGCCAGCUCC | 17 | 436 |
| MYOC-P370L-39 | + | UCGAGUUCCAGAUUCUC | 17 | 914 |
| MYOC-P370L-40 | + | AUAUCUUAUGACAGUUC | 17 | 438 |
| MYOC-P370L-41 | + | CAGCGCCCUGGAAAUAG | 17 | 922 |
| MYOC-P370L-42 | + | AAUACGGGAACUGUCCG | 17 | 920 |
| MYOC-P370L-43 | - | UUCCCGUAUUCUUGGGG | 17 | 428 |
| MYOC-P370L-44 | - | CAUUUACAGCACCGAUG | 17 | 432 |
| MYOC-P370L-45 | - | CAGUUCCCGUAUUCUUG | 17 | 427 |
| MYOC-P370L-46 | - | CUACACGGACAUUGACU | 17 | 394 |
| MYOC-P370L-47 | + | CGAGUUCCAGAUUCUCU | 17 | 915 |
| MYOC-P370L-48 | - | ACAGUUCCCGUAUUCUU | 17 | 426 |
| MYOC-P370L-49 | - | UACAGCACCGAUGAGGCCAA | 20 | 415 |
| MYOC-P370L-50 | - | AUCCCUGGAGCUGGCUACCA | 20 | 407 |
| MYOC-P370L-51 | - | UCGGGGAGCCUCUAUUUCCA | 20 | 763 |
| MYOC-P370L-52 | + | CAAGGUGCCACAGAUGAUGA | 20 | 791 |
| MYOC-P370L-53 | - | UAUGCAGGGCUACCCUUCUA | 20 | 753 |
| MYOC-P370L-54 | + | CAUUGGCGACUGACUGCUUA | 20 | 793 |
| MYOC-P370L-55 | + | AAGGGUAGCCCUGCAUAAAC | 20 | 807 |
| MYOC-P370L-56 | - | UCACAUACUGCCUAGGCCAC | 20 | 755 |
| MYOC-P370L-57 | - | CCUAGGCCACUGGAAAGCAC | 20 | 757 |
| MYOC-P370L-58 | + | UGUAGCCACCCCAAGAAUAC | 20 | 418 |
| MYOC-P370L-59 | - | AUCUGGAACUCGAACAAACC | 20 | 766 |
| MYOC-P370L-60 | + | CAGUUCUGGACUCAGCGCCC | 20 | 801 |
| MYOC-P370L-61 | - | AAGGCUGAGAAGGAAAUCCC | 20 | 406 |
| MYOC-P370L-62 | + | CUUACGGAUGUUUGUCUCCC | 20 | 794 |
| MYOC-P370L-63 | + | UGUCCGUGGUAGCCAGCUCC | 20 | 420 |
| MYOC-P370L-64 | - | CUCGGGGAGCCUCUAUUUCC | 20 | 762 |
| MYOC-P370L-65 | - | CAAACUGAACCCAGAGAAUC | 20 | 765 |
| MYOC-P370L-66 | - | ACGGGUGCUGUGGUGUACUC | 20 | 760 |
| MYOC-P370L-67 | + | UGUUCGAGUUCCAGAUUCUC | 20 | 795 |
| MYOC-P370L-68 | + | CUCAUAUCUUAUGACAGUUC | 20 | 422 |
| MYOC-P370L-69 | + | CGGUGCUGUAAAUGACCCAG | 20 | 417 |
| MYOC-P370L-70 | + | ACUCAGCGCCCUGGAAAUAG | 20 | 802 |
| MYOC-P370L-71 | + | AAGAAUACGGGAACUGUCCG | 20 | 419 |
| MYOC-P370L-72 | - | CGGGUGCUGUGGUGUACUCG | 20 | 761 |
| MYOC-P370L-73 | - | CAGUUCCCGUAUUCUUGGGG | 20 | 410 |
| MYOC-P370L-74 | - | CACGGACAUUGACUUGGCUG | 20 | 412 |

TABLE 21B-continued

| 2nd Tier | | | | |
|---|---|---|---|---|
| gRNA Name | DNA Strand | Targeting Domain | Target Site Length | SEQ ID NO |
| MYOC-P370L-75 | − | ACUGGAAAGCACGGGUGCUG | 20 | 758 |
| MYOC-P370L-76 | + | AAUGGCACCUUUGGCCUCAU | 20 | 416 |
| MYOC-P370L-77 | − | UGGCUACACGGACAUUGACU | 20 | 411 |
| MYOC-P370L-78 | − | CACGGGUGCUGUGGUGUACU | 20 | 759 |
| MYOC-P370L-79 | − | UCUGGAACUCGAACAAACCU | 20 | 767 |
| MYOC-P370L-80 | + | CCCGUGCUUUCCAGUGGCCU | 20 | 804 |
| MYOC-P370L-81 | − | CUAAGGUUCACAUACUGCCU | 20 | 754 |
| MYOC-P370L-82 | − | ACGGACAGUUCCCGUAUUCU | 20 | 408 |
| MYOC-P370L-83 | − | CGGACAGUUCCCGUAUUCUU | 20 | 409 |

Table 21C provides exemplary targeting domains for correcting a mutation (e.g., P370L) in the MYOC gene selected according to the third tier parameters. The targeting domains bind within 200 bp from a mutation (e.g., P370L) and start with a 5'G. It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 21C

| 3rd Tier | | | | |
|---|---|---|---|---|
| gRNA Name | DNA Strand | Targeting Domain | Target Site Length | SEQ ID NO |
| MYOC-P370L-84 | + | GUAUGUGAACCUUAGAA | 17 | 926 |
| MYOC-P370L-85 | − | GACAGUGAAGGCUGAGA | 17 | 401 |
| MYOC-P370L-86 | + | GGUGCCACAGAUGAUGA | 17 | 910 |
| MYOC-P370L-87 | − | GCUGAGAAGGAAAUCCC | 17 | 423 |
| MYOC-P370L-88 | − | GGGGAGCCUCUAUUUCC | 17 | 879 |

TABLE 21C-continued

| 3rd Tier | | | | |
|---|---|---|---|---|
| gRNA Name | DNA Strand | Targeting Domain | Target Site Length | SEQ ID NO |
| MYOC-P370L-89 | − | GGAAAGCACGGGUGCUG | 17 | 875 |
| MYOC-P370L-90 | + | GGCACCUUUGGCCUCAU | 17 | 404 |
| MYOC-P370L-91 | + | GUGCUUUCCAGUGGCCU | 17 | 924 |
| MYOC-P370L-92 | − | GGAUGAAGCAGGCCUCU | 17 | 403 |
| MYOC-P370L-93 | + | GAGGACAAUGGCACCUU | 17 | 919 |
| MYOC-P370L-94 | − | GAGAAGGAAAUCCCUGGAGC | 20 | 399 |

Table 21D provides exemplary targeting domains for correcting a mutation (e.g., P370L) in the MYOC gene selected according to the fourth tier parameters. The targeting domains bind within 200 bp from a mutation (e.g., P370L). It is contemplated herein that in an embodiment the targeting domain hybridizes to the target domain through complementary base pairing. Any of the targeting domains in the Table can be used with a *S. pyogenes* Cas9 molecule that generates a double stranded break (Cas9 nuclease) or a single-stranded break (Cas9 nickase).

TABLE 21D

| 4th Tier | | | | |
|---|---|---|---|---|
| gRNA Name | DNA Strand | Targeting Domain | Target Site Length | SEQ ID NO |
| MYOC-P370L-95 | + | CAGUUUGGAGAGGACAA | 17 | 918 |
| MYOC-P370L-96 | − | UUCUUGGGGUGGCUACA | 17 | 429 |
| MYOC-P370L-97 | − | CCUGGAGCUGGCUACCA | 17 | 425 |

TABLE 21D-continued

| 4th Tier | | | | |
|---|---|---|---|---|
| gRNA Name | DNA Strand | Targeting Domain | Target Site Length | SEQ ID NO |
| MYOC-P370L-98 | - | UAGGCCACUGGAAAGCA | 17 | 873 |
| MYOC-P370L-99 | - | AGGCCACUGGAAAGCAC | 17 | 874 |
| MYOC-P370L-100 | - | UUGGCUGUGGAUGAAGC | 17 | 430 |
| MYOC-P370L-101 | - | AAGGAAAUCCCUGGAGC | 17 | 424 |
| MYOC-P370L-102 | - | CAUCAGCCAGUUUAUGC | 17 | 868 |
| MYOC-P370L-103 | - | ACUGAACCCAGAGAAUC | 17 | 882 |
| MYOC-P370L-104 | - | UGGAUGAAGCAGGCCUC | 17 | 431 |
| MYOC-P370L-105 | + | UGCUGUAAAUGACCCAG | 17 | 434 |
| MYOC-P370L-106 | + | CUGGGUUCAGUUUGGAG | 17 | 917 |
| MYOC-P370L-107 | - | AAUGCCUUCAUCAUCUG | 17 | 885 |
| MYOC-P370L-108 | + | ACAGAUGAUGAAGGCAU | 17 | 911 |
| MYOC-P370L-109 | - | AGGUUCACAUACUGCCU | 17 | 871 |
| MYOC-P370L-110 | + | CUCAGCCUUCACUGUCU | 17 | 437 |
| MYOC-P370L-111 | + | AUUCUCUGGGUUCAGUU | 17 | 916 |
| MYOC-P370L-112 | - | CGAGACAGUGAAGGCUGAGA | 20 | 405 |
| MYOC-P370L-113 | - | CUGUGGAUGAAGCAGGCCUC | 20 | 413 |
| MYOC-P370L-114 | + | ACAGCACCCGUGCUUUCCAG | 20 | 803 |
| MYOC-P370L-115 | + | UCUCUGGGUUCAGUUUGGAG | 20 | 798 |
| MYOC-P370L-116 | - | UGUGGAUGAAGCAGGCCUCU | 20 | 414 |
| MYOC-P370L-117 | + | CUUCUCAGCCUUCACUGUCU | 20 | 421 |
| MYOC-P370L-118 | + | CAGAUUCUCUGGGUUCAGUU | 20 | 797 |

Table 22A provides exemplary targeting domains for correcting a mutation (e.g., P370L) in the MYOC gene selected according to the first tier parameters. The targeting domains bind within 200 bp from a mutation (e.g., P370L), have a high level of orthogonality, start with a 5'G, and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 22A

| 1st Tier | | | | |
|---|---|---|---|---|
| gRNA Name | DNA Strand | Targeting Domain | Target Site Length | SEQ ID NO |
| MYOC-P370L-119 | + | GUCAAUGUCCGUGUAGCCACCCC | 23 | 3539 |
| MYOC-P370L-120 | + | GAACUGUCCGUGGUAGCCAGCUCC | 24 | 3541 |
| MYOC-P370L-121 | + | GCGCCCUGGAAAUAGAGGCUCC | 22 | 3543 |
| MYOC-P370L-122 | + | GCCUAGGCAGUAUGUGAACCUUAG | 24 | 3556 |
| MYOC-P370L-123 | + | GUUUGUUCGAGUUCCAGAUUCU | 22 | 3560 |
| MYOC-P370L-124 | + | GGUUUGUUCGAGUUCCAGAUUCU | 23 | 3561 |
| MYOC-P370L-125 | + | GAUGUUUGUCUCCCAGGUUUGU | 22 | 3566 |
| MYOC-P370L-126 | + | GGAUGUUUGUCUCCCAGGUUUGU | 23 | 3567 |

TABLE 22A-continued

| 1st Tier | | | | |
|---|---|---|---|---|
| gRNA Name | DNA Strand | Targeting Domain | Target Site Length | SEQ ID NO |
| MYOC-P370L-127 | - | GGAGCCUCUAUUUCCAGGGCG | 21 | 3594 |
| MYOC-P370L-128 | - | GGGAGCCUCUAUUUCCAGGGCG | 22 | 3595 |
| MYOC-P370L-129 | - | GGGGAGCCUCUAUUUCCAGGGCG | 23 | 3596 |
| MYOC-P370L-130 | - | GGCUGUGGAUGAAGCAGGCCU | 21 | 3601 |
| MYOC-P370L-131 | - | GCUACACGGACAUUGACUUGGCU | 23 | 3602 |
| MYOC-P370L-132 | - | GGCUACACGGACAUUGACUUGGCU | 24 | 3603 |

Table 22B provides exemplary targeting domains for correcting a mutation (e.g., P370L) in the MYOC gene selected according to the second tier parameters. The targeting domains bind within 200 bp from a mutation (e.g., P370L), have a high level of orthogonality and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 22B

| 2nd Tier | | | | |
|---|---|---|---|---|
| gRNA Name | DNA Strand | Targeting Domain | Target Site Length | SEQ ID NO |
| MYOC-P370L-133 | + | CAAUGUCCGUGUAGCCACCCC | 21 | 3634 |
| MYOC-P370L-134 | + | UCAAUGUCCGUGUAGCCACCCC | 22 | 3635 |
| MYOC-P370L-135 | + | AGUCAAUGUCCGUGUAGCCACCCC | 24 | 3636 |
| MYOC-P370L-136 | + | CUGUCCGUGGUAGCCAGCUCC | 21 | 3638 |
| MYOC-P370L-137 | + | ACUGUCCGUGGUAGCCAGCUCC | 22 | 3639 |
| MYOC-P370L-138 | + | AACUGUCCGUGGUAGCCAGCUCC | 23 | 3640 |
| MYOC-P370L-139 | + | CGCCCUGGAAAUAGAGGCUCC | 21 | 3643 |
| MYOC-P370L-140 | + | AGCGCCCUGGAAAUAGAGGCUCC | 23 | 3644 |
| MYOC-P370L-141 | + | CAGCGCCCUGGAAAUAGAGGCUCC | 24 | 3645 |
| MYOC-P370L-142 | + | UAGGCAGUAUGUGAACCUUAG | 21 | 3662 |
| MYOC-P370L-143 | + | CUAGGCAGUAUGUGAACCUUAG | 22 | 3663 |
| MYOC-P370L-144 | + | CCUAGGCAGUAUGUGAACCUUAG | 23 | 3664 |
| MYOC-P370L-145 | + | UUUGUUCGAGUUCCAGAUUCU | 21 | 3678 |
| MYOC-P370L-146 | + | AGGUUUGUUCGAGUUCCAGAUUCU | 24 | 3679 |
| MYOC-P370L-147 | + | AUGUUUGUCUCCCAGGUUUGU | 21 | 3690 |
| MYOC-P370L-148 | + | CGGAUGUUUGUCUCCCAGGUUUGU | 24 | 3691 |
| MYOC-P370L-149 | - | CUGCCUAGGCCACUGGAAAGC | 21 | 3729 |
| MYOC-P370L-150 | - | ACUGCCUAGGCCACUGGAAAGC | 22 | 3730 |
| MYOC-P370L-151 | - | UACUGCCUAGGCCACUGGAAAGC | 23 | 3731 |
| MYOC-P370L-152 | - | AUACUGCCUAGGCCACUGGAAAGC | 24 | 3732 |
| MYOC-P370L-153 | - | AGAACUGUCAUAAGAUAUGAG | 21 | 3769 |
| MYOC-P370L-154 | - | CAGAACUGUCAUAAGAUAUGAG | 22 | 3770 |

TABLE 22B-continued

| 2nd Tier | | | | |
|---|---|---|---|---|
| gRNA Name | DNA Strand | Targeting Domain | Target Site Length | SEQ ID NO |
| MYOC-P370L-155 | - | CCAGAACUGUCAUAAGAUAUGAG | 23 | 3771 |
| MYOC-P370L-156 | - | UCCAGAACUGUCAUAAGAUAUGAG | 24 | 3772 |
| MYOC-P370L-157 | - | CGGGGAGCCUCUAUUUCCAGGGCG | 24 | 3780 |
| MYOC-P370L-158 | - | UGGCUGUGGAUGAAGCAGGCCU | 22 | 3800 |
| MYOC-P370L-159 | - | UUGGCUGUGGAUGAAGCAGGCCU | 23 | 3801 |
| MYOC-P370L-160 | - | CUUGGCUGUGGAUGAAGCAGGCCU | 24 | 3802 |
| MYOC-P370L-161 | - | UACACGGACAUUGACUUGGCU | 21 | 3805 |
| MYOC-P370L-162 | - | CUACACGGACAUUGACUUGGCU | 22 | 3806 |
| MYOC-P370L-163 | - | CACGGACAGUUCCCGUAUUCU | 21 | 3808 |
| MYOC-P370L-164 | - | CCACGGACAGUUCCCGUAUUCU | 22 | 3809 |
| MYOC-P370L-165 | - | ACCACGGACAGUUCCCGUAUUCU | 23 | 3810 |
| MYOC-P370L-166 | - | UACCACGGACAGUUCCCGUAUUCU | 24 | 3811 |

Table 22C provides exemplary targeting domains for correcting a mutation (e.g., P370L) in the MYOC gene selected according to the third tier parameters. The targeting domains bind within 200 bp from a mutation (e.g., P370L), start with a 5' G and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 22C

| 3rd Tier | | | | |
|---|---|---|---|---|
| gRNA Name | DNA Strand | Targeting Domain | Target Site Length | SEQ ID NO |
| MYOC-P370L-167 | + | GUCCGUGGUAGCCAGCUCC | 19 | 3540 |
| MYOC-P370L-168 | + | GCCCUGGAAAUAGAGGCUCC | 20 | 3542 |
| MYOC-P370L-169 | + | GCAGUAUGUGAACCUUAG | 18 | 3554 |
| MYOC-P370L-170 | + | GGCAGUAUGUGAACCUUAG | 19 | 3555 |
| MYOC-P370L-171 | + | GUUCGAGUUCCAGAUUCU | 18 | 3559 |
| MYOC-P370L-172 | + | GUUUGUCUCCCAGGUUUGU | 19 | 3565 |
| MYOC-P370L-173 | + | GCAUUGGCGACUGACUGCUU | 20 | 2793 |
| MYOC-P370L-174 | + | GGCAUUGGCGACUGACUGCUU | 21 | 3571 |
| MYOC-P370L-175 | + | GAAGGCAUUGGCGACUGACUGCUU | 24 | 3572 |
| MYOC-P370L-176 | - | GUCCUCUCCAAACUGAACCCA | 21 | 3573 |
| MYOC-P370L-177 | - | GCCUAGGCCACUGGAAAGC | 19 | 3579 |
| MYOC-P370L-178 | - | GAACUGUCAUAAGAUAUGAG | 20 | 1807 |
| MYOC-P370L-179 | - | GCCUCUAUUUCCAGGGCG | 18 | 3592 |
| MYOC-P370L-180 | - | GAGCCUCUAUUUCCAGGGCG | 20 | 3593 |
| MYOC-P370L-181 | - | GCUGUGGAUGAAGCAGGCCU | 20 | 1819 |
| MYOC-P370L-182 | - | GGACAGUUCCCGUAUUCU | 18 | 3604 |

Table 22D provides exemplary targeting domains for correcting a mutation (e.g., P370L) in the MYOC gene selected according to the fourth tier parameters. The targeting domains bind within 200 bp from a mutation (e.g., P370L), and PAM is NNGRRT. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 22D

| 4th Tier | | | | |
|---|---|---|---|---|
| gRNA Name | DNA Strand | Targeting Domain | Target Site Length | SEQ ID NO |
| MYOC-P370L-183 | + | UGUCCGUGUAGCCACCCC | 18 | 3632 |
| MYOC-P370L-184 | + | AUGUCCGUGUAGCCACCCC | 19 | 3633 |
| MYOC-P370L-185 | + | AAUGUCCGUGUAGCCACCCC | 20 | 1824 |
| MYOC-P370L-186 | + | UCCGUGGUAGCCAGCUCC | 18 | 3637 |
| MYOC-P370L-63 | + | UGUCCGUGGUAGCCAGCUCC | 20 | 420 |
| MYOC-P370L-187 | + | CCUGGAAAUAGAGGCUCC | 18 | 3641 |
| MYOC-P370L-188 | + | CCCUGGAAAUAGAGGCUCC | 19 | 3642 |
| MYOC-P370L-189 | + | AGGCAGUAUGUGAACCUUAG | 20 | 3661 |
| MYOC-P370L-190 | + | UGUUCGAGUUCCAGAUUCU | 19 | 3676 |
| MYOC-P370L-191 | + | UUGUUCGAGUUCCAGAUUCU | 20 | 3677 |
| MYOC-P370L-192 | + | UUUGUCUCCCAGGUUUGU | 18 | 3689 |
| MYOC-P370L-193 | + | UGUUUGUCUCCCAGGUUUGU | 20 | 2792 |
| MYOC-P370L-194 | + | AUUGGCGACUGACUGCUU | 18 | 3695 |
| MYOC-P370L-195 | + | CAUUGGCGACUGACUGCUU | 19 | 3696 |
| MYOC-P370L-196 | + | AGGCAUUGGCGACUGACUGCUU | 22 | 3697 |
| MYOC-P370L-197 | + | AAGGCAUUGGCGACUGACUGCUU | 23 | 3698 |
| MYOC-P370L-198 | - | CUCUCCAAACUGAACCCA | 18 | 3699 |
| MYOC-P370L-199 | - | CCUCUCCAAACUGAACCCA | 19 | 3700 |
| MYOC-P370L-200 | - | UCCUCUCCAAACUGAACCCA | 20 | 3701 |
| MYOC-P370L-201 | - | UGUCCUCUCCAAACUGAACCCA | 22 | 3702 |
| MYOC-P370L-202 | - | UUGUCCUCUCCAAACUGAACCCA | 23 | 3703 |
| MYOC-P370L-203 | - | AUUGUCCUCUCCAAACUGAACCCA | 24 | 3704 |
| MYOC-P370L-204 | - | CCUAGGCCACUGGAAAGC | 18 | 3727 |
| MYOC-P370L-205 | - | UGCCUAGGCCACUGGAAAGC | 20 | 3728 |
| MYOC-P370L-206 | - | ACUGUCAUAAGAUAUGAG | 18 | 3767 |
| MYOC-P370L-207 | - | AACUGUCAUAAGAUAUGAG | 19 | 3768 |
| MYOC-P370L-208 | - | AGCCUCUAUUUCCAGGGCG | 19 | 3779 |
| MYOC-P370L-209 | - | UGUGGAUGAAGCAGGCCU | 18 | 3798 |
| MYOC-P370L-210 | - | CUGUGGAUGAAGCAGGCCU | 19 | 3799 |
| MYOC-P370L-211 | - | ACGGACAUUGACUUGGCU | 18 | 3803 |
| MYOC-P370L-212 | - | CACGGACAUUGACUUGGCU | 19 | 3804 |
| MYOC-P370L-213 | - | ACACGGACAUUGACUUGGCU | 20 | 1817 |
| MYOC-P370L-214 | - | CGGACAGUUCCCGUAUUCU | 19 | 3807 |
| MYOC-P370L-82 | - | ACGGACAGUUCCCGUAUUCU | 20 | 408 |

Table 22E provides exemplary targeting domains for correcting a mutation (e.g., P370L) in the MYOC gene selected according to the fifth tier parameters. The targeting domains bind within 200 bp from a mutation (e.g., P370L), and PAM is NNGRRV. It is contemplated herein that in an embodiment the targeting domain hybridizes to the target domain through complementary base pairing. Any of the targeting domains in the Table can be used with a *S. aureus* Cas9 molecule that generates a double stranded break (Cas9 nuclease) or a single-stranded break (Cas9 nickase).

TABLE 22E

5th Tier

| gRNA Name | DNA Strand | Targeting Domain | Target Site Length | SEQ ID NO |
|---|---|---|---|---|
| MYOC-P370L-215 | + | GACUCAGCGCCCUGGAAA | 18 | 3848 |
| MYOC-P370L-216 | + | GGACUCAGCGCCCUGGAAA | 19 | 3849 |
| MYOC-P370L-217 | + | UGGACUCAGCGCCCUGGAAA | 20 | 3850 |
| MYOC-P370L-218 | + | CUGGACUCAGCGCCCUGGAAA | 21 | 3851 |
| MYOC-P370L-219 | + | UCUGGACUCAGCGCCCUGGAAA | 22 | 3852 |
| MYOC-P370L-220 | + | UUCUGGACUCAGCGCCCUGGAAA | 23 | 3853 |
| MYOC-P370L-221 | + | GUUCUGGACUCAGCGCCCUGGAAA | 24 | 3854 |
| MYOC-P370L-222 | + | CUCUGGGUUCAGUUUGGA | 18 | 3892 |
| MYOC-P370L-223 | + | UCUCUGGGUUCAGUUUGGA | 19 | 3893 |
| MYOC-P370L-224 | + | UUCUCUGGGUUCAGUUUGGA | 20 | 3894 |
| MYOC-P370L-225 | + | AUUCUCUGGGUUCAGUUUGGA | 21 | 3895 |
| MYOC-P370L-226 | + | GAUUCUCUGGGUUCAGUUUGGA | 22 | 3896 |
| MYOC-P370L-227 | + | AGAUUCUCUGGGUUCAGUUUGGA | 23 | 3897 |
| MYOC-P370L-228 | + | CAGAUUCUCUGGGUUCAGUUUGGA | 24 | 3898 |
| MYOC-P370L-229 | + | GUAGCCACCCCAAGAAUA | 18 | 3912 |
| MYOC-P370L-230 | + | UGUAGCCACCCCAAGAAUA | 19 | 3913 |
| MYOC-P370L-19 | + | GUGUAGCCACCCCAAGAAUA | 20 | 390 |
| MYOC-P370L-231 | + | CGUGUAGCCACCCCAAGAAUA | 21 | 3914 |
| MYOC-P370L-232 | + | CCGUGUAGCCACCCCAAGAAUA | 22 | 3915 |
| MYOC-P370L-233 | + | UCCGUGUAGCCACCCCAAGAAUA | 23 | 3916 |
| MYOC-P370L-234 | + | GUCCGUGUAGCCACCCCAAGAAUA | 24 | 3917 |
| MYOC-P370L-235 | + | UAGCCACCCCAAGAAUAC | 18 | 3944 |
| MYOC-P370L-236 | + | GUAGCCACCCCAAGAAUAC | 19 | 3945 |
| MYOC-P370L-58 | + | UGUAGCCACCCCAAGAAUAC | 20 | 418 |
| MYOC-P370L-237 | + | GUGUAGCCACCCCAAGAAUAC | 21 | 3946 |
| MYOC-P370L-238 | + | CGUGUAGCCACCCCAAGAAUAC | 22 | 3947 |
| MYOC-P370L-239 | + | CCGUGUAGCCACCCCAAGAAUAC | 23 | 3948 |
| MYOC-P370L-240 | + | UCCGUGUAGCCACCCCAAGAAUAC | 24 | 3949 |
| MYOC-P370L-241 | + | UCGGUGCUGUAAAUGACC | 18 | 3950 |
| MYOC-P370L-242 | + | AUCGGUGCUGUAAAUGACC | 19 | 3951 |
| MYOC-P370L-243 | + | CAUCGGUGCUGUAAAUGACC | 20 | 1825 |
| MYOC-P370L-244 | + | UCAUCGGUGCUGUAAAUGACC | 21 | 3952 |
| MYOC-P370L-245 | + | CUCAUCGGUGCUGUAAAUGACC | 22 | 3953 |
| MYOC-P370L-246 | + | CCUCAUCGGUGCUGUAAAUGACC | 23 | 3954 |

TABLE 22E-continued

| 5th Tier | | | | |
|---|---|---|---|---|
| gRNA Name | DNA Strand | Targeting Domain | Target Site Length | SEQ ID NO |
| MYOC-P370L-247 | + | GCCUCAUCGGUGCUGUAAAUGACC | 24 | 3955 |
| MYOC-P370L-248 | + | GUUCUGGACUCAGCGCCC | 18 | 3968 |
| MYOC-P370L-249 | + | AGUUCUGGACUCAGCGCCC | 19 | 3969 |
| MYOC-P370L-60 | + | CAGUUCUGGACUCAGCGCCC | 20 | 801 |
| MYOC-P370L-250 | + | ACAGUUCUGGACUCAGCGCCC | 21 | 3970 |
| MYOC-P370L-251 | + | GACAGUUCUGGACUCAGCGCCC | 22 | 3971 |
| MYOC-P370L-252 | + | UGACAGUUCUGGACUCAGCGCCC | 23 | 3972 |
| MYOC-P370L-253 | + | AUGACAGUUCUGGACUCAGCGCCC | 24 | 3973 |
| MYOC-P370L-254 | + | AGUUCUGGACUCAGCGCC | 18 | 3980 |
| MYOC-P370L-255 | + | CAGUUCUGGACUCAGCGCC | 19 | 3981 |
| MYOC-P370L-256 | + | ACAGUUCUGGACUCAGCGCC | 20 | 3982 |
| MYOC-P370L-257 | + | GACAGUUCUGGACUCAGCGCC | 21 | 3983 |
| MYOC-P370L-258 | + | UGACAGUUCUGGACUCAGCGCC | 22 | 3984 |
| MYOC-P370L-259 | + | AUGACAGUUCUGGACUCAGCGCC | 23 | 3985 |
| MYOC-P370L-260 | + | UAUGACAGUUCUGGACUCAGCGCC | 24 | 3986 |
| MYOC-P370L-261 | + | GUCCGUGGUAGCCAGCUC | 18 | 4071 |
| MYOC-P370L-262 | + | UGUCCGUGGUAGCCAGCUC | 19 | 4072 |
| MYOC-P370L-263 | + | CUGUCCGUGGUAGCCAGCUC | 20 | 1822 |
| MYOC-P370L-264 | + | ACUGUCCGUGGUAGCCAGCUC | 21 | 4073 |
| MYOC-P370L-265 | + | AACUGUCCGUGGUAGCCAGCUC | 22 | 4074 |
| MYOC-P370L-266 | + | GAACUGUCCGUGGUAGCCAGCUC | 23 | 4075 |
| MYOC-P370L-267 | + | GGAACUGUCCGUGGUAGCCAGCUC | 24 | 4076 |
| MYOC-P370L-268 | + | UUCUCUGGGUUCAGUUUG | 18 | 4197 |
| MYOC-P370L-269 | + | AUUCUCUGGGUUCAGUUUG | 19 | 4198 |
| MYOC-P370L-270 | + | GAUUCUCUGGGUUCAGUUUG | 20 | 4199 |
| MYOC-P370L-271 | + | AGAUUCUCUGGGUUCAGUUUG | 21 | 4200 |
| MYOC-P370L-272 | + | CAGAUUCUCUGGGUUCAGUUUG | 22 | 4201 |
| MYOC-P370L-273 | + | CCAGAUUCUCUGGGUUCAGUUUG | 23 | 4202 |
| MYOC-P370L-274 | + | UCCAGAUUCUCUGGGUUCAGUUUG | 24 | 4203 |
| MYOC-P370L-275 | + | UGUAGCCACCCCAAGAAU | 18 | 4211 |
| MYOC-P370L-276 | + | GUGUAGCCACCCCAAGAAU | 19 | 4212 |
| MYOC-P370L-277 | + | CGUGUAGCCACCCCAAGAAU | 20 | 1823 |
| MYOC-P370L-278 | + | CCGUGUAGCCACCCCAAGAAU | 21 | 4213 |
| MYOC-P370L-279 | + | UCCGUGUAGCCACCCCAAGAAU | 22 | 4214 |
| MYOC-P370L-280 | + | GUCCGUGUAGCCACCCCAAGAAU | 23 | 4215 |
| MYOC-P370L-281 | + | UGUCCGUGUAGCCACCCCAAGAAU | 24 | 4216 |
| MYOC-P370L-282 | + | CAGUGGCCUAGGCAGUAU | 18 | 4231 |
| MYOC-P370L-283 | + | CCAGUGGCCUAGGCAGUAU | 19 | 4232 |

TABLE 22E-continued

| 5th Tier | | | | |
|---|---|---|---|---|
| gRNA Name | DNA Strand | Targeting Domain | Target Site Length | SEQ ID NO |
| MYOC-P370L-284 | + | UCCAGUGGCCUAGGCAGUAU | 20 | 4233 |
| MYOC-P370L-285 | + | UUCCAGUGGCCUAGGCAGUAU | 21 | 4234 |
| MYOC-P370L-286 | + | UUUCCAGUGGCCUAGGCAGUAU | 22 | 4235 |
| MYOC-P370L-287 | + | CUUUCCAGUGGCCUAGGCAGUAU | 23 | 4236 |
| MYOC-P370L-288 | + | GCUUUCCAGUGGCCUAGGCAGUAU | 24 | 4237 |
| MYOC-P370L-289 | + | UAGGCAGUAUGUGAACCU | 18 | 4258 |
| MYOC-P370L-290 | + | CUAGGCAGUAUGUGAACCU | 19 | 4259 |
| MYOC-P370L-291 | + | CCUAGGCAGUAUGUGAACCU | 20 | 4260 |
| MYOC-P370L-292 | + | GCCUAGGCAGUAUGUGAACCU | 21 | 4261 |
| MYOC-P370L-293 | + | GGCCUAGGCAGUAUGUGAACCU | 22 | 4262 |
| MYOC-P370L-294 | + | UGGCCUAGGCAGUAUGUGAACCU | 23 | 4263 |
| MYOC-P370L-295 | + | GUGGCCUAGGCAGUAUGUGAACCU | 24 | 4264 |
| MYOC-P370L-296 | + | AGAUUCUCUGGGUUCAGU | 18 | 4290 |
| MYOC-P370L-297 | + | CAGAUUCUCUGGGUUCAGU | 19 | 4291 |
| MYOC-P370L-298 | + | CCAGAUUCUCUGGGUUCAGU | 20 | 4292 |
| MYOC-P370L-299 | + | UCCAGAUUCUCUGGGUUCAGU | 21 | 4293 |
| MYOC-P370L-300 | + | UUCCAGAUUCUCUGGGUUCAGU | 22 | 4294 |
| MYOC-P370L-301 | + | GUUCCAGAUUCUCUGGGUUCAGU | 23 | 4295 |
| MYOC-P370L-302 | + | AGUUCCAGAUUCUCUGGGUUCAGU | 24 | 4296 |
| MYOC-P370L-303 | + | UCAUAUCUUAUGACAGUU | 18 | 4337 |
| MYOC-P370L-304 | + | CUCAUAUCUUAUGACAGUU | 19 | 4338 |
| MYOC-P370L-305 | + | GCUCAUAUCUUAUGACAGUU | 20 | 1821 |
| MYOC-P370L-306 | + | AGCUCAUAUCUUAUGACAGUU | 21 | 4339 |
| MYOC-P370L-307 | + | CAGCUCAUAUCUUAUGACAGUU | 22 | 4340 |
| MYOC-P370L-308 | + | UCAGCUCAUAUCUUAUGACAGUU | 23 | 4341 |
| MYOC-P370L-309 | + | UUCAGCUCAUAUCUUAUGACAGUU | 24 | 4342 |
| MYOC-P370L-310 | + | GAUUCUCUGGGUUCAGUU | 18 | 4343 |
| MYOC-P370L-311 | + | AGAUUCUCUGGGUUCAGUU | 19 | 4344 |
| MYOC-P370L-118 | + | CAGAUUCUCUGGGUUCAGUU | 20 | 797 |
| MYOC-P370L-312 | + | CCAGAUUCUCUGGGUUCAGUU | 21 | 4345 |
| MYOC-P370L-313 | + | UCCAGAUUCUCUGGGUUCAGUU | 22 | 4346 |
| MYOC-P370L-314 | + | UUCCAGAUUCUCUGGGUUCAGUU | 23 | 4347 |
| MYOC-P370L-315 | + | GUUCCAGAUUCUCUGGGUUCAGUU | 24 | 4348 |
| MYOC-P370L-316 | - | GCCAUUGUCCUCUCCAAA | 18 | 4356 |
| MYOC-P370L-317 | - | UGCCAUUGUCCUCUCCAAA | 19 | 4357 |
| MYOC-P370L-318 | - | GUGCCAUUGUCCUCUCCAAA | 20 | 4358 |
| MYOC-P370L-319 | - | GGUGCCAUUGUCCUCUCCAAA | 21 | 4359 |

TABLE 22E-continued

| 5th Tier | | | | |
|---|---|---|---|---|
| gRNA Name | DNA Strand | Targeting Domain | Target Site Length | SEQ ID NO |
| MYOC-P370L-320 | - | AGGUGCCAUUGUCCUCUCCAAA | 22 | 4360 |
| MYOC-P370L-321 | - | AAGGUGCCAUUGUCCUCUCCAAA | 23 | 4361 |
| MYOC-P370L-322 | - | AAAGGUGCCAUUGUCCUCUCCAAA | 24 | 4362 |
| MYOC-P370L-323 | - | GAGCUGAAUACCGAGACA | 18 | 4389 |
| MYOC-P370L-324 | - | UGAGCUGAAUACCGAGACA | 19 | 4390 |
| MYOC-P370L-325 | - | AUGAGCUGAAUACCGAGACA | 20 | 1809 |
| MYOC-P370L-326 | - | UAUGAGCUGAAUACCGAGACA | 21 | 4391 |
| MYOC-P370L-327 | - | AUAUGAGCUGAAUACCGAGACA | 22 | 4392 |
| MYOC-P370L-328 | - | GAUAUGAGCUGAAUACCGAGACA | 23 | 4393 |
| MYOC-P370L-329 | - | AGAUAUGAGCUGAAUACCGAGACA | 24 | 4394 |
| MYOC-P370L-330 | - | CACAUACUGCCUAGGCCA | 18 | 4395 |
| MYOC-P370L-331 | - | UCACAUACUGCCUAGGCCA | 19 | 4396 |
| MYOC-P370L-332 | - | UUCACAUACUGCCUAGGCCA | 20 | 4397 |
| MYOC-P370L-333 | - | GUUCACAUACUGCCUAGGCCA | 21 | 4398 |
| MYOC-P370L-334 | - | GGUUCACAUACUGCCUAGGCCA | 22 | 4399 |
| MYOC-P370L-335 | - | AGGUUCACAUACUGCCUAGGCCA | 23 | 4400 |
| MYOC-P370L-336 | - | AAGGUUCACAUACUGCCUAGGCCA | 24 | 4401 |
| MYOC-P370L-337 | - | AGACAGUGAAGGCUGAGA | 18 | 4433 |
| MYOC-P370L-338 | - | GAGACAGUGAAGGCUGAGA | 19 | 4434 |
| MYOC-P370L-112 | - | CGAGACAGUGAAGGCUGAGA | 20 | 405 |
| MYOC-P370L-339 | - | CCGAGACAGUGAAGGCUGAGA | 21 | 4435 |
| MYOC-P370L-340 | - | ACCGAGACAGUGAAGGCUGAGA | 22 | 4436 |
| MYOC-P370L-341 | - | UACCGAGACAGUGAAGGCUGAGA | 23 | 4437 |
| MYOC-P370L-342 | - | AUACCGAGACAGUGAAGGCUGAGA | 24 | 4438 |
| MYOC-P370L-343 | - | UAAGAUAUGAGCUGAAUA | 18 | 4465 |
| MYOC-P370L-344 | - | AUAAGAUAUGAGCUGAAUA | 19 | 4466 |
| MYOC-P370L-345 | - | CAUAAGAUAUGAGCUGAAUA | 20 | 1808 |
| MYOC-P370L-346 | - | UCAUAAGAUAUGAGCUGAAUA | 21 | 4467 |
| MYOC-P370L-347 | - | GUCAUAAGAUAUGAGCUGAAUA | 22 | 4468 |
| MYOC-P370L-348 | - | UGUCAUAAGAUAUGAGCUGAAUA | 23 | 4469 |
| MYOC-P370L-349 | - | CUGUCAUAAGAUAUGAGCUGAAUA | 24 | 4470 |
| MYOC-P370L-350 | - | UCUGGAACUCGAACAAAC | 18 | 4478 |
| MYOC-P370L-351 | - | AUCUGGAACUCGAACAAAC | 19 | 4479 |
| MYOC-P370L-352 | - | AAUCUGGAACUCGAACAAAC | 20 | 4480 |
| MYOC-P370L-353 | - | GAAUCUGGAACUCGAACAAAC | 21 | 4481 |
| MYOC-P370L-354 | - | AGAAUCUGGAACUCGAACAAAC | 22 | 4482 |
| MYOC-P370L-355 | - | GAGAAUCUGGAACUCGAACAAAC | 23 | 4483 |
| MYOC-P370L-356 | - | AGAGAAUCUGGAACUCGAACAAAC | 24 | 4484 |

TABLE 22E-continued

| 5th Tier | | | | |
|---|---|---|---|---|
| gRNA Name | DNA Strand | Targeting Domain | Target Site Length | SEQ ID NO |
| MYOC-P370L-357 | - | ACCCAGAGAAUCUGGAAC | 18 | 4491 |
| MYOC-P370L-358 | - | AACCCAGAGAAUCUGGAAC | 19 | 4492 |
| MYOC-P370L-359 | - | GAACCCAGAGAAUCUGGAAC | 20 | 4493 |
| MYOC-P370L-360 | - | UGAACCCAGAGAAUCUGGAAC | 21 | 4494 |
| MYOC-P370L-361 | - | CUGAACCCAGAGAAUCUGGAAC | 22 | 4495 |
| MYOC-P370L-362 | - | ACUGAACCCAGAGAAUCUGGAAC | 23 | 4496 |
| MYOC-P370L-363 | - | AACUGAACCCAGAGAAUCUGGAAC | 24 | 4497 |
| MYOC-P370L-364 | - | ACAUACUGCCUAGGCCAC | 18 | 4505 |
| MYOC-P370L-365 | - | CACAUACUGCCUAGGCCAC | 19 | 4506 |
| MYOC-P370L-56 | - | UCACAUACUGCCUAGGCCAC | 20 | 755 |
| MYOC-P370L-366 | - | UUCACAUACUGCCUAGGCCAC | 21 | 4507 |
| MYOC-P370L-367 | - | GUUCACAUACUGCCUAGGCCAC | 22 | 4508 |
| MYOC-P370L-368 | - | GGUUCACAUACUGCCUAGGCCAC | 23 | 4509 |
| MYOC-P370L-369 | - | AGGUUCACAUACUGCCUAGGCCAC | 24 | 4510 |
| MYOC-P370L-370 | - | UAUUCUUGGGGUGGCUAC | 18 | 4517 |
| MYOC-P370L-371 | - | GUAUUCUUGGGGUGGCUAC | 19 | 4518 |
| MYOC-P370L-372 | - | CGUAUUCUUGGGGUGGCUAC | 20 | 1816 |
| MYOC-P370L-373 | - | CCGUAUUCUUGGGGUGGCUAC | 21 | 4519 |
| MYOC-P370L-374 | - | CCCGUAUUCUUGGGGUGGCUAC | 22 | 4520 |
| MYOC-P370L-375 | - | UCCCGUAUUCUUGGGGUGGCUAC | 23 | 4521 |
| MYOC-P370L-376 | - | UUCCCGUAUUCUUGGGGUGGCUAC | 24 | 4522 |
| MYOC-P370L-377 | - | ACGGGUGCUGUGGUGUAC | 18 | 4530 |
| MYOC-P370L-378 | - | CACGGGUGCUGUGGUGUAC | 19 | 4531 |
| MYOC-P370L-379 | - | GCACGGGUGCUGUGGUGUAC | 20 | 4532 |
| MYOC-P370L-380 | - | AGCACGGGUGCUGUGGUGUAC | 21 | 4533 |
| MYOC-P370L-381 | - | AAGCACGGGUGCUGUGGUGUAC | 22 | 4534 |
| MYOC-P370L-382 | - | AAAGCACGGGUGCUGUGGUGUAC | 23 | 4535 |
| MYOC-P370L-383 | - | GAAAGCACGGGUGCUGUGGUGUAC | 24 | 4536 |
| MYOC-P370L-384 | - | CUGGAACUCGAACAAACC | 18 | 4537 |
| MYOC-P370L-385 | - | UCUGGAACUCGAACAAACC | 19 | 4538 |
| MYOC-P370L-59 | - | AUCUGGAACUCGAACAAACC | 20 | 766 |
| MYOC-P370L-386 | - | AAUCUGGAACUCGAACAAACC | 21 | 4539 |
| MYOC-P370L-387 | - | GAAUCUGGAACUCGAACAAACC | 22 | 4540 |
| MYOC-P370L-388 | - | AGAAUCUGGAACUCGAACAAACC | 23 | 4541 |
| MYOC-P370L-389 | - | GAGAAUCUGGAACUCGAACAAACC | 24 | 4542 |
| MYOC-P370L-390 | - | UCCUCUCCAAACUGAACC | 18 | 4543 |
| MYOC-P370L-391 | - | GUCCUCUCCAAACUGAACC | 19 | 4544 |

TABLE 22E-continued

| 5th Tier | | | | |
|---|---|---|---|---|
| gRNA Name | DNA Strand | Targeting Domain | Target Site Length | SEQ ID NO |
| MYOC-P370L-392 | - | UGUCCUCUCCAAACUGAACC | 20 | 4545 |
| MYOC-P370L-393 | - | UUGUCCUCUCCAAACUGAACC | 21 | 4546 |
| MYOC-P370L-394 | - | AUUGUCCUCUCCAAACUGAACC | 22 | 4547 |
| MYOC-P370L-395 | - | CAUUGUCCUCUCCAAACUGAACC | 23 | 4548 |
| MYOC-P370L-396 | - | CCAUUGUCCUCUCCAAACUGAACC | 24 | 4549 |
| MYOC-P370L-397 | - | UCCCUGGAGCUGGCUACC | 18 | 4557 |
| MYOC-P370L-398 | - | AUCCCUGGAGCUGGCUACC | 19 | 4558 |
| MYOC-P370L-399 | - | AAUCCCUGGAGCUGGCUACC | 20 | 1814 |
| MYOC-P370L-400 | - | AAAUCCCUGGAGCUGGCUACC | 21 | 4559 |
| MYOC-P370L-401 | - | GAAAUCCCUGGAGCUGGCUACC | 22 | 4560 |
| MYOC-P370L-402 | - | GGAAAUCCCUGGAGCUGGCUACC | 23 | 4561 |
| MYOC-P370L-403 | - | AGGAAAUCCCUGGAGCUGGCUACC | 24 | 4562 |
| MYOC-P370L-404 | - | GGCUGAGAAGGAAAUCCC | 18 | 4581 |
| MYOC-P370L-405 | - | AGGCUGAGAAGGAAAUCCC | 19 | 4582 |
| MYOC-P370L-61 | - | AAGGCUGAGAAGGAAAUCCC | 20 | 406 |
| MYOC-P370L-406 | - | GAAGGCUGAGAAGGAAAUCCC | 21 | 4583 |
| MYOC-P370L-407 | - | UGAAGGCUGAGAAGGAAAUCCC | 22 | 4584 |
| MYOC-P370L-408 | - | GUGAAGGCUGAGAAGGAAAUCCC | 23 | 4585 |
| MYOC-P370L-409 | - | AGUGAAGGCUGAGAAGGAAAUCCC | 24 | 4586 |
| MYOC-P370L-410 | - | AGGCUGAGAAGGAAAUCC | 18 | 4593 |
| MYOC-P370L-411 | - | AAGGCUGAGAAGGAAAUCC | 19 | 4594 |
| MYOC-P370L-412 | - | GAAGGCUGAGAAGGAAAUCC | 20 | 1813 |
| MYOC-P370L-413 | - | UGAAGGCUGAGAAGGAAAUCC | 21 | 4595 |
| MYOC-P370L-414 | - | GUGAAGGCUGAGAAGGAAAUCC | 22 | 4596 |
| MYOC-P370L-415 | - | AGUGAAGGCUGAGAAGGAAAUCC | 23 | 4597 |
| MYOC-P370L-416 | - | CAGUGAAGGCUGAGAAGGAAAUCC | 24 | 4598 |
| MYOC-P370L-417 | - | AACUGAACCCAGAGAAUC | 18 | 4636 |
| MYOC-P370L-418 | - | AAACUGAACCCAGAGAAUC | 19 | 4637 |
| MYOC-P370L-65 | - | CAAACUGAACCCAGAGAAUC | 20 | 765 |
| MYOC-P370L-419 | - | CCAAACUGAACCCAGAGAAUC | 21 | 4638 |
| MYOC-P370L-420 | - | UCCAAACUGAACCCAGAGAAUC | 22 | 4639 |
| MYOC-P370L-421 | - | CUCCAAACUGAACCCAGAGAAUC | 23 | 4640 |
| MYOC-P370L-422 | - | UCUCCAAACUGAACCCAGAGAAUC | 24 | 4641 |
| MYOC-P370L-423 | - | GGGUGCUGUGGUGUACUC | 18 | 4648 |
| MYOC-P370L-424 | - | CGGGUGCUGUGGUGUACUC | 19 | 4649 |
| MYOC-P370L-66 | - | ACGGGUGCUGUGGUGUACUC | 20 | 760 |
| MYOC-P370L-425 | - | CACGGGUGCUGUGGUGUACUC | 21 | 4650 |
| MYOC-P370L-426 | - | GCACGGGUGCUGUGGUGUACUC | 22 | 4651 |

TABLE 22E-continued

| 5th Tier | | | | |
|---|---|---|---|---|
| gRNA Name | DNA Strand | Targeting Domain | Target Site Length | SEQ ID NO |
| MYOC-P370L-427 | - | AGCACGGGUGCUGUGGUGUACUC | 23 | 4652 |
| MYOC-P370L-428 | - | AAGCACGGGUGCUGUGGUGUACUC | 24 | 4653 |
| MYOC-P370L-429 | - | UUUCCAGGGCGCUGAGUC | 18 | 4666 |
| MYOC-P370L-430 | - | AUUUCCAGGGCGCUGAGUC | 19 | 4667 |
| MYOC-P370L-431 | - | UAUUUCCAGGGCGCUGAGUC | 20 | 4668 |
| MYOC-P370L-432 | - | CUAUUUCCAGGGCGCUGAGUC | 21 | 4669 |
| MYOC-P370L-433 | - | UCUAUUUCCAGGGCGCUGAGUC | 22 | 4670 |
| MYOC-P370L-434 | - | CUCUAUUUCCAGGGCGCUGAGUC | 23 | 4671 |
| MYOC-P370L-435 | - | CCUCUAUUUCCAGGGCGCUGAGUC | 24 | 4672 |
| MYOC-P370L-436 | - | CGGACAGUUCCCGUAUUC | 18 | 4679 |
| MYOC-P370L-437 | - | ACGGACAGUUCCCGUAUUC | 19 | 4680 |
| MYOC-P370L-438 | - | CACGGACAGUUCCCGUAUUC | 20 | 1815 |
| MYOC-P370L-439 | - | CCACGGACAGUUCCCGUAUUC | 21 | 4681 |
| MYOC-P370L-440 | - | ACCACGGACAGUUCCCGUAUUC | 22 | 4682 |
| MYOC-P370L-441 | - | UACCACGGACAGUUCCCGUAUUC | 23 | 4683 |
| MYOC-P370L-442 | - | CUACCACGGACAGUUCCCGUAUUC | 24 | 4684 |
| MYOC-P370L-443 | - | UCGGGGAGCCUCUAUUUC | 18 | 4699 |
| MYOC-P370L-444 | - | CUCGGGGAGCCUCUAUUUC | 19 | 4700 |
| MYOC-P370L-445 | - | ACUCGGGGAGCCUCUAUUUC | 20 | 4701 |
| MYOC-P370L-446 | - | UACUCGGGGAGCCUCUAUUUC | 21 | 4702 |
| MYOC-P370L-447 | - | GUACUCGGGGAGCCUCUAUUUC | 22 | 4703 |
| MYOC-P370L-448 | - | UGUACUCGGGGAGCCUCUAUUUC | 23 | 4704 |
| MYOC-P370L-449 | - | GUGUACUCGGGGAGCCUCUAUUUC | 24 | 4705 |
| MYOC-P370L-450 | - | GAGACAGUGAAGGCUGAG | 18 | 4756 |
| MYOC-P370L-451 | - | CGAGACAGUGAAGGCUGAG | 19 | 4757 |
| MYOC-P370L-452 | - | CCGAGACAGUGAAGGCUGAG | 20 | 1812 |
| MYOC-P370L-453 | - | ACCGAGACAGUGAAGGCUGAG | 21 | 4758 |
| MYOC-P370L-454 | - | UACCGAGACAGUGAAGGCUGAG | 22 | 4759 |
| MYOC-P370L-455 | - | AUACCGAGACAGUGAAGGCUGAG | 23 | 4760 |
| MYOC-P370L-456 | - | AAUACCGAGACAGUGAAGGCUGAG | 24 | 4761 |
| MYOC-P370L-457 | - | GGGUCAUUUACAGCACCG | 18 | 4782 |
| MYOC-P370L-458 | - | UGGGUCAUUUACAGCACCG | 19 | 4783 |
| MYOC-P370L-459 | - | CUGGGUCAUUUACAGCACCG | 20 | 1820 |
| MYOC-P370L-460 | - | UCUGGGUCAUUUACAGCACCG | 21 | 4784 |
| MYOC-P370L-461 | - | CUCUGGGUCAUUUACAGCACCG | 22 | 4785 |
| MYOC-P370L-462 | - | CCUCUGGGUCAUUUACAGCACCG | 23 | 4786 |
| MYOC-P370L-463 | - | GCCUCUGGGUCAUUUACAGCACCG | 24 | 4787 |

TABLE 22E-continued

| 5th Tier | | | | |
|---|---|---|---|---|
| gRNA Name | DNA Strand | Targeting Domain | Target Site Length | SEQ ID NO |
| MYOC-P370L-464 | - | GGUGCUGUGGUGUACUCG | 18 | 4788 |
| MYOC-P370L-465 | - | GGGUGCUGUGGUGUACUCG | 19 | 4789 |
| MYOC-P370L-72 | - | CGGGUGCUGUGGUGUACUCG | 20 | 761 |
| MYOC-P370L-466 | - | ACGGGUGCUGUGGUGUACUCG | 21 | 4790 |
| MYOC-P370L-467 | - | CACGGGUGCUGUGGUGUACUCG | 22 | 4791 |
| MYOC-P370L-468 | - | GCACGGGUGCUGUGGUGUACUCG | 23 | 4792 |
| MYOC-P370L-469 | - | AGCACGGGUGCUGUGGUGUACUCG | 24 | 4793 |
| MYOC-P370L-470 | - | AUACCGAGACAGUGAAGG | 18 | 4812 |
| MYOC-P370L-471 | - | AAUACCGAGACAGUGAAGG | 19 | 4813 |
| MYOC-P370L-472 | - | GAAUACCGAGACAGUGAAGG | 20 | 1810 |
| MYOC-P370L-473 | - | UGAAUACCGAGACAGUGAAGG | 21 | 4814 |
| MYOC-P370L-474 | - | CUGAAUACCGAGACAGUGAAGG | 22 | 4815 |
| MYOC-P370L-475 | - | GCUGAAUACCGAGACAGUGAAGG | 23 | 4816 |
| MYOC-P370L-476 | - | AGCUGAAUACCGAGACAGUGAAGG | 24 | 4817 |
| MYOC-P370L-477 | - | ACAUUGACUUGGCUGUGG | 18 | 4855 |
| MYOC-P370L-478 | - | GACAUUGACUUGGCUGUGG | 19 | 4856 |
| MYOC-P370L-479 | - | GGACAUUGACUUGGCUGUGG | 20 | 1818 |
| MYOC-P370L-480 | - | CGGACAUUGACUUGGCUGUGG | 21 | 4857 |
| MYOC-P370L-481 | - | ACGGACAUUGACUUGGCUGUGG | 22 | 4858 |
| MYOC-P370L-482 | - | CACGGACAUUGACUUGGCUGUGG | 23 | 4859 |
| MYOC-P370L-483 | - | ACACGGACAUUGACUUGGCUGUGG | 24 | 4860 |
| MYOC-P370L-484 | - | AAACUGAACCCAGAGAAU | 18 | 4925 |
| MYOC-P370L-485 | - | CAAACUGAACCCAGAGAAU | 19 | 4926 |
| MYOC-P370L-486 | - | CCAAACUGAACCCAGAGAAU | 20 | 4927 |
| MYOC-P370L-487 | - | UCCAAACUGAACCCAGAGAAU | 21 | 4928 |
| MYOC-P370L-488 | - | CUCCAAACUGAACCCAGAGAAU | 22 | 4929 |
| MYOC-P370L-489 | - | UCUCCAAACUGAACCCAGAGAAU | 23 | 4930 |
| MYOC-P370L-490 | - | CUCUCCAAACUGAACCCAGAGAAU | 24 | 4931 |
| MYOC-P370L-491 | - | CCAGAACUGUCAUAAGAU | 18 | 4945 |
| MYOC-P370L-492 | - | UCCAGAACUGUCAUAAGAU | 19 | 4946 |
| MYOC-P370L-493 | - | GUCCAGAACUGUCAUAAGAU | 20 | 1806 |
| MYOC-P370L-494 | - | AGUCCAGAACUGUCAUAAGAU | 21 | 4947 |
| MYOC-P370L-495 | - | GAGUCCAGAACUGUCAUAAGAU | 22 | 4948 |
| MYOC-P370L-496 | - | UGAGUCCAGAACUGUCAUAAGAU | 23 | 4949 |
| MYOC-P370L-497 | - | CUGAGUCCAGAACUGUCAUAAGAU | 24 | 4950 |
| MYOC-P370L-498 | - | CGGGUGCUGUGGUGUACU | 18 | 4972 |
| MYOC-P370L-499 | - | ACGGGUGCUGUGGUGUACU | 19 | 4973 |
| MYOC-P370L-78 | - | CACGGGUGCUGUGGUGUACU | 20 | 759 |

TABLE 22E-continued

| 5th Tier | | | | |
|---|---|---|---|---|
| gRNA Name | DNA Strand | Targeting Domain | Target Site Length | SEQ ID NO |
| MYOC-P370L-500 | - | GCACGGGUGCUGUGGUGUACU | 21 | 4974 |
| MYOC-P370L-501 | - | AGCACGGGUGCUGUGGUGUACU | 22 | 4975 |
| MYOC-P370L-502 | - | AAGCACGGGUGCUGUGGUGUACU | 23 | 4976 |
| MYOC-P370L-503 | - | AAAGCACGGGUGCUGUGGUGUACU | 24 | 4977 |
| MYOC-P370L-504 | - | UGGAACUCGAACAAACCU | 18 | 4978 |
| MYOC-P370L-505 | - | CUGGAACUCGAACAAACCU | 19 | 4979 |
| MYOC-P370L-79 | - | UCUGGAACUCGAACAAACCU | 20 | 767 |
| MYOC-P370L-506 | - | AUCUGGAACUCGAACAAACCU | 21 | 4980 |
| MYOC-P370L-507 | - | AAUCUGGAACUCGAACAAACCU | 22 | 4981 |
| MYOC-P370L-508 | - | GAAUCUGGAACUCGAACAAACCU | 23 | 4982 |
| MYOC-P370L-509 | - | AGAAUCUGGAACUCGAACAAACCU | 24 | 4983 |
| MYOC-P370L-510 | - | ACCGAGACAGUGAAGGCU | 18 | 5003 |
| MYOC-P370L-511 | - | UACCGAGACAGUGAAGGCU | 19 | 5004 |
| MYOC-P370L-512 | - | AUACCGAGACAGUGAAGGCU | 20 | 1811 |
| MYOC-P370L-513 | - | AAUACCGAGACAGUGAAGGCU | 21 | 5005 |
| MYOC-P370L-514 | - | GAAUACCGAGACAGUGAAGGCU | 22 | 5006 |
| MYOC-P370L-515 | - | UGAAUACCGAGACAGUGAAGGCU | 23 | 5007 |
| MYOC-P370L-516 | - | CUGAAUACCGAGACAGUGAAGGCU | 24 | 5008 |

Table 23A provides exemplary targeting domains for correcting a mutation (e.g., P370L) in the MYOC gene selected according to the third tier parameters. The targeting domains bind within 200 bp from a mutation (e.g., P370L) and start with a 5'G. It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 23A

| 3rd Tier | | | | |
|---|---|---|---|---|
| gRNA Name | DNA Strand | Targeting Domain | Target Site Length | SEQ ID NO |
| MYOC-P370L-517 | + | GUGCUGUAAAUGACCCAGAG | 20 | 5137 |

Table 23B provides exemplary targeting domains for correcting a mutation (e.g., P370L) in the MYOC gene selected according to the fourth tier parameters. The targeting domains bind within 200 bp from a mutation (e.g., P370L). It is contemplated herein that in an embodiment the targeting domain hybridizes to the target domain through complementary base pairing. Any of the targeting domains in the Table can be used with a *N. meningitidis* Cas9 molecule that generates a double stranded break (Cas9 nuclease) or a single-stranded break (Cas9 nickase).

TABLE 23B

| 4th Tier | | | | |
|---|---|---|---|---|
| gRNA Name | DNA Strand | Targeting Domain | Target Site Length | SEQ ID NO |
| MYOC-P370L-518 | + | CGAGUACACCACAGCAC | 17 | 5116 |
| MYOC-P370L-519 | + | UCCGUGGUAGCCAGCUC | 17 | 1842 |
| MYOC-P370L-520 | + | CUGUAAAUGACCCAGAG | 17 | 5120 |
| MYOC-P370L-521 | + | UGAAGGCAUUGGCGACU | 17 | 5124 |
| MYOC-P370L-522 | + | CCCAGGUUUGUUCGAGU | 17 | 2854 |
| MYOC-P370L-523 | + | CCCCGAGUACACCACAGCAC | 20 | 5133 |
| MYOC-P370L-263 | + | CUGUCCGUGGUAGCCAGCUC | 20 | 1822 |
| MYOC-P370L-524 | + | UGAUGAAGGCAUUGGCGACU | 20 | 5140 |

TABLE 23B-continued

| 4th Tier | | | | |
|---|---|---|---|---|
| gRNA Name | DNA Strand | Targeting Domain | Target Site Length | SEQ ID NO |
| MYOC-P370L-525 | + | UCUCCCAGGUUUGUUCGAGU | 20 | 2848 |

III. Cas9 Molecules

Cas9 molecules of a variety of species can be used in the methods and compositions described herein. While the *S. pyogenes, S. aureus* and *S. thermophilus* Cas9 molecules are the subject of much of the disclosure herein, Cas9 molecules of, derived from, or based on the Cas9 proteins of other species listed herein can be used as well. In other words, while the much of the description herein uses *S. pyogenes* and *S. thermophilus* Cas9 molecules, Cas9 molecules from the other species can replace them, e.g., *Staphylococcus aureus* and *Neisseria meningitidis* Cas9 molecules. Additional Cas9 species include: *Acidovorax avenae, Actinobacillus pleuropneumoniae, Actinobacillus succinogenes, Actinobacillus suis, Actinomyces* sp., *Cychphilus denitrificans, Aminomonas paucivorans, Bacillus cereus, Bacillus smithii, Bacillus thuringiensis, Bacteroides* sp., *Blastopirellula marina, Bradyrhizobium* sp., *Brevi bacillus laterosporus, Campylobacter coli, Campylobacter jejuni, Campylobacter lari, Candidatus puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, Gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria meningitidis, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tistrella mobilis, Treponema* sp., or *Verminephrobacter eiseniae.*

A Cas9 molecule or Cas 9 polypeptide, as that term is used herein, refers to a molecule or polypeptide that can interact with a guide RNA (gRNA) molecule and, in concert with the gRNA molecule, home or localizes to a site which comprises a target domain and PAM sequence.

Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule or a sequence of Table 25.

Cas9 Domains

Crystal structures have been determined for two different naturally occurring bacterial Cas9 molecules (Jinek et al., Science, 343(6176):1247997, 2014) and for *S. pyogenes* Cas9 with a guide RNA (e.g., a synthetic fusion of crRNA and tracrRNA) (Nishimasu et al., Cell, 156:935-949, 2014; and Anders et al., Nature, 2014, doi: 10.1038/nature13579).

Figure 9A:
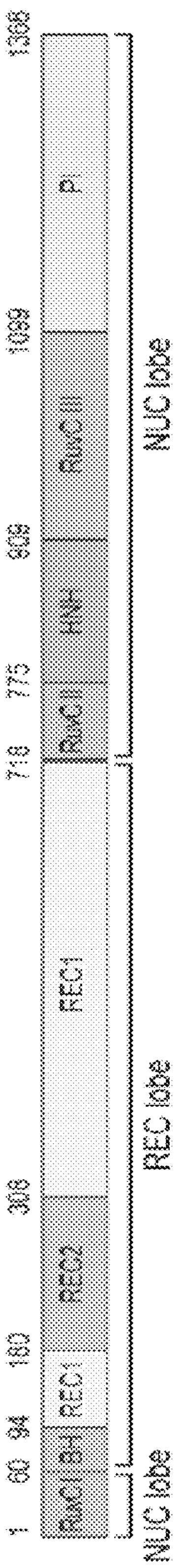
FIGS. 9A and 9B are schematic representations of the domain organization of *S. pyogenes* Cas 9.
Figure 9B:
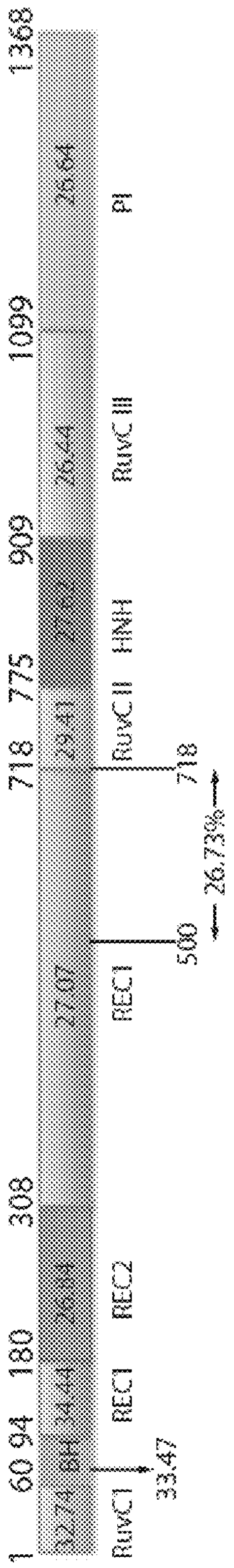

A naturally occurring Cas9 molecule comprises two lobes: a recognition (REC) lobe and a nuclease (NUC) lobe; each of which further comprises domains described herein. FIGS. 9A-9B provide a schematic of the organization of important Cas9 domains in the primary structure. The domain nomenclature and the numbering of the amino acid residues encompassed by each domain used throughout this disclosure is as described in Nishimasu et al. The numbering of the amino acid residues is with reference to Cas9 from *S. pyogenes.*

The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long α helix and arginine rich region and comprises amino acids 60-93 of the sequence of *S. pyogenes* Cas9. The REC1 domain is important for recognition of the repeat: anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat: anti-repeat duplex. The REC2 domain comprises amino acids 180-307 of the sequence of *S. pyogenes* Cas9.

The NUC lobe comprises the RuvC domain (also referred to herein as RuvC-like domain), the HNH domain (also referred to herein as HNH-like domain), and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

A RuvC-Like Domain and an HNH-Like Domain

In an embodiment, a Cas9 molecule or Cas9 polypeptide comprises an HNH-like domain and a RuvC-like domain. In an embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In an embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

RuvC-Like Domains

In an embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain. Exemplary N-terminal RuvC-like domains are described below.

In an embodiment, an eaCas9 molecule or eaCas9 polypeptide comprises an N-terminal RuvC-like domain comprising an amino acid sequence of formula I:

```
                                    (SEQ ID NO: 8)
D-X1-G-X2-X3-X4-X5-G-X6-X7-X8-X9,
```

wherein,

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X4 is selected from S, Y, N and F (e.g., S);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent (e.g., selected from T, V, I, L, Δ, F, S, A, Y, M and R, or, e.g., selected from T, V, I, L and Δ).

In an embodiment, the N-terminal RuvC-like domain differs from a sequence of SEQ ID NO:8, by as many as 1 but no more than 2, 3, 4, or 5 residues.

In embodiment, the N-terminal RuvC-like domain is cleavage competent.

In embodiment, the N-terminal RuvC-like domain is cleavage incompetent.

In an embodiment, a eaCas9 molecule or eaCas9 polypeptide comprises an N-terminal RuvC-like domain comprising an amino acid sequence of formula II:

```
                                    (SEQ ID NO: 9)
D-X1-G-X2-X3-S-X5-G-X6-X7-X8-X9,,
```

wherein

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:9 by as many as 1 but no more than 2, 3, 4, or 5 residues.

In an embodiment, the N-terminal RuvC-like domain comprises an amino acid sequence of formula III:

```
                                    (SEQ ID NO: 10)
D-I-G-X2-X3-S-V-G-W-A-X8-X9,
```

wherein

X2 is selected from T, I, V, S, N, Y, E and L (e.g., selected from T, V, and I);

X3 is selected from N, S, G, A, D, T, R, M and F (e.g., A or N);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:10 by as many as 1 but no more than, 2, 3, 4, or 5 residues.

In an embodiment, the N-terminal RuvC-like domain comprises an amino acid sequence of formula III:

```
                                    (SEQ ID NO: 11)
D-I-G-T-N-S-V-G-W-A-V-X,
```

wherein

X is a non-polar alkyl amino acid or a hydroxyl amino acid, e.g., X is selected from V, I, L and T (e.g., the eaCas9 molecule can comprise an N-terminal RuvC-like domain shown in FIGS. 2A-2G (is depicted as Y)).

In an embodiment, the N-terminal RuvC-like domain differs from a sequence of SEQ ID NO:11 by as many as 1 but no more than, 2, 3, 4, or 5 residues.

In an embodiment, the N-terminal RuvC-like domain differs from a sequence of an N-terminal RuvC like domain disclosed herein, e.g., in FIGS. 3A-3B or FIGS. 7A-7B, as many as 1 but no more than 2, 3, 4, or 5 residues. In an embodiment, 1, 2, 3 or all of the highly conserved residues identified in FIGS. 3A-3B or FIGS. 7A-7B are present.

In an embodiment, the N-terminal RuvC-like domain differs from a sequence of an N-terminal RuvC-like domain disclosed herein, e.g., in FIGS. 4A-4B or FIGS. 7A-7B, as many as 1 but no more than 2, 3, 4, or 5 residues. In an embodiment, 1, 2, or all of the highly conserved residues identified in FIGS. 4A-4B or FIGS. 7A-7B are present.

Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In an embodiment, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence:

```
(SEQ ID NO: 12)
I-X1-X2-E-X3-A-R-E,
```

wherein
- X1 is V or H,
- X2 is I, L or V (e.g., I or V); and
- X3 is M or T.

In an embodiment, the additional RuvC-like domain comprises the amino acid sequence:

```
(SEQ ID NO: 13)
I-V-X2-E-M-A-R-E,
```

wherein
- X2 is I, L or V (e.g., I or V) (e.g., the eaCas9 molecule or eaCas9 polypeptide can comprise an additional RuvC-like domain shown in FIG. 2A-2G or FIGS. 7A-7B (depicted as B)).

An additional RuvC-like domain can comprise an amino acid sequence:

```
(SEQ ID NO: 14)
H-H-A-X1-D-A-X2-X3,
```

wherein
- X1 is H or L;
- X2 is R or V; and
- X3 is E or V.

In an embodiment, the additional RuvC-like domain comprises the amino acid sequence:

```
(SEQ ID NO: 15)
H-H-A-H-D-A-Y-L.
```

In an embodiment, the additional RuvC-like domain differs from a sequence of SEQ ID NO: 12, 13, 14 or 15 by as many as 1 but no more than 2, 3, 4, or 5 residues.

In some embodiments, the sequence flanking the N-terminal RuvC-like domain is a sequences of formula V:

```
(SEQ ID NO: 16)
K-X1'-Y-X2'-X3'-X4'-Z-T-D-X9'-Y,.
```

wherein
- X1' is selected from K and P,
- X2' is selected from V, L, I, and F (e.g., V, I and L);
- X3' is selected from G, A and S (e.g., G),
- X4' is selected from L, I, V and F (e.g., L);
- X9' is selected from D, E, N and Q; and
- Z is an N-terminal RuvC-like domain, e.g., as described above.

HNH-Like Domains

In an embodiment, an HNH-like domain cleaves a single stranded complementary domain, e.g., a complementary strand of a double stranded nucleic acid molecule. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

In an embodiment, an eaCas9 molecule or eaCas9 polypeptide comprises an HNH-like domain having an amino acid sequence of formula VI:

```
(SEQ ID NO: 17)
X1-X2-X3-H-X4-X5-P-X6-X7-X8-X9-X10-X11-X12-X13-

X14-X15-N-X16-X17-X18-X19-X20-X21-X22-X23-N,
```

wherein
- X1 is selected from D, E, Q and N (e.g., D and E);
- X2 is selected from L, I, R, Q, V, M and K;
- X3 is selected from D and E;
- X4 is selected from I, V, T, A and L (e.g., A, I and V);
- X5 is selected from V, Y, I, L, F and W (e.g., V, I and L);
- X6 is selected from Q, H, R, K, Y, I, L, F and W;
- X7 is selected from S, A, D, T and K (e.g., S and A);
- X8 is selected from F, L, V, K, Y, M, I, R, A, E, D and Q (e.g., F);
- X9 is selected from L, R, T, I, V, S, C, Y, K, F and G;
- X10 is selected from K, Q, Y, T, F, L, W, M, A, E, G, and S;
- X11 is selected from D, S, N, R, L and T (e.g., D);
- X12 is selected from D, N and S;
- X13 is selected from S, A, T, G and R (e.g., S);
- X14 is selected from I, L, F, S, R, Y, Q, W, D, K and H (e.g., I, L and F);
- X15 is selected from D, S, I, N, E, A, H, F, L, Q, M, G, Y and V;
- X16 is selected from K, L, R, M, T and F (e.g., L, R and K);
- X17 is selected from V, L, I, A and T;
- X18 is selected from L, I, V and A (e.g., L and I);
- X19 is selected from T, V, C, E, S and A (e.g., T and V);
- X20 is selected from R, F, T, W, E, L, N, C, K, V, S, Q, I, Y, H and A;
- X21 is selected from S, P, R, K, N, A, H, Q, G and L;
- X22 is selected from D, G, T, N, S, K, A, I, E, L, Q, R and Y; and
- X23 is selected from K, V, A, E, Y, I, C, L, S, T, G, K, M, D and F.

In an embodiment, a HNH-like domain differs from a sequence of SEQ ID NO: 17 by at least one but no more than, 2, 3, 4, or 5 residues.

In an embodiment, the HNH-like domain is cleavage competent.

In an embodiment, the HNH-like domain is cleavage incompetent.

In an embodiment, an eaCas9 molecule or eaCas9 polypeptide comprises an HNH-like domain comprising an amino acid sequence of formula VII:

```
(SEQ ID NO: 18)
X1-X2-X3-H-X4-X5-P-X6-S-X8-X9-X10-D-D-S-X14-X15-N-

K-V-L-X19-X20-X21-X22-X23-N,
```

wherein
- X1 is selected from D and E;
- X2 is selected from L, I, R, Q, V, M and K;
- X3 is selected from D and E;
- X4 is selected from I, V, T, A and L (e.g., A, I and V);
- X5 is selected from V, Y, I, L, F and W (e.g., V, I and L);
- X6 is selected from Q, H, R, K, Y, I, L, F and W;
- X8 is selected from F, L, V, K, Y, M, I, R, A, E, D and Q (e.g., F);
- X9 is selected from L, R, T, I, V, S, C, Y, K, F and G;
- X10 is selected from K, Q, Y, T, F, L, W, M, A, E, G, and S;
- X14 is selected from I, L, F, S, R, Y, Q, W, D, K and H (e.g., I, L and F);

X15 is selected from D, S, I, N, E, A, H, F, L, Q, M, G, Y and V;

X19 is selected from T, V, C, E, S and A (e.g., T and V);

X20 is selected from R, F, T, W, E, L, N, C, K, V, S, Q, I, Y, H and A;

X21 is selected from S, P, R, K, N, A, H, Q, G and L;

X22 is selected from D, G, T, N, S, K, A, I, E, L, Q, R and Y; and

X23 is selected from K, V, A, E, Y, I, C, L, S, T, G, K, M, D and F.

In an embodiment, the HNH-like domain differs from a sequence of SEQ ID NO: 18 by 1, 2, 3, 4, or 5 residues.

In an embodiment, an eaCas9 molecule or eaCas9 polypeptide comprises an HNH-like domain comprising an amino acid sequence of formula VII:

```
                                     (SEQ ID NO: 19)
X1-V-X3-H-I-V-P-X6-S-X8-X9-X10-D-D-S-X14-X15-N-K-

V-L-T-X20-X21-X22-X23-N,
```

wherein

X1 is selected from D and E;

X3 is selected from D and E;

X6 is selected from Q, H, R, K, Y, I, L and W;

X8 is selected from F, L, V, K, Y, M, I, R, A, E, D and Q (e.g., F);

X9 is selected from L, R, T, I, V, S, C, Y, K, F and G;

X10 is selected from K, Q, Y, T, F, L, W, M, A, E, G, and S;

X14 is selected from I, L, F, S, R, Y, Q, W, D, K and H (e.g., I, L and F);

X15 is selected from D, S, I, N, E, A, H, F, L, Q, M, G, Y and V;

X20 is selected from R, F, T, W, E, L, N, C, K, V, S, Q, I, Y, H and A;

X21 is selected from S, P, R, K, N, A, H, Q, G and L;

X22 is selected from D, G, T, N, S, K, A, I, E, L, Q, R and Y; and

X23 is selected from K, V, A, E, Y, I, C, L, S, T, G, K, M, D and F.

In an embodiment, the HNH-like domain differs from a sequence of SEQ ID NO: 19 by 1, 2, 3, 4, or 5 residues.

In an embodiment, an eaCas9 molecule or eaCas9 polypeptide comprises an HNH-like domain having an amino acid sequence of formula VIII:

```
                                     (SEQ ID NO: 20)
D-X2-D-H-I-X5-P-Q-X7-F-X9-X10-D-X12-S-I-D-N-X16-V-

L-X19-X20-S-X22-X23-N,
```

wherein

X2 is selected from I and V;

X5 is selected from I and V;

X7 is selected from A and S;

X9 is selected from I and L;

X10 is selected from K and T;

X12 is selected from D and N;

X16 is selected from R, K and L; X19 is selected from T and V;

X20 is selected from S and R;

X22 is selected from K, D and A; and

X23 is selected from E, K, G and N (e.g., the eaCas9 molecule or eaCas9 polypeptide can comprise an HNH-like domain as described herein).

In an embodiment, the HNH-like domain differs from a sequence of SEQ ID NO: 20 by as many as 1 but no more than 2, 3, 4, or 5 residues.

In an embodiment, an eaCas9 molecule or eaCas9 polypeptide comprises the amino acid sequence of formula IX:

```
                                     (SEQ ID NO: 21)
L-Y-Y-L-Q-N-G-X1'-D-M-Y-X2'-X3'-X4'-X5'-L-D-I-X6'-

X7'-L-S-X8'-Y-Z-N-R-X9'-K-X10'-D-X11'-V-P,
```

wherein

X1' is selected from K and R;

X2' is selected from V and T;

X3' is selected from G and D;

X4' is selected from E, Q and D;

X5' is selected from E and D;

X6' is selected from D, N and H;

X7' is selected from Y, R and N;

X8' is selected from Q, D and N; X9' is selected from G and E;

X10' is selected from S and G;

X11' is selected from D and N; and

Z is an HNH-like domain, e.g., as described above.

In an embodiment, the eaCas9 molecule or eaCas9 polypeptide comprises an amino acid sequence that differs from a sequence of SEQ ID NO:21 by as many as 1 but no more than 2, 3, 4, or 5 residues.

In an embodiment, the HNH-like domain differs from a sequence of an HNH-like domain disclosed herein, e.g., in FIGS. 5A-5C or FIGS. 7A-7B, as many as 1 but no more than 2, 3, 4, or 5 residues. In an embodiment, 1 or both of the highly conserved residues identified in FIGS. 5A-5C or FIGS. 7A-7B are present.

In an embodiment, the HNH-like domain differs from a sequence of an HNH-like domain disclosed herein, e.g., in FIGS. 6A-6B or FIGS. 7A-7B, as many as 1 but no more than 2, 3, 4, or 5 residues. In an embodiment, 1, 2, all 3 of the highly conserved residues identified in FIGS. 6A-6B or FIGS. 7A-7B are present.

Cas9 Activities

Nuclease and Helicase Activities

In an embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide. In an embodiment, an eaCas9 molecule or eaCas9 polypeptide, comprises one or more of the following activities:

- a nickase activity, i.e., the ability to cleave a single strand, e.g., the non-complementary strand or the complementary strand, of a nucleic acid molecule;
- a double stranded nuclease activity, i.e., the ability to cleave both strands of a double stranded nucleic acid and create a double stranded break, which in an embodiment is the presence of two nickase activities;
- an endonuclease activity;
- an exonuclease activity; and
- a helicase activity, i.e., the ability to unwind the helical structure of a double stranded nucleic acid.

In an embodiment, an enzymatically active Cas9 or an eaCas9 molecule or an eacas9 polypeptide cleaves both DNA strands and results in a double stranded break. In an embodiment, an eaCas9 molecule or eaCas9 polypeptide cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH-like domain. In an embodiment, an eaCas9 molecule or eaCas9 polypeptide comprises cleavage activity associated with an N-terminal RuvC-like domain. In an embodiment, an eaCas9 molecule or eaCas9 polypeptide comprises cleavage activity associated with an HNH-like domain and cleavage activity associated with an N-terminal RuvC-like domain. In an embodiment, an eaCas9 molecule or eaCas9 polypeptide comprises an active, or cleavage competent, HNH-like domain and an inactive, or cleavage incompetent, N-terminal RuvC-like domain. In an embodiment, an eaCas9 molecule or eaCas9 polypeptide comprises an inactive, or cleavage incompetent, HNH-like domain and an active, or cleavage competent, N-terminal RuvC-like domain. Some Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

A Cas9 molecule or Cas9 polypeptide, is a polypeptide that can interact with a guide RNA (gRNA) molecule and, in concert with the gRNA molecule, localizes to a site which comprises a target domain and PAM sequence.

In an embodiment, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. EaCas9 molecules from different bacterial species can recognize different sequence motifs (e.g., PAM sequences). In an embodiment, an eaCas9 molecule of *S. pyogenes* recognizes the sequence motif NGG and directs cleavage of a target nucleic acid sequence 1 to 10, e.g., 3 to 5, base pairs upstream from that sequence. See, e.g., Mali et al., SCIENCE 2013; 339(6121): 823-826. In an embodiment, an eaCas9 molecule of *S. thermophilus* recognizes the sequence motif NGGNG and NNAGAAW (W=A or T) and directs cleavage of a core target nucleic acid sequence 1 to 10, e.g., 3 to 5, base pairs upstream from these sequences. See, e.g., Horvath et al., SCIENCE 2010; 327(5962):167-170, and Deveau et al., J BACTERIOL 2008; 190(4): 1390-1400. In an embodiment, an eaCas9 molecule of *S. mutans* recognizes the sequence motif NGG and/or NAAR (R=A or G) and directs cleavage of a core target nucleic acid sequence 1 to 10, e.g., 3 to 5 base pairs, upstream from this sequence. See, e.g., Deveau et al., J BACTERIOL 2008; 190(4): 1390-1400. In an embodiment, an eaCas9 molecule of *S. aureus* recognizes the sequence motif NNGRR (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRN (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRT (R=A or G) and directs cleavage of a target nucleic acid sequence 1 to 10, e.g., 3 to 5, base pairs upstream from that sequence. In an embodiment, an eaCas9 molecule of *S. aureus* recognizes the sequence motif NNGRRV (R=A or G, V=A, G or C) and directs cleavage of a target nucleic acid sequence 1 to 10, e.g., 3 to 5, base pairs upstream from that sequence. In an embodiment, an eaCas9 molecule of *Neisseria meningitidis* recognizes the sequence motif NNNNGATT or NNNGCTT and directs cleavage of a target nucleic acid sequence 1 to 10, e.g., 3 to 5, base pairs upstream from that sequence. See, e.g., Hou et al., PNAS Early Edition 2013, 1-6. The ability of a Cas9 molecule to recognize a PAM sequence can be determined, e.g., using a transformation assay described in Jinek et al., SCIENCE 2012 337:816. In the aforementioned embodiments, N can be any nucleotide residue, e.g., any of A, G, C or T.

As is discussed herein, Cas9 molecules can be engineered to alter the PAM specificity of the Cas9 molecule.

Exemplary naturally occurring Cas9 molecules are described in Chylinski et al., RNA BIOLOGY 2013 10:5, 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: *S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408). Additional exemplary Cas9 molecules are a Cas9 molecule of *Neisseria meningitidis* (Hou et al., PNAS Early Edition 2013, 1-6 and a *S. aureus* cas9 molecule.

In an embodiment, a Cas9 molecule or Cas9 polypeptide, e.g., an eaCas9 molecule or eaCas9 polypeptide, comprises an amino acid sequence:

- having 60%, 65%, 70%, 75%, 80%, 85%, 90%, 95%, 96%, 97%, 98% or 99% homology with;
- differs at no more than, 2, 5, 10, 15, 20, 30, or 40% of the amino acid residues when compared with;
- differs by at least 1, 2, 5, 10 or 20 amino acids, but by no more than 100, 80, 70, 60, 50, 40 or 30 amino acids from; or
- is identical to any Cas9 molecule sequence described herein, or a naturally occurring Cas9 molecule sequence, e.g., a Cas9 molecule from a species listed herein or described in Chylinski et al., RNA Biology 2013 10:5, 727-737; Hou et al., PNAS Early Edition 2013, 1-6; SEQ ID NO:1-4. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

In an embodiment, a Cas9 molecule or Cas9 polypeptide comprises any of the amino acid sequence of the consensus sequence of FIGS. 2A-2G, wherein "*" indicates any amino acid found in the corresponding position in the amino acid sequence of a Cas9 molecule or Cas9 polypeptide of *S. pyogenes, S. thermophilus, S. mutans* and *L. innocua*, and "–" indicates any amino acid. In an embodiment, a Cas9 molecule differs from the sequence of the consensus sequence of FIGS. 2A-2G by at least 1, but no more than 2, 3, 4, 5, 6, 7, 8, 9, or 10 amino acid residues. In an embodiment, a Cas9 molecule or Cas9 polypeptide comprises the amino acid sequence of SEQ ID NO:7 of FIGS. 7A-7B, wherein "*" indicates any amino acid found in the corresponding position in the amino acid sequence of a Cas9 molecule or Cas9 polypeptide of *S. pyogenes*, or *N. meningitidis*, "–" indicates any amino acid, and "–" indicates any amino acid or absent. In an embodiment, a Cas9 molecule or Cas9 polypeptide differs from the sequence of SEQ ID NO:6 or 7 disclosed in FIGS. 7A-7B by at least 1, but no more than 2, 3, 4, 5, 6, 7, 8, 9, or 10 amino acid residues.

A comparison of the sequence of a number of Cas9 molecules indicate that certain regions are conserved. These are identified below as:

- region 1 (residues 1 to 180, or in the case of region 1' residues 120 to 180)
- region 2 (residues 360 to 480);
- region 3 (residues 660 to 720);
- region 4 (residues 817 to 900); and
- region 5 (residues 900 to 960);

In an embodiment, a Cas9 molecule or Cas9 polypeptide comprises regions 1-5, together with sufficient additional Cas9 molecule sequence to provide a biologically active molecule, e.g., a Cas9 molecule having at least one activity described herein. In an embodiment, each of regions 1-5, independently, have 50%, 60%, 70%, 80%, 85%, 90%, 95%, 96%, 97%, 98% or 99% homology with the corresponding residues of a Cas9 molecule or Cas9 polypeptide described herein, e.g., a sequence from FIGS. 2A-2G or from FIGS. 7A-7B.

In an embodiment, a Cas9 molecule or Cas9 polypeptide, e.g., an eaCas9 molecule or eaCas9 polypeptide, comprises an amino acid sequence referred to as region 1:

- having 50%, 60%, 70%, 80%, 85%, 90%, 95%, 96%, 97%, 98% or 99% homology with amino acids 1-180 (the numbering is according to the motif sequence in FIGS. 2A-2G; 52% of residues in the four Cas9 sequences in FIGS. 2A-2G are conserved) of the amino acid sequence of Cas9 of *S. pyogenes;*
- differs by at least 1, 2, 5, 10 or 20 amino acids but by no more than 90, 80, 70, 60, 50, 40 or 30 amino acids from amino acids 1-180 of the amino acid sequence of Cas9 of *S. pyogenes, S. thermophilus, S. mutans* or *Listeria innocua*; or
- is identical to 1-180 of the amino acid sequence of Cas9 of *S. pyogenes, S. thermophilus, S. mutans* or *L. innocua.*

In an embodiment, a Cas9 molecule or Cas9 polypeptide, e.g., an eaCas9 molecule or eaCas9 polypeptide, comprises an amino acid sequence referred to as region 1':

- having 55%, 60%, 65%, 70%, 75%, 80%, 85%, 90%, 95%, 96%, 97%, 98% or 99% homology with amino acids 120-180 (55% of residues in the four Cas9 sequences in FIGS. 2A-2G are conserved) of the amino acid sequence of Cas9 of *S. pyogenes, S. thermophilus, S. mutans* or *L. innocua;*
- differs by at least 1, 2, or 5 amino acids but by no more than 35, 30, 25, 20 or 10 amino acids from amino acids 120-180 of the amino acid sequence of Cas9 of *S. pyogenes, S. thermophilus, S. mutans* or *L. innocua*; or
- is identical to 120-180 of the amino acid sequence of Cas9 of *S. pyogenes, S. thermophilus, S. mutans* or *L. innocua.*

In an embodiment, a Cas9 molecule or Cas9 polypeptide, e.g., an eaCas9 molecule or eaCas9 polypeptide, comprises an amino acid sequence referred to as region 2:

- having 50%, 55%, 60%, 65%, 70%, 75%, 80%, 85%, 90%, 95%, 96%, 97%, 98% or 99% homology with amino acids 360-480 (52% of residues in the four Cas9 sequences in FIGS. 2A-2G are conserved) of the amino acid sequence of Cas9 of *S. pyogenes, S. thermophilus, S. mutans* or *L. innocua;*
- differs by at least 1, 2, or 5 amino acids but by no more than 35, 30, 25, 20 or 10 amino acids from amino acids 360-480 of the amino acid sequence of Cas9 of *S. pyogenes, S. thermophilus, S. mutans* or *L. innocua*; or
- is identical to 360-480 of the amino acid sequence of Cas9 of *S. pyogenes, S. thermophilus, S. mutans* or *L. innocua.*

In an embodiment, a Cas9 molecule or Cas9 polypeptide, e.g., an eaCas9 molecule or eaCas9 polypeptide, comprises an amino acid sequence referred to as region 3:

- having 55%, 60%, 65%, 70%, 75%, 80%, 85%, 90%, 95%, 96%, 97%, 98%, or 99% homology with amino acids 660-720 (56% of residues in the four Cas9 sequences in FIGS. 2A-2G are conserved) of the amino acid sequence of Cas9 of *S. pyogenes, S. thermophilus, S. mutans* or *L. innocua;*
- differs by at least 1, 2, or 5 amino acids but by no more than 35, 30, 25, 20 or 10 amino acids from amino acids 660-720 of the amino acid sequence of Cas9 of *S. pyogenes, S. thermophilus, S. mutans* or *L. innocua*; or
- is identical to 660-720 of the amino acid sequence of Cas9 of *S. pyogenes, S. thermophilus, S. mutans* or *L. innocua.*

In an embodiment, a Cas9 molecule or Cas9 polypeptide, e.g., an eaCas9 molecule or eaCas9 polypeptide, comprises an amino acid sequence referred to as region 4:
- having 50%, 55%, 60%, 65%, 70%, 75%, 80%, 85%, 90%, 95%, 96%, 97%, 98%, or 99% homology with amino acids 817-900 (55% of residues in the four Cas9 sequences in FIGS. 2A-2G are conserved) of the amino acid sequence of Cas9 of *S. pyogenes, S. thermophilus, S. mutans* or *L. innocua;*
- differs by at least 1, 2, or 5 amino acids but by no more than 35, 30, 25, 20 or 10 amino acids from amino acids 817-900 of the amino acid sequence of Cas9 of *S. pyogenes, S. thermophilus, S. mutans* or *L. innocua*; or
- is identical to 817-900 of the amino acid sequence of Cas9 of *S. pyogenes, S. thermophilus, S. mutans* or *L. innocua.*

In an embodiment, a Cas9 molecule or Cas9 polypeptide, e.g., an eaCas9 molecule or eaCas9 polypeptide, comprises an amino acid sequence referred to as region 5:
- having 50%, 55%, 60%, 65%, 70%, 75%, 80%, 85%, 90%, 95%, 96%, 97%, 98%, or 99% homology with amino acids 900-960 (60% of residues in the four Cas9 sequences in FIGS. 2A-2G are conserved) of the amino acid sequence of Cas9 of *S. pyogenes, S. thermophilus, S. mutans* or *L. innocua;*
- differs by at least 1, 2, or 5 amino acids but by no more than 35, 30, 25, 20 or 10 amino acids from amino acids 900-960 of the amino acid sequence of Cas9 of *S. pyogenes, S. thermophilus, S. mutans* or *L. innocua*; or
- is identical to 900-960 of the amino acid sequence of Cas9 of *S. pyogenes, S. thermophilus, S. mutans* or *L. innocua.*

Engineered or Altered Cas9 Molecules and Cas9 Polypeptides

Cas9 molecules and Cas9 polypeptides described herein, e.g., naturally occurring Cas9 molecules can possess any of a number of properties, including: nickase activity, nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecule or Cas9 polypeptide can include all or a subset of these properties. In typical embodiments, a Cas9 molecule or Cas9 polypeptide have the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptide.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity, (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. E.g., an engineered Cas9 molecule can be altered to recognize a PAM sequence other than that recognized by the endogenous wild-type PI domain. In an embodiment, a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring Cas9 molecules or Cas9 polypeptides to provide an altered Cas9 molecule or Cas9 polypeptides having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids); insertions; or deletions. In an embodiment, a Cas9 molecule or Cas9 polypeptide can comprises one or more mutations or differences, e.g., at least 1, 2, 3, 4, 5, 10, 15, 20, 30, 40 or 50 mutations, but less than 200, 100, or 80 mutations relative to a reference, e.g., a parental, Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein.

Non-Cleaving and Modified-Cleavage Cas9 Molecules and Cas9 Polypeptides

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

Modified Cleavage eaCas9 Molecules and eaCas9 Polypeptides

In an embodiment, an eaCas9 molecule or eaCas9 polypeptide comprises one or more of the following activities: cleavage activity associated with an N-terminal RuvC-like domain; cleavage activity associated with an HNH-like domain; cleavage activity associated with an HNH-like domain and cleavage activity associated with an N-terminal RuvC-like domain.

In an embodiment, an eaCas9 molecule or eaCas9 polypeptide comprises an active, or cleavage competent, HNH-like domain (e.g., an HNH-like domain described herein, e.g., SEQ ID NO: 17, SEQ ID NO: 18, SEQ ID NO: 19, SEQ ID NO: 20 or SEQ ID NO: 21) and an inactive, or cleavage incompetent, N-terminal RuvC-like domain. An exemplary inactive, or cleavage incompetent N-terminal RuvC-like domain can have a mutation of an aspartic acid in an N-terminal RuvC-like domain, e.g., an aspartic acid at position 9 of the consensus sequence disclosed in FIGS. 2A-2G or an aspartic acid at position 10 of SEQ ID NO: 7, e.g., can be substituted with an alanine. In an embodiment, the eaCas9 molecule or eaCas9 polypeptide differs from wild type in the N-terminal RuvC-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes*, or *S. thermophilus*. In an embodiment, the reference Cas9 molecule is the naturally occurring Cas9 molecule having the closest sequence identity or homology.

In an embodiment, an eaCas9 molecule or eaCas9 polypeptide comprises an inactive, or cleavage incompetent, HNH domain and an active, or cleavage competent, N-terminal RuvC-like domain (e.g., a RuvC-like domain described herein, e.g., SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, or SEQ ID NO: 16). Exemplary inactive, or cleavage incompetent HNH-like domains can have a mutation at one or more of: a histidine in an HNH-like domain, e.g., a histidine shown at position 856 of the consensus sequence disclosed in FIGS. 2A-2G, e.g., can be substituted with an alanine; and one or more asparagines in an HNH-like domain, e.g., an asparagine shown at position 870 of the consensus sequence disclosed in FIGS. 2A-2G and/or at position 879 of the consensus sequence disclosed in FIGS. 2A-2G, e.g., can be substituted with an alanine. In an embodiment, the eaCas9 differs from wild type in the HNH-like domain and does not cleave the target nucleic acid, or cleaves with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of *S. pyogenes*, or *S. thermophilus*. In an embodiment, the reference Cas9 molecule is the naturally occurring Cas9 molecule having the closest sequence identity or homology.

Alterations in the Ability to Cleave One or Both Strands of a Target Nucleic Acid In an embodiment, exemplary Cas9 activities comprise one or more of PAM specificity, cleavage activity, and helicase activity. A mutation(s) can be present, e.g., in one or more RuvC-like domain, e.g., an N-terminal RuvC-like domain; an HNH-like domain; a region outside the RuvC-like domains and the HNH-like domain. In some embodiments, a mutation(s) is present in a RuvC-like domain, e.g., an N-terminal RuvC-like domain. In some embodiments, a mutation(s) is present in an HNH-like domain. In some embodiments, mutations are present in both a RuvC-like domain, e.g., an N-terminal RuvC-like domain and an HNH-like domain.

Exemplary mutations that may be made in the RuvC domain or HNH domain with reference to the *S. pyogenes* sequence include: D10A, E762A, H840A, N854A, N863A and/or D986A.

In an embodiment, a Cas9 molecule or Cas9 polypeptide is an eiCas9 molecule or eiCas9 polypeptide comprising one or more differences in a RuvC domain and/or in an HNH domain as compared to a reference Cas9 molecule, and the eiCas9 molecule or eiCas9 polypeptide does not cleave a nucleic acid, or cleaves with significantly less efficiency than does wildtype, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative or by the method described in Section IV. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from naturally occurring Cas9 molecules, e.g., a Cas9 molecule of *S. aureus, S. pyogenes*, or *C. jejuni* as follows: its ability to modulate, e.g., decreased or increased, cleavage of a double stranded break (endonuclease and/or exonuclease activity), e.g., as compared to a naturally occurring Cas9 molecule (e.g., a Cas9 molecule of *S. aureus, S. pyogenes*, or *C. jejuni*); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of *S. aureus, S. pyogenes*, or *C. jejuni*); or the ability to cleave a nucleic acid molecule, e.g., a double stranded or single stranded nucleic acid molecule, can be eliminated.

In an embodiment, the altered Cas9 molecule or Cas9 polypeptide is an eaCas9 molecule or eaCas9 polypeptide comprising one or more of the following activities: cleavage activity associated with a RuvC domain; cleavage activity associated with an HNH domain; cleavage activity associated with an HNH domain and cleavage activity associated with a RuvC domain.

In an embodiment, the altered Cas9 molecule or Cas9 polypeptide is an eiCas9 molecule or eiCas9 polypeptide which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of *S. pyogenes, S. thermophilus, S. aureus, C. jejuni* or *N. meningitidis*. In an embodiment, the reference Cas9 molecule is the naturally occurring Cas9 molecule having the closest sequence identity or homology. In an embodiment, the eiCas9 molecule or eiCas9 polypeptide lacks substantial cleavage activity associated with a RuvC domain and cleavage activity associated with an HNH domain.

In an embodiment, the altered Cas9 molecule or Cas9 polypeptide is is an eaCas9 molecule or eaCas9 polypeptide is comprising the fixed amino acid residues of *S. pyogenes* shown in the consensus sequence disclosed in FIGS. 2A-2G, and has one or more amino acids that differ from the amino acid sequence of *S. pyogenes* (e.g., has a substitution) at one or more residue (e.g., 2, 3, 5, 10, 15, 20, 30, 50, 70, 80, 90, 100, 200 amino acid residues) represented by an "–" in the consensus sequence disclosed in FIGS. 2A-2G or SEQ ID NO:7.

In an embodiment, the altered Cas9 molecule or Cas9 polypeptide comprises a sequence in which:

- the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;
- the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *S. pyogenes* Cas9 molecule; and,
- the sequence corresponding to the residues identified by "–" in the consensus sequence disclosed in FIGS. 2A-2G differ at no more than 5, 10, 15, 20, 25, 30, 35, 40, 45, 55, or 60% of the "–" residues from the corresponding sequence of naturally occurring Cas9 molecule, e.g., an *S. pyogenes* Cas9 molecule.

In an embodiment, the altered Cas9 molecule or Cas9 polypeptide is an eaCas9 molecule or eaCas9 polypeptide comprising the fixed amino acid residues of *S. thermophilus* shown in the consensus sequence disclosed in FIGS. 2A-2G, and has one or more amino acids that differ from the amino acid sequence of *S. thermophilus* (e.g., has a substitution) at one or more residue (e.g., 2, 3, 5, 10, 15, 20, 30, 50, 70, 80, 90, 100, 200 amino acid residues) represented by an "–" in the consensus sequence disclosed in FIGS. 2A-2G. In an embodiment In an embodiment, the altered Cas9 molecule or Cas9 polypeptide comprises a sequence in which:

- the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;
- the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *S. thermophilus* Cas9 molecule; and,
- the sequence corresponding to the residues identified by "–" in the consensus sequence disclosed in FIGS. 2A-2G differ at no more than 5, 10, 15, 20, 25, 30, 35, 40, 45, 55, or 60% of the "–" residues from the corresponding sequence of naturally occurring Cas9 molecule, e.g., an *S. thermophilus* Cas9 molecule.

In an embodiment, the altered Cas9 molecule or Cas9 polypeptide is an eaCas9 molecule or eaCas9 polypeptide comprising the fixed amino acid residues of *S. mutans* shown in the consensus sequence disclosed in FIGS. 2A-2G, and has one or more amino acids that differ from the amino acid sequence of *S. mutans* (e.g., has a substitution) at one or more residue (e.g., 2, 3, 5, 10, 15, 20, 30, 50, 70, 80, 90, 100, 200 amino acid residues) represented by an "–" in the consensus sequence disclosed in FIGS. 2A-2G.

In an embodiment, the altered Cas9 molecule or Cas9 polypeptide comprises a sequence in which:

- the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;
- the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *S. mutans* Cas9 molecule; and,
- the sequence corresponding to the residues identified by "–" in the consensus sequence disclosed in FIGS. 2A-2G differ at no more than 5, 10, 15, 20, 25, 30, 35, 40, 45, 55, or 60% of the "–" residues from the corresponding sequence of naturally occurring Cas9 molecule, e.g., an *S. mutans* Cas9 molecule.

In an embodiment, the altered Cas9 molecule or Cas9 polypeptide is an eaCas9 molecule or eaCas9 polypeptide comprising the fixed amino acid residues of *L. innocula* shown in the consensus sequence disclosed in FIGS. 2A-2G, and has one or more amino acids that differ from the amino acid sequence of *L. innocula* (e.g., has a substitution) at one or more residue (e.g., 2, 3, 5, 10, 15, 20, 30, 50, 70, 80, 90, 100, 200 amino acid residues) represented by an "–" in the consensus sequence disclosed in FIGS. 2A-2G.

In an embodiment, the altered Cas9 molecule or Cas9 polypeptide comprises a sequence in which:

- the sequence corresponding to the fixed sequence of the consensus sequence disclosed in FIGS. 2A-2G differs at no more than 1, 2, 3, 4, 5, 10, 15, or 20% of the fixed residues in the consensus sequence disclosed in FIGS. 2A-2G;
- the sequence corresponding to the residues identified by "*" in the consensus sequence disclosed in FIGS. 2A-2G differ at no more than 1, 2, 3, 4, 5, 10, 15, 20, 25, 30, 35, or 40% of the "*" residues from the corresponding sequence of naturally occurring Cas9 molecule, e.g., an *L. innocula* Cas9 molecule; and,
- the sequence corresponding to the residues identified by "–" in the consensus sequence disclosed in FIGS. 2A-2G differ at no more than 5, 10, 15, 20, 25, 30, 35, 40, 45, 55, or 60% of the "–" residues from the corresponding sequence of naturally occurring Cas9 molecule, e.g., an *L. innocula* Cas9 molecule.

In an embodiment, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of *S. pyogenes* comprising an N-terminal RuvC-like domain can be fused to a fragment of a Cas9 molecule of a species other than *S. pyogenes* (e.g., *S. thermophilus*) comprising an HNH-like domain.

Cas9 Molecules or Cas9 Polypeptides with Altered PAM Recognition or No PAM Recognition Naturally occurring Cas9 molecules can recognize specific PAM sequences, for example, the PAM recognition sequences described above for *S. pyogenes, S. thermophiles, S. mutans, S. aureus* and *N. meningitidis.*

In an embodiment, a Cas9 molecule or Cas9 polypeptide has the same PAM specificities as a naturally occurring Cas9 molecule. In another embodiment, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule or Cas9 polypeptide can be altered, e.g., to alter PAM recognition, e.g., to alter the PAM sequence that the Cas9 molecule recognizes to decrease off target sites and/or improve specificity; or eliminate a PAM recognition requirement. In an embodiment, a Cas9 molecule or Cas9 polypeptide can be altered, e.g., to increase length of PAM recognition sequence and/or improve Cas9 specificity to high level of identity (e.g., 98%, 99% or 100% match between gRNA and a PAM sequence), to decrease off target sites and increase specificity. In an embodiment, the length of the PAM recognition sequence is at least 4, 5, 6, 7, 8, 9, 10 or 15 amino acids in length. In an embodiment, the Cas9 specificity requires at least 90%, 95%, 96%, 97%, 98%, 99% or more homology between the gRNA and the PAM sequence. Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt et al. Nature 2011, 472(7344): 499-503. Candidate Cas9 molecules can be evaluated, e.g., by methods described in Section IV.

Alterations of the PI domain, which mediates PAM recognition, are discussed below.

Synthetic Cas9 Molecules and Cas9 Polypeptides with Altered PI Domains

Current genome-editing methods are limited in the diversity of target sequences that can be targeted by the PAM sequence that is recognized by the Cas9 molecule utilized. A synthetic Cas9 molecule (or Syn-Cas9 molecule), or synthetic Cas9 polypeptide (or Syn-Cas9 polypeptide), as that term is used herein, refers to a Cas9 molecule or Cas9 polypeptide that comprises a Cas9 core domain from one bacterial species and a functional altered PI domain, i.e., a PI domain other than that naturally associated with the Cas9 core domain, e.g., from a different bacterial species.

In an embodiment, the altered PI domain recognizes a PAM sequence that is different from the PAM sequence recognized by the naturally-occurring Cas9 from which the Cas9 core domain is derived. In an embodiment, the altered PI domain recognizes the same PAM sequence recognized by the naturally-occurring Cas9 from which the Cas9 core domain is derived, but with different affinity or specificity. A Syn-Cas9 molecule or Syn-Cas9 polypeptide can be, respectively, a Syn-eaCas9 molecule or Syn-eaCas9 polypeptide or a Syn-eiCas9 molecule Syn-eiCas9 polypeptide.

An exemplary Syn-Cas9 molecule or Syn-Cas9 polypeptide comprises:

a) a Cas9 core domain, e.g., a Cas9 core domain from Table 25 or 26, e.g., a *S. aureus, S. pyogenes*, or *C. jejuni* Cas9 core domain; and b) an altered PI domain from a species X Cas9 sequence selected from Tables 28 and 29.

In an embodiment, the RKR motif (the PAM binding motif) of said altered PI domain comprises: differences at 1, 2, or 3 amino acid residues; a difference in amino acid sequence at the first, second, or third position; differences in amino acid sequence at the first and second positions, the first and third positions, or the second and third positions; as compared with the sequence of the RKR motif of the native or endogenous PI domain associated with the Cas9 core domain.

In an embodiment, the Cas9 core domain comprises the Cas9 core domain from a species X Cas9 from Table 25 and said altered PI domain comprises a PI domain from a species Y Cas9 from Table 25.

In an embodiment, the RKR motif of the species X Cas9 is other than the RKR motif of the species Y Cas9.

In an embodiment, the RKR motif of the altered PI domain is selected from XXY, XNG, and XNQ.

In an embodiment, the altered PI domain has at least 60, 70, 80, 90, 95, or 100% homology with the amino acid sequence of a naturally occurring PI domain of said species Y from Table 25.

In an embodiment, the altered PI domain differs by no more than 50, 40, 30, 25, 20, 15, 10, 5, 4, 3, 2, or 1 amino acid residue from the amino acid sequence of a naturally occurring PI domain of said second species from Table 25.

In an embodiment, the Cas9 core domain comprises a *S. aureus* core domain and altered PI domain comprises: an *A. denitrificans* PI domain; a *C. jejuni* PI domain; a *H. mustelae* PI domain; or an altered PI domain of species X PI domain, wherein species X is selected from Table 29.

In an embodiment, the Cas9 core domain comprises a *S. pyogenes* core domain and the altered PI domain comprises: an *A. denitrificans* PI domain; a *C. jejuni* PI domain; a *H. mustelae* PI domain; or an altered PI domain of species X PI domain, wherein species X is selected from Table 29.

In an embodiment, the Cas9 core domain comprises a *C. jejuni* core domain and the altered PI domain comprises: an *A. denitrificans* PI domain; a *H. mustelae* PI domain; or an altered PI domain of species X PI domain, wherein species X is selected from Table 29.

In an embodiment, the Cas9 molecule or Cas9 polypeptide further comprises a linker disposed between said Cas9 core domain and said altered PI domain.

In an embodiment, the linker comprises: a linker described elsewhere herein disposed between the Cas9 core domain and the heterologous PI domain. Suitable linkers are further described in Section V.

Exemplary altered PI domains for use in Syn-Cas9 molecules are described in Tables 28 and 29. The sequences for the 83 Cas9 orthologs referenced in Tables 28 and 29 are provided in Table 25. Table 27 provides the Cas9 orthologs with known PAM sequences and the corresponding RKR motif In an embodiment, a Syn-Cas9 molecule or Syn-Cas9 polypeptide may also be size-optimized, e.g., the Syn-Cas9 molecule or Syn-Cas9 polypeptide comprises one or more deletions, and optionally one or more linkers disposed between the amino acid residues flanking the deletions. In an embodiment, a Syn-Cas9 molecule or Syn-Cas9 polypeptide comprises a REC deletion.

Size-Optimized Cas9 Molecules and Cas9 Polypeptides

Engineered Cas9 molecules and engineered Cas9 polypeptides described herein include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a *S. aureus, S. pyogenes*, or *C. jejuni*, Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule or Cas9 polypeptide can comprise one or more deletions that do not substantially affect or decrease the activity of the resultant Cas9 molecules or Cas9 polypeptides described herein. Activities that are retained in the Cas9 molecules or Cas9 polypeptides comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules or Cas9 polypeptides described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed in Table 25, can be modeled onto the crystal structure of *S. pyogenes* Cas9 (Nishimasu et al., Cell, 156:935-949, 2014) to examine the level of conservation across the selected Cas9 orthologs with respect to the three-dimensional conformation of the protein. Less conserved or unconserved regions that are spatially located distant from regions involved in Cas9 activity, e.g., interface with the target nucleic acid molecule and/or gRNA, represent regions or domains are candidates for deletion without substantially affecting or decreasing Cas9 activity.

REC-Optimized Cas9 Molecules and Cas9 Polypeptides

A REC-optimized Cas9 molecule, or a REC-optimized Cas9 polypeptide, as that term is used herein, refers to a Cas9 molecule or Cas9 polypeptide that comprises a deletion in one or both of the REC2 domain and the $RE1_{CT}$ domain (collectively a REC deletion), wherein the deletion comprises at least 10% of the amino acid residues in the cognate domain. A REC-optimized Cas9 molecule or Cas9 polypeptide can be an eaCas9 molecule or eaCas9 polypeptide, or an eiCas9 molecule or eiCas9 polypeptide. An exemplary REC-optimized Cas9 molecule or REC-optimized Cas9 polypeptide comprises:

a) a deletion selected from:

i) a REC2 deletion;

ii) a $REC1_{CT}$ deletion; or iii) a $REC1_{SUB}$ deletion.

Optionally, a linker is disposed between the amino acid residues that flank the deletion. In an embodiment, a Cas9 molecule or Cas9 polypeptide includes only one deletion, or only two deletions. A Cas9 molecule or Cas9 polypeptide can comprise a REC2 deletion and a $REC1_{CT}$ deletion. A Cas9 molecule or Cas9 polypeptide can comprise a REC2 deletion and a $REC1_{SUB}$ deletion.

Generally, the deletion will contain at least 10% of the amino acids in the cognate domain, e.g., a REC2 deletion will include at least 10% of the amino acids in the REC2 domain. A deletion can comprise: at least 10, 20, 30, 40, 50, 60, 70, 80, or 90% of the amino acid residues of its cognate domain; all of the amino acid residues of its cognate domain; an amino acid residue outside its cognate domain; a plurality of amino acid residues outside its cognate domain; the amino acid residue immediately N terminal to its cognate domain; the amino acid residue immediately C terminal to its cognate domain; the amino acid residue immediately N terminal to its cognate and the amino acid residue immediately C terminal to its cognate domain; a plurality of, e.g., up to 5, 10, 15, or 20, amino acid residues N terminal to its cognate domain; a plurality of, e.g., up to 5, 10, 15, or 20, amino acid residues C terminal to its cognate domain; a plurality of, e.g., up to 5, 10, 15, or 20, amino acid residues N terminal to to its cognate domain and a plurality of e.g., up to 5, 10, 15, or 20, amino acid residues C terminal to its cognate domain.

In an embodiment, a deletion does not extend beyond: its cognate domain; the N terminal amino acid residue of its cognate domain; the C terminal amino acid residue of its cognate domain.

A REC-optimized Cas9 molecule or REC-optimized Cas9 polypeptide can include a linker disposed between the amino acid residues that flank the deletion. Any linkers known in the art that maintain the conformation or native fold of the Cas9 molecule (thereby retaining Cas9 activity) can be used between the amino acid resides that flank a REC deletion in a REC-optimized Cas9 molecule or REC-optimized Cas9 polypeptide. Linkers for use in generating recombinant proteins, e.g., multi-domain proteins, are known in the art (Chen et al., *Adv Drug Delivery Rev,* 65:1357-69, 2013).

In an embodiment, a REC-optimized Cas9 molecule or REC-optimized Cas9 polypeptide comprises an amino acid sequence that, other than any REC deletion and associated linker, has at least 50, 55, 60, 65, 70, 75, 80, 85, 90, 95, 99, or 100% homology with the amino acid sequence of a naturally occurring Cas 9, e.g., a Cas9 molecule described in Table 25, e.g., a *S. aureus* Cas9 molecule, a *S. pyogenes* Cas9 molecule, or a *C. jejuni* Cas9 molecule.

In an embodiment, a a REC-optimized Cas9 molecule or REC-optimized Cas9 polypeptide comprises an amino acid sequence that, other than any REC deletion and associated linker, differs by no more than 1, 2, 3, 4, 5, 6, 7, 8, 9, 10, 15, 20, or 25, amino acid residues from the amino acid sequence of a naturally occurring Cas 9, e.g., a Cas9 molecule described in Table 25, e.g., a *S. aureus* Cas9 molecule, a *S. pyogenes* Cas9 molecule, or a *C. jejuni* Cas9 molecule.

In an embodiment, a REC-optimized Cas9 molecule or REC-optimized Cas9 polypeptide comprises an amino acid sequence that, other than any REC deletion and associate linker, differs by no more than 1, 2, 3, 4, 5, 6, 7, 8, 9, 10, 15, 20, or 25% of the, amino acid residues from the amino acid sequence of a naturally occurring Cas 9, e.g., a Cas9 molecule described in Table 25, e.g., a *S. aureus* Cas9 molecule, a *S. pyogenes* Cas9 molecule, or a *C. jejuni* Cas9 molecule.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, WI), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information.

The percent identity between two amino acid sequences can also be determined using the algorithm of E. Meyers and W. Miller, (1988) Comput. Appl. Biosci. 4:11-17) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453) algorithm which has been incorporated into the GAP program in the GCG software package (available at gcg.com), using either a Blossom 62 matrix or a PAM250 matrix, and a gap weight of 16, 14, 12, 10, 8, 6, or 4 and a length weight of 1, 2, 3, 4, 5, or 6.

Sequence information for exemplary REC deletions are provided for 83 naturally-occurring Cas9 orthologs in Table 25.

The amino acid sequences of exemplary Cas9 molecules from different bacterial species are shown below.

TABLE 25

Amino Acid Sequence of Cas9 Orthologs

| Species/Composite ID | Amino acid sequence | REC2 start (AA pos) | REC2 stop (AA pos) | REC2 #AA deleted (n) | $REC1_{CT}$ start (AA pos) | $REC1_{CT}$ stop (AA pos) | $REC1_{CT}$ # AA deleted (n) | $Rec_{sub}$ start (AA pos) | $Rec_{sub}$ stop (AA pos) | $Rec_{sub}$ # AA deleted (n) |
|---|---|---|---|---|---|---|---|---|---|---|
| *Staphylococcus Aureus*<br>tr\|J7RUA5\|J7RUA5_STAAU | SEQ ID NO: 304 | 126 | 166 | 41 | 296 | 352 | 57 | 296 | 352 | 57 |
| *Streptococcus Pyogenes*<br>sp\|Q99ZW2\|CAS9_STRP1 | SEQ ID NO: 305 | 176 | 314 | 139 | 511 | 592 | 82 | 511 | 592 | 82 |
| *Campylobacter jejuni*<br>NCTC 11168<br>gi\|21856312\|ref\|YP_002344900.1 | SEQ ID NO: 306 | 137 | 181 | 45 | 316 | 360 | 45 | 316 | 360 | 45 |
| *Bacteroides fragilis*<br>NCTC 9343<br>gi\|60683389\|ref\|YP_213533.1\| | SEQ ID NO: 307 | 148 | 339 | 192 | 524 | 617 | 84 | 524 | 617 | 84 |
| *Bifidobacterium bifidum* S17<br>gi\|310286728\|ref\|YP_003937986. | SEQ ID NO: 308 | 173 | 335 | 163 | 516 | 607 | 87 | 516 | 607 | 87 |
| *Veillonella atypica*<br>ACS-134-V-Col7a<br>gi\|303229466\|ref\|ZP_07316256.1 | SEQ ID NO: 309 | 185 | 339 | 155 | 574 | 663 | 79 | 574 | 663 | 79 |
| *Lactobacillus rhamnosus* GG<br>gi\|258509199\|ref\|YP_003171950.1 | SEQ ID NO: 310 | 169 | 320 | 152 | 559 | 645 | 78 | 559 | 645 | 78 |
| *Filifactor alocis* ATCC 35896<br>gi\|374307738\|ref\|YP_005054169.1 | SEQ ID NO: 311 | 166 | 314 | 149 | 508 | 592 | 76 | 508 | 592 | 76 |
| *Oenococcus kitaharae* DSM 17330<br>gi\|366983953\|gb\|EHN59352.1\| | SEQ ID NO: 312 | 169 | 317 | 149 | 555 | 639 | 80 | 555 | 639 | 80 |
| *Fructobacillus fructosus*<br>KCTC 3544<br>gi\|339625081\|ref\|ZP_08660870.1 | SEQ ID NO: 313 | 168 | 314 | 147 | 488 | 571 | 76 | 488 | 571 | 76 |
| *Catenibacterium mitsuokai*<br>DSM 15897<br>gi\|224543312\|ref\|ZP_03683851.1 | SEQ ID NO: 314 | 173 | 318 | 146 | 511 | 594 | 78 | 511 | 594 | 78 |
| *Finegoldia magna* ATCC 29328<br>gi\|169823755\|ref\|YP_001691366.1 | SEQ ID NO: 315 | 168 | 313 | 146 | 452 | 534 | 77 | 452 | 534 | 77 |
| *Coriobacterium*glomeransPW2<br>gi\|328956315\|ref\|YP_004373648.1 | SEQ ID NO: 316 | 175 | 318 | 144 | 511 | 592 | 82 | 511 | 592 | 82 |
| *Eubacterium yurii* ATCC43715<br>gi\|306821691\|ref\|ZP_07455288.1 | SEQ ID NO: 317 | 169 | 310 | 142 | 552 | 633 | 76 | 552 | 633 | 76 |
| *Peptoniphilus duerdenii* ATCC<br>BAA-1640<br>gi\|304438954\|ref\|ZP_07398877.1 | SEQ ID NO: 318 | 171 | 311 | 141 | 535 | 615 | 76 | 535 | 615 | 76 |
| *Acidaminococcus* sp. D21<br>gi\|227824983\|ref\|ZP_03989815.1 | SEQ ID NO: 319 | 167 | 306 | 140 | 511 | 591 | 75 | 511 | 591 | 75 |
| *Lactobacillus farciminis*<br>KCTC 3681<br>gi\|336394882\|rep\|ZP_08576281.1 | SEQ ID NO: 320 | 171 | 310 | 140 | 542 | 621 | 85 | 542 | 621 | 85 |
| *Streptococcus sanguinis* SK49<br>gi\|422884106\|ref\|ZP_16930555.1 | SEQ ID NO: 321 | 185 | 324 | 140 | 411 | 490 | 85 | 411 | 490 | 85 |
| *Coprococcus catus* GD-7<br>gi\|291520705\|emb\|CBK78998.11 | SEQ ID NO: 322 | 172 | 310 | 139 | 556 | 634 | 76 | 556 | 634 | 76 |

TABLE 25-continued

Amino Acid Sequence of Cas9 Orthologs

| Species/Composite ID | Amino acid sequence | REC2 start (AA pos) | REC2 stop (AA pos) | REC2 #AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| *Streptococcus mutans* UA159 gi\|24379809\|ref\|NP_721764.1\| | SEQ ID NO: 323 | 176 | 314 | 139 | 392 | 470 | 84 | 392 | 470 | 84 |
| *Streptococcus pyogenes* M1 GAS gi\|13622193\|gb\|AAK33936.1\| | SEQ ID NO: 324 | 176 | 314 | 139 | 523 | 600 | 82 | 523 | 600 | 82 |
| *Streptococcus thermophilus* LMD-9 gi\|116628213\|ref\|YP_820832.1\| | SEQ ID NO: 325 | 176 | 314 | 139 | 481 | 558 | 81 | 481 | 558 | 81 |
| *Fusobacteriumnucleatum* ATCC49256 gi\|34762592\|ref\|ZP_00143587.1\| | SEQ ID NO: 326 | 171 | 308 | 138 | 537 | 614 | 76 | 537 | 614 | 76 |
| *Planococcus* antarcticus DSM 14505 gi\|389815359\|ref\|ZP_10206685.1 | SEQ ID NO: 327 | 162 | 299 | 138 | 538 | 614 | 94 | 538 | 614 | 94 |
| *Treponema denticola* ATCC 35405 gi\|42525843\|ref\|NT_970941.1\| | SEQ ID NO: 328 | 169 | 305 | 137 | 524 | 600 | 81 | 524 | 600 | 81 |
| *Solobacterium moorei* F0204 gi\|320528778\|ref\|ZP_08029929.1 | SEQ ID NO: 329 | 179 | 314 | 136 | 544 | 619 | 77 | 544 | 619 | 77 |
| *Staphylococcus pseudintermedius* ED99 gi\|323463801\|gb\|ADX75954.1\| | SEQ ID NO: 330 | 164 | 299 | 136 | 531 | 606 | 92 | 531 | 606 | 92 |
| *Flavobacterium branchiophilum* FL-15 gi\|347536497\|ref\|YP_004843922.1 | SEQ ID NO: 331 | 162 | 286 | 125 | 538 | 613 | 63 | 538 | 613 | 63 |
| *Ignavibacterium* album JCM 16511 gi\|385811609\|ref\|YP_005848005.1 | SEQ ID NO: 332 | 223 | 329 | 107 | 357 | 432 | 90 | 357 | 432 | 90 |
| *Bergeyella zoohelcum* ATCC 43767 gi\|423317190\|ref\|ZP_17295095.1 | SEQ ID NO: 333 | 165 | 261 | 97 | 529 | 604 | 56 | 529 | 604 | 56 |
| *Nitrobacter hamburgensis* X14 gi\|92109262\|ref\|YP_571550.1\| | SEQ ID NO: 334 | 169 | 253 | 85 | 536 | 611 | 48 | 536 | 611 | 48 |
| *Odoribacter laneus* YIT 12061 gi\|374384763\|ref\|ZP_09642280.1 | SEQ ID NO: 335 | 164 | 242 | 79 | 535 | 610 | 63 | 535 | 610 | 63 |
| *Legionella pneumophila* str. Paris gi\|54296138\|ref\|YP_122507.1\| | SEQ ID NO: 336 | 164 | 239 | 76 | 402 | 476 | 67 | 402 | 476 | 67 |
| *Bacteroides* sp. 203 gi\|301311869\|ref\|ZP_07217791.1 | SEQ ID NO: 337 | 198 | 269 | 72 | 530 | 604 | 83 | 530 | 604 | 83 |
| *Akkermansia muciniphila* ATCC BAA-835 gi\|187736489\|ref\|YP_001878601. | SEQ ID NO: 338 | 136 | 202 | 67 | 348 | 418 | 62 | 348 | 418 | 62 |
| *Prevotella* sp. C561 gi\|345885718\|ref\|ZP_08837074.1 | SEQ ID NO: 339 | 184 | 250 | 67 | 357 | 425 | 78 | 357 | 425 | 78 |
| *Wolinella succinogenes* DSM 1740 gi\|34557932\|ref\|NP_907747.1\| | SEQ ID NO: 340 | 157 | 218 | 36 | 401 | 468 | 60 | 401 | 468 | 60 |
| *Alicyclobacillus hesperidum* URH17-3-68 gi\|403744858\|ref\|ZP_10953934.1 | SEQ ID NO: 341 | 142 | 196 | 55 | 416 | 482 | 61 | 416 | 482 | 61 |
| *Caenispirillum salinarum* AK4 gi\|427429481\|ref\|ZP_18919511.1 | SEQ ID NO: 342 | 161 | 214 | 54 | 330 | 393 | 68 | 330 | 393 | 68 |
| *Eubacterium rectale* ATCC 33656 gi\|238924075\|ref\|YP_002937591.1 | SEQ ID NO: 343 | 133 | 185 | 53 | 322 | 384 | 60 | 322 | 384 | 60 |
| *Mycoplasma synoviae* 53 gi\|71894592\|ref\|YP_278700.1\| | SEQ ID NO: 344 | 187 | 239 | 53 | 319 | 381 | 80 | 319 | 381 | 80 |
| *Porphyromonas* sp. oral taxon 279 str. F0450 gi\|402847315\|ref\|ZP_10895610.1 | SEQ ID NO: 345 | 150 | 202 | 53 | 309 | 371 | 60 | 309 | 371 | 60 |
| *Streptococcus thermophilus* LMD-9 gi\|116627542\|ref\|YP_820161.1\| | SEQ ID NO: 346 | 127 | 178 | 139 | 424 | 486 | 81 | 424 | 486 | 81 |
| *Roseburia inulinivorans* DSM 16841 gi\|225377804\|ref\|ZP_03755025.1 | SEQ ID NO: 347 | 154 | 204 | 51 | 318 | 380 | 69 | 318 | 380 | 69 |
| *Methylosinus trichosporium* OB3b gi\|296446027\|ref\|ZP_06887976.1 | SEQ ID NO: 348 | 144 | 193 | 50 | 426 | 488 | 64 | 426 | 488 | 64 |
| *Ruminococcus* albus 8 gi\|325677756\|ref\|ZP_08157403.1 | SEQ ID NO: 349 | 139 | 187 | 49 | 351 | 412 | 55 | 351 | 412 | 55 |

TABLE 25-continued

Amino Acid Sequence of Cas9 Orthologs

| Species/Composite ID | Amino acid sequence | REC2 start (AA pos) | REC2 stop (AA pos) | REC2 #AA deleted (n) | $REC1_{CT}$ start (AA pos) | $REC1_{CT}$ stop (AA pos) | $REC1_{CT}$ # AA deleted (n) | $Rec_{sub}$ start (AA pos) | $Rec_{sub}$ stop (AA pos) | $Rec_{sub}$ # AA deleted (n) |
|---|---|---|---|---|---|---|---|---|---|---|
| *Bifidobacterium longum* DJO10A gi\|189440764\|ref\|YP_001955845. | SEQ ID NO: 350 | 183 | 230 | 48 | 370 | 431 | 44 | 370 | 431 | 44 |
| *Enterococcus faecalis* TX0012 gi\|315149830\|gb\|EFT93846.1\| | SEQ ID NO: 351 | 123 | 170 | 48 | 327 | 387 | 60 | 327 | 387 | 60 |
| *Mycoplasma* mobile 163K gi\|47458868\|ref\|YP_015730.1\| | SEQ ID NO: 352 | 179 | 226 | 48 | 314 | 374 | 79 | 314 | 374 | 79 |
| *Actinomyces coleocanis* DSM 15436 gi\|227494853\|ref\|ZP_03925169.1 | SEQ ID NO: 353 | 147 | 193 | 47 | 358 | 418 | 40 | 358 | 418 | 40 |
| *Dinoroseobacter shibae* DFL 12 gi\|159042956\|ref\|YP_001531750.1 | SEQ ID NO: 354 | 138 | 184 | 47 | 338 | 398 | 48 | 338 | 398 | 48 |
| *Actinomyces* sp. oral taxon 180 str. F0310 gi\|315605738\|ref\|ZP_07880770.1 | SEQ ID NO: 355 | 183 | 228 | 46 | 349 | 409 | 40 | 349 | 409 | 40 |
| *Alcanivorax* sp. W11-5 gi\|407803669\|ref\|ZP_11150502.1 | SEQ ID NO: 356 | 139 | 183 | 45 | 344 | 404 | 61 | 344 | 404 | 61 |
| *Aminomonas paucivorans* DSM 12260 gi\|312879015\|ref\|ZP_07738815.1 | SEQ ID NO: 357 | 134 | 178 | 45 | 341 | 401 | 63 | 341 | 401 | 63 |
| *Mycoplasma canis* PG 14 gi\|384393286\|gb\|EIE39736.1\| | SEQ ID NO: 358 | 139 | 183 | 45 | 319 | 379 | 76 | 319 | 379 | 76 |
| *Lactobacillus coiyniformis* KCTC 3535 gi\|336393381\|ref\|ZP_08574780.1 | SEQ ID NO: 359 | 141 | 184 | 44 | 328 | 387 | 61 | 328 | 387 | 61 |
| *Elusimicrobium minutum* Pei191 gi\|187250660\|ref\|YP_001875142.1 | SEQ ID NO: 360 | 177 | 219 | 43 | 322 | 381 | 47 | 322 | 381 | 47 |
| *Neisseria meningitidis* Z2491 gi\|218767588\|ref\|YP_002342100.1 | SEQ ID NO: 361 | 147 | 189 | 43 | 360 | 419 | 61 | 360 | 419 | 61 |
| *Pasteurella multocida* str. Pm70 gi\|15602992\|ref\|NP_246064.1\| | SEQ ID NO: 362 | 139 | 181 | 43 | 319 | 378 | 61 | 319 | 378 | 61 |
| *Rhodovulum* sp. PH10 gi\|402849997\|ref\|ZP_10898214.1 | SEQ ID NO: 363 | 141 | 183 | 43 | 319 | 378 | 48 | 319 | 378 | 48 |
| *Eubacterium dolichum* DSM 3991 gi\|160915782\|ref\|ZP_02077990.1 | SEQ ID NO: 364 | 131 | 172 | 42 | 303 | 361 | 59 | 303 | 361 | 59 |
| *Nitratifractor salsuginis* DSM 16511 gi\|319957206\|ref\|YP_004168469.1 | SEQ ID NO: 365 | 143 | 184 | 42 | 347 | 404 | 61 | 347 | 404 | 61 |
| *Rhodospirillum rubrum* ATCC 11170 gi\|83591793\|ref\|YP_425545.1\| | SEQ ID NO: 366 | 139 | 180 | 42 | 314 | 371 | 55 | 314 | 371 | 55 |
| *Clostridium cellulolyticum* H10 gi\|220930482\|ref\|YP_002507391.1 | SEQ ID NO: 367 | 137 | 176 | 40 | 320 | 376 | 61 | 320 | 376 | 61 |
| *Helicobacter mustelae* 12198 gi\|291276265\|ref\|YP_003516037.1 | SEQ ID NO: 368 | 148 | 187 | 40 | 298 | 354 | 48 | 298 | 354 | 48 |
| *Ilyobacter polytropus* DSM 2926 gi\|310780384\|ref\|YP_003968716.1 | SEQ ID NO: 369 | 134 | 173 | 40 | 462 | 517 | 63 | 462 | 517 | 63 |
| *Sphaerochaeta globus* str. Buddy gi\|325972003\|ref\|YP_004248194.1 | SEQ ID NO: 370 | 163 | 202 | 40 | 335 | 389 | 45 | 335 | 389 | 45 |
| *Staphylococcus lugdunensis* M23590 gi\|315659848\|ref\|ZP_07912707.1 | SEQ ID NO: 371 | 128 | 167 | 40 | 337 | 391 | 57 | 337 | 391 | 57 |
| *Treponema* sp. JC4 gi\|384109266\|ref\|ZP_10010146.1 | SEQ ID NO: 372 | 144 | 183 | 40 | 328 | 382 | 63 | 328 | 382 | 63 |
| uncultured delta *proteobacterium* HF007007E19 gi\|297182908\|gb\|ADI19058.1\| | SEQ ID NO: 373 | 154 | 193 | 40 | 313 | 365 | 55 | 313 | 365 | 55 |
| *Alicycliphilus denitrificans* K601 gi\|330822845\|ref\|YP_004386148.1 | SEQ ID NO: 374 | 140 | 178 | 39 | 317 | 366 | 48 | 317 | 366 | 48 |
| *Azospirillum* sp. B510 gi\|288957741\|ref\|YP_003448082.1 | SEQ ID NO: 375 | 205 | 243 | 39 | 342 | 389 | 46 | 342 | 389 | 46 |
| *Bradyrhizobium* sp. BTAil gi\|148255343\|ref\|YP_001239928.1 | SEQ ID NO: 376 | 143 | 181 | 39 | 323 | 370 | 48 | 323 | 370 | 48 |
| *Parvibaculum lavamentivorans* DS-1 gi\|154250555\|ref\|YP_001411379.1 | SEQ ID NO: 377 | 138 | 176 | 39 | 327 | 374 | 58 | 327 | 374 | 58 |

TABLE 25-continued

Amino Acid Sequence of Cas9 Orthologs

| Species/Composite ID | Amino acid sequence | REC2 start (AA pos) | REC2 stop (AA pos) | REC2 #AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| *Prevotella timonensis* CRIS 5C-B1 gi\|282880052\|ref\|ZP_06288774.1 | SEQ ID NO: 378 | 170 | 208 | 39 | 328 | 375 | 61 | 328 | 375 | 61 |
| *Bacillus smithii* 7 3 47FAA gi\|365156657\|ref\|ZP_09352959.1 | SEQ ID NO: 379 | 134 | 171 | 38 | 401 | 448 | 63 | 401 | 448 | 63 |
| *Cand. Puniceispirillum marinum* IMCC1322 gi\|294086111\|ref\|YP_003552871.1 | SEQ ID NO: 380 | 135 | 172 | 38 | 344 | 391 | 53 | 344 | 391 | 53 |
| *Barnesiella intestinihominis* YIT 11860 gi\|404487228\|ref\|ZP_11022414.1 | SEQ ID NO: 381 | 140 | 176 | 37 | 371 | 417 | 60 | 371 | 417 | 60 |
| *Ralstonia syzygii* R24 gi\|344171927\|emb\|CCA84553.1\| | SEQ ID NO: 382 | 140 | 176 | 37 | 395 | 440 | 50 | 395 | 440 | 50 |
| *Wolinella succinogenes* DSM 1740 gi\|34557790\|ref\|NP_907605.1\| | SEQ ID NO: 383 | 145 | 180 | 36 | 348 | 392 | 60 | 348 | 392 | 60 |
| *Mycoplasma gallisepticum* str. F gi\|284931710\|gb\|ADC31648.1\| | SEQ ID NO: 384 | 144 | 177 | 34 | 373 | 416 | 71 | 373 | 416 | 71 |
| *Acidothermus cellulolyticus* 11B gi\|117929158\|ref\|YP_873709.1\| | SEQ ID NO: 385 | 150 | 182 | 33 | 341 | 380 | 58 | 341 | 380 | 58 |
| *Mycoplasma ovipneumoniae* SC01 gi\|363542550\|ref\|ZP_09312133.1 | SEQ ID NO: 386 | 156 | 184 | 29 | 381 | 420 | 62 | 381 | 420 | 62 |

TABLE 26

Amino Acid Sequence of Cas9 Core Domains

| Strain Name | Cas9 Start (AA pos) Start and Stop numbers refer to the sequence in Table 25 | Cas9 Stop (AA pos) |
|---|---|---|
| *Staphylococcus Aureus* | 1 | 772 |
| *Streptococcus Pyogenes* | 1 | 1099 |
| *Campulobacter Jejuni* | 1 | 741 |

TABLE 27

Identified PAM sequences and corresponding RKR motifs.

| Strain Name | PAM sequence (NA) | RKR motif (AA) |
|---|---|---|
| *Streptococcus pyogenes* | NGG | RKR |
| *Streptococcus mutans* | NGG | RKR |
| *Streptococcus thermophilus* A | NGGNG | RYR |
| *Treponema denticola* | NAAAAN | VAK |
| *Streptococcus thermophilus* B | NNAAAAW | IYK |
| *Campylobacter jejuni* | NNNNACA | NLK |
| *Pasteurella multocida* | GNNNCNNA | KDG |

TABLE 27-continued

Identified PAM sequences and corresponding RKR motifs.

| Strain Name | PAM sequence (NA) | RKR motif (AA) |
|---|---|---|
| *Neisseria meningitidis* | NNNNGATT or | IGK |
| *Staphylococcus aureus* | NNGRRV (R = A or G; V = A, G or C) NNGRRT (R = A or G) | NDK |

PI domains are provided in Tables 28 and 29.

TABLE 28

Altered PI Domains

| Strain Name | PI Start (AA pos) Start and Stop numbers refer to the sequences in Table 25 | PI Stop (AA pos) | Length of PI (AA) | RKR motif (AA) |
|---|---|---|---|---|
| *Alicycliphilus denitrificans* K601 | 837 | 1029 | 193 | --Y |
| *Campylobacter jejuni* NCTC 11168 | 741 | 984 | 244 | -NG |
| *Helicobacter mustelae* 12198 | 771 | 1024 | 254 | -NQ |

TABLE 29

| Other Altered PI Domains | | | | |
|---|---|---|---|---|
| Strain Name | PI Start (AA pos) Start and Stop numbers refer to the sequences in Table 25 | PI Stop (AA pos) | Length of PI (AA) | RKR motif (AA) |
| *Akkennansia muciniphila* ATCC BAA-835 | 871 | 1101 | 231 | ALK |
| *Ralstonia syzygii* R24 | 821 | 1062 | 242 | APY |
| *Cand. Puniceispirillum marinum* IMCC1322 | 815 | 1035 | 221 | AYK |
| *Fructobacillus fructosus* KCTC 3544 | 1074 | 1323 | 250 | DGN |
| *Eubacterium yurii* ATCC 43715 | 1107 | 1391 | 285 | DGY |
| *Eubacterium dolichum* DSM 3991 | 779 | 1096 | 318 | DKK |
| *Dinoroseobacter shibae* DFL 12 | 851 | 1079 | 229 | DPI |
| *Clostridium cellulolyticum* H10 | 767 | 1021 | 255 | EGK |
| *Pasteurella multocida* str. Pm70 | 815 | 1056 | 242 | ENN |
| *Mycoplasma canis* PG 14 | 907 | 1233 | 327 | EPK |
| *Porphyromonas* sp. oral taxon 279 str. F0450 | 935 | 1197 | 263 | EPT |
| *Filifactor alocis* ATCC 35896 | 1094 | 1365 | 272 | EVD |
| *Aminomonas paucivorans* DSM 12260 | 801 | 1052 | 252 | EVY |
| *Wolinella succinogenes* DSM 1740 | 1034 | 1409 | 376 | EYK |
| *Oenococcus kitaharae* DSM 17330 | 1119 | 1389 | 271 | GAL |
| *CoriobacteriumglomeransPW2* | 1126 | 1384 | 259 | GDR |
| *Peptoniphilus duerdenii* ATCC BAA-1640 | 1091 | 1364 | 274 | GDS |
| *Bifidobacterium bifidum* S17 | 1138 | 1420 | 283 | GGL |
| *Alicyclobacillus hesperidum* URH17-3-68 | 876 | 1146 | 271 | GGR |
| *Roseburia inulinivorans* DSM 16841 | 895 | 1152 | 258 | GGT |
| *Actinomyces coleocanis* DSM 15436 | 843 | 1105 | 263 | GKK |
| *Odoribacter laneus* YIT 12061 | 1103 | 1498 | 396 | GKV |
| *Coprococcus catus* GD-7 | 1063 | 1338 | 276 | GNQ |
| *Enterococcus faecalis* TX0012 | 829 | 1150 | 322 | GRK |
| *Bacillus smithii* 7 3 47FAA | 809 | 1088 | 280 | GSK |
| *Legionella pneumophila* str. Paris | 1021 | 1372 | 352 | GTM |
| *Bacteroides fragilis* NCTC 9343 | 1140 | 1436 | 297 | IPV |
| *Mycoplasma ovipneumoniae* SC01 | 923 | 1265 | 343 | IRI |
| *Actinomyces* sp. oral taxon 180 str. F0310 | 895 | 1181 | 287 | KEK |
| *Treponema* sp. JC4 | 832 | 1062 | 231 | KIS |
| *Fusobacteriumnucleatum* ATCC49256 | 1073 | 1374 | 302 | KKV |
| *Lactobacillus farciminis* KCTC 3681 | 1101 | 1356 | 256 | KKV |
| *Nitratifractor salsuginis* DSM 16511 | 840 | 1132 | 293 | KMR |
| *Lactobacillus coryniformis* KCTC 3535 | 850 | 1119 | 270 | KNK |
| *Mycoplasma mobile* 163K | 916 | 1236 | 321 | KNY |
| *Flavobacterium branchiophilum* FL-15 | 1182 | 1473 | 292 | KQK |
| *Prevotella timonensis* CRIS 5C-B1 | 957 | 1218 | 262 | KQQ |
| *Methylosinus trichosporium* OB3b | 830 | 1082 | 253 | KRP |
| *Prevotella* sp. C561 | 1099 | 1424 | 326 | KRY |
| *Mycoplasma gallisepticum* str. F | 911 | 1269 | 359 | KTA |
| *Lactobacillus rhamnosus* GG | 1077 | 1363 | 287 | KYG |
| *Wolinella succinogenes* DSM 1740 | 811 | 1059 | 249 | LPN |
| *Streptococcus thermophilus* LMD-9 | 1099 | 1388 | 290 | MLA |
| *Treponema denticola* ATCC 35405 | 1092 | 1395 | 304 | NDS |
| *Bergeyella zoohelcum* ATCC 43767 | 1098 | 1415 | 318 | NEK |
| *Veillonella atypica* ACS-134-V-Col7a | 1107 | 1398 | 292 | NGF |
| *Neisseria meningitidis* Z2491 | 835 | 1082 | 248 | NHN |
| *Ignavibacterium album* JCM 16511 | 1296 | 1688 | 393 | NKK |
| *Ruminococcus albus* 8 | 853 | 1156 | 304 | NNF |
| *Streptococcus thermophilus* LMD-9 | 811 | 1121 | 311 | NNK |
| *Barnesiella intestinihominis* YIT 11860 | 871 | 1153 | 283 | NPV |
| *Azospirillum* sp. B510 | 911 | 1168 | 258 | PFH |
| *Rhodospirillum rubrum* ATCC 11170 | 863 | 1173 | 311 | PRG |
| *Planococcus antarcticus* DSM 14505 | 1087 | 1333 | 247 | PYY |
| *Staphylococcus pseudintermedius* ED99 | 1073 | 1334 | 262 | QIV |
| *Alcanivorax* sp. W11-5 | 843 | 1113 | 271 | RIE |
| *Bradyrhizobium* sp. BTAi1 | 811 | 1064 | 254 | RIY |
| *Streptococcus pyogenes* M1 GAS | 1099 | 1368 | 270 | RKR |
| *Streptococcus mutans* UA159 | 1078 | 1345 | 268 | RKR |
| *Streptococcus Pyogenes* | 1099 | 1368 | 270 | RKR |
| *Bacteroides* sp. 20 3 | 1147 | 1517 | 371 | RNI |
| *S. aureus* | 772 | 1053 | 282 | RNK |
| *Solobacterium moorei* F0204 | 1062 | 1327 | 266 | RSG |
| *Finegoldia magna* ATCC 29328 | 1081 | 1348 | 268 | RTE |
| uncultured delta proteobacterium HF0070 07E19 | 770 | 1011 | 242 | SGG |
| *Acidaminococcus* sp. D21 | 1064 | 1358 | 295 | SIG |
| *Eubacterium rectale* ATCC 33656 | 824 | 1114 | 291 | SKK |
| *Caenispirillum salinarum* AK4 | 1048 | 1442 | 395 | SLV |
| *Acidothermus cellulolyticus* 11B | 830 | 1138 | 309 | SPS |
| *Catenibacterium mitsuokai* DSM 15897 | 1068 | 1329 | 262 | SPT |
| *Parvibaculum lavamentivorans* DS-1 | 827 | 1037 | 211 | TGN |
| *Staphylococcus lugdunensis* M23590 | 772 | 1054 | 283 | TKK |

TABLE 29-continued

| Other Altered PI Domains | | | | |
|---|---|---|---|---|
| Strain Name | PI Start (AA pos) Start and Stop numbers refer to the sequences in Table 25 | PI Stop (AA pos) | Length of PI (AA) | RKR motif (AA) |
| *Streptococcus sanguinis* SK49 | 1123 | 1421 | 299 | TRM |
| *Elusimicrobium minutum* Pei191 | 910 | 1195 | 286 | TTG |
| *Nitrobacter hamburgensis* X14 | 914 | 1166 | 253 | VAY |
| *Mycoplasma synoviae* 53 | 991 | 1314 | 324 | VGF |
| *Sphaerochaeta globus* str. Buddy | 877 | 1179 | 303 | VKG |
| *Ilyobacter polytropus* DSM 2926 | 837 | 1092 | 256 | VNG |
| *Rhodovulum* sp. PH10 | 821 | 1059 | 239 | WY |
| *Bifidobacterium longum* DJO10A | 904 | 1187 | 284 | VRK |

Amino acid sequences described in Table 25:

SEQ ID NO: 304

MKRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLMGHCTYFPEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIIRTTGKENAKYLIEKIKLHDMQEGKCLYSLEAIPLEDLLNNP
FNYEVDHIIPRSVSFDNSFNNKVLVKQEENSKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIFKEWKKLDKAKKVMENQMFEEKQAESMPEIETEQEY
KEIFITPHQIKHIKDFKDYKYSHRVDKKPNRELINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
RNKVVKLSLKPYRFDVYLDNGVYKFVTVKNLDVIKKENYYEVNSKCYEEA
KKLKKISNQAEFIASFYNNDLIKINGELYRVIGVNNDLLNRIEVNMIDIT
YREYLENMNDKRPPRIIKTIASKTQSIKKYSTDILGNLYEVKSKKHPQII
KKG

SEQ ID NO: 305

MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI

-continued

LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD

SEQ ID NO: 306

MARILAFDIGISSIGWAFSENDELKDCGVRIFTKVENPKTGESLALPRRL
ARSARKRLARRKARLNHLKHLIANEFKLNYEDYQSFDESLAKAYKGSLIS
PYELRFRALNELLSKQDFARVILHIAKRRGYDDIKNSDDKEKGAILKAIK
QNEEKLANYQSVGEYLYKEYFQKFKENSKEFTNVRNKKESYERCIAQSFL
KDELKLIFKKQREFGFSFSKKFEEEVLSVAFYKRALKDFSHLVGNCSFFT
DEKRAPKNSPLAFMFVALTRIINLLNNLKNTEGILYTKDDLNALLNEVLK
NGTLTYKQTKKLLGLSDDYEFKGEKGTYFIEFKKYKEFIKALGEHNLSQD

-continued

DLNEIAKDITLIKDEIKLKKALAKYDLNQNQIDSLSKLEFKDHLNISFKA

LKLVTPLMLEGKKYDEACNELNLKVAINEDKKDFLPAFNETYYKDEVTNP

VVLRAIKEYRKVLNALLKKYGKVHKINIELAREVGKNHSQRAKIEKEQNE

NYKAKKDAELECEKLGLKINSKNILKLRLFKEQKEFCAYSGEKIKISDLQ

DEKMLEIDHIYPYSRSFDDSYMNKVLVFTKQNQEKLNQTPFEAFGNDSAK

WQKIEVLAKNLPTKKQKRILDKNYKDKEQKNFKDRNLNDTRYIARLVLNY

TKDYLDFLPLSDDENTKLNDTQKGSKVHVEAKSGMLTSALRHTWGFSAKD

RNNHLHHAIDAVIIAYANNSIVKAFSDFKKEQESNSAELYAKKISELDYK

NKRKFFEPFSGFRQKVLDKIDEIFVSKPERKKPSGALHEETFRKEEEFYQ

SYGGKEGVLKALELGKIRKVNGKIVKNGDMFRVDIFKHKKTNKFYAVPIY

TMDFALKVLPNKAVARSKKGEIKDWILMDENYEFCFSLYKDSLILIQTKD

MQEPEFVYYNAFTSSTVSLIVSKHDNKFETLSKNQKILFKNANEKEVIAK

SIGIQNLKVFEKYIVSALGEVTKAEFRQREDFKK

SEQ ID NO: 307

MKRILGLDLGTNSIGWALVNEAENKDERSSIVKLGVRVNPLTVDELTNFE

KGKSITTNADRTLKRGMRRNLQRYKLRRETLTEVLKEHKLITEDTILSEN

GNRTTFETYRLRAKAVTEEISLEEFARVLLMINKKRGYKSSRKAKGVEEG

TLIDGMDIARELYNNNLTPGELCLQLLDAGKKFLPDFYRSDLQNELDRIW

EKQKEYYPEILTDVLKEELRGKKRDAVWAICAKYFVWKENYTEWNKEKGK

TEQQEREHKLEGIYSKRKRDEAKRENLQWRVNGLKEKLSLEQLVIVFQEM

NTQINNSSGYLGAISDRSKELYFNKQTVGQYQMEMLDKNPNASLRNMVFY

RQDYLDEFNMLWEKQAVYHKELTEELKKEIRDIIIFYQRRLKSQKGLIGF

CEFESRQIEVDIDGKKKIKTVGNRVISRSSPLFQEFKIWQILNNIEVTVV

GKKRKRRKLKENYSALFEELNDAEQLELNGSRRLCQEEKELLAQELFIRD

KMTKSEVLKLLFDNPQELDLNFKTIDGNKTGYALFQAYSKMIEMSGHEPV

DFKKPVEKVVEYIKAVFDLLNWNTDILGFNSNEELDNQPYYKLWHLLYSF

EGDNTPTGNGRLIQKMTELYGFEKEYATILANVSFQDDYGSLSAKAIHKI

LPHLKEGNRYDVACVYAGYRHSESSLTREEIANKVLKDRLMLLPKNSLHN

PVVEKILNQMVNVINVIIDIYGKPDEIRVELARELKKNAKEREELTKSIA

QTTKAHEEYKTLLQTEFGLTNVSRTDILRYKLYKELESCGYKTLYSNTYI

SREKLFSKEFDIEHIIPQARLFDDSFSNKTLEARSVNIEKGNKTAYDFVK

EKFGESGADNSLEHYLNNIEDLFKSGKISKTKYNKLKMAEQDIPDGFIER

DLRNTQYIAKKALSMLNEISHRVVATSGSVTDKLREDWQLIDVMKELNWE

KYKALGLVEYFEDRDGRQIGRIKDWTKRNDHRHHAMDALTVAFTKDVFIQ

YFNNKNASLDPNANEHAIKNKYFQNGRAIAPMPLREFRAEAKKHLENTLI

SIKAKNKVITGNINKTRKKGGVNKNMQQTPRGQLHLETIYGSGKQYLTKE

EKVNASFDMRKIGTVSKSAYRDALLKRLYENDNDPKKAFAGKNSLDKQPI

WLDKEQMRKVPEKVKIVTLEAIYTIRKEISPDLKVDKVIDVGVRKILIDR

LNEYGNDAKKAFSNLDKNPIWLNKEKGISIKRVTISGISNAQSLHVKKDK

DGKPILDENGRNIPVDFVNTGNNHHVAVYYRPVIDKRGQLVVDEAGNPKY

ELEEVVVSFFEAVTRANLGLPIIDKDYKTTEGWQFLFSMKQNEYFVFPNE

-continued

KTGFNPKEIDLLDVENYGLISPNLFRVQKFSLKNYVFRHHLETTIKDTSS

ILRGITWIDFRSSKGLDTIVKVRVNHIGQIVSVGEY

SEQ ID NO: 308

MSRKNYVDDYAISLDIGNASVGWSAFTPNYRLVRAKGHELIGVRLFDPAD

TAESRRMARTTRRRYSRRRWRLRLLDALFDQALSEIDPSFLARRKYSWVH

PDDENNADCWYGSVLFDSNEQDKRFYEKYPTIYHLRKALMEDDSQHDIRE

IYLAIHHMVKYRGNFLVEGTLESSNAFKEDELLKLLGRITRYEMSEGEQN

SDIEQDDENKLVAPANGQLADALCATRGSRSMRVDNALEALSAVNDLSRE

QRAIVKAIFAGLEGNKLDLAKIFVSKEFSSENKKILGIYFNKSDYEEKCV

QIVDSGLLDDEEREFLDRMQGQYNAIALKQLLGRSTSVSDSKCASYDAHR

ANWNLIKLQLRTKENEKDINENYGILVGWKIDSGQRKSVRGESAYENMRK

KANVFFKKMIETSDLSETDKNRLIHDIEEDKLFPIQRDSDNGVIPHQLHQ

NELKQIIKKQGKYYPFLLDAFEKDGKQINKIEGLLTFRVPYFVGPLVVPE

DLQKSDNSENHWMVRKKKGEITPWNFDEMVDKDASGRKFIERLVGTDSYL

LGEPTLPKNSLLYQEYEVLNELNNVRLSVRTGNHWNDKRRMRLGREEKTL

LCQRLFMKGQTVTKRTAENLLRKEYGRTYELSGLSDESKFTSSLSTYGKM

CRIFGEKYVNEHRDLMEKIVELQTVFEDKETLLHQLRQLEGISEADCALL

VNTHYTGWGRLSRKLLTTKAGECKISDDFAPRKHSIIEIMRAEDRNLMEI

ITDKQLGFSDWIEQENLGAENGSSLMEVVDDLRVSPKVKRGIIQSIRLID

DISKAVGKRPSRIFLELADDIQPSGRTISRKSRLQDLYRNANLGKEFKGI

ADELNACSDKDLQDDRLFLYYTQLGKDMYTGEELDLDRLSSAYDIDHIIP

QAVTQNDSIDNRVLVARAENARKTDSFTYMPQIADRMRNFWQILLDNGLI

SRVKFERLTRQNEFSEREKERFVQRSLVETRQIMKNVATLMRQRYGNSAA

VIGLNAELTKEMHRYLGFSHKNRDINDYHHAQDALCVGIAGQFAANRGFF

ADGEVSDGAQNSYNQYLRDYLRGYREKLSAEDRKQGRAFGFIVGSMRSQD

EQKRVNPRTGEVVWSEEDKDYLRKVMNYRKMLVTQKVGDDFGALYDETRY

AATDPKGIKGIPFDGAKQDTSLYGGFSSAKPAYAVLIESKGKTRLVNVTM

QEYSLLGDRPSDDELRKVLAKKKSEYAKANILLRHVPKMQLIRYGGGLMV

IKSAGELNNAQQLWLPYEEYCYFDDLSQGKGSLEKDDLKKLLDSILGSVQ

CLYPWHRFTEEELADLHVAFDKLPEDEKKNVITGIVSALHADAKTANLSI

VGMTGSWRRMNNKSGYTFSDEDEFIFQSPSGLFEKRVTVGELKRKAKKEV

NSKYRTNEKRLPTLSGASQP

SEQ ID NO: 309

METQTSNQLITSHLKDYPKQDYFVGLDIGTNSVGWAVTNTSYELLKFHSH

KMWGSRLFEEGESAVTRRGFRSMRRRLERRKLRLKLLEELFADAMAQVDS

TFFIRLHESKYHYEDKTTGHSSKHILFIDEDYTDQDYFTEYPTIYHLRKD

LMENGTDDIRKLFLAVHHILKYRGNFLYEGATFNSNAFTFEDVLKQALVN

ITFNCFDTNSAISSISNILMESGKTKSDKAKAIERLVDTYTVFDEVNTPD

KPQKEQVKEDKKTLKAFANLVLGLSANLIDLFGSVEDIDDDLKKLQIVGD

TYDEKRDELAKVWGDEIHIIDDCKSVYDAIILMSIKEPGLTISQSKVKAF

DKHKEDLVILKSLLKLDRNVYNEMFKSDKKGLHNYVHYIKQGRTEETSCS

REDFYKYTKKIVEGLADSKDKEYILNEIELQTLLPLQRIKDNGVIPYQLH

-continued

LEELKVILDKCGPKFPFLHTVSDGFSVTEKLIKMLEFRIPYYVGPLNTHH
NIDNGGFSWAVRKQAGRVTPWNFEEKIDREKSAAAFIKNLTNKCTYLFGE
DVLPKSSLLYSEFMLLNELNNVRIDGKALAQGVKQHLIDSIFKQDHKKMT
KNRIELFLKDNNYITKKHKPEITGLDGEIKNDLTSYRDMVRILGNNFDVS
MAEDIITDITIFGESKKMLRQTLRNKFGSQLNDETIKKLSKLRYRDWGRL
SKKLLKGIDGCDKAGNGAPKTIIELMRNDSYNLMEILGDKFSFMECIEEE
NAKLAQGQVVNPHDIIDELALSPAVKRAVWQALRIVDEVAHIKKALPSRI
FVEVARTNKSEKKKKDSRQKRLSDLYSAIKKDDVLQSGLQDKEFGALKSG
LANYDDAALRSKKLYLYYTQMGRCAYTGNIIDLNQLNTDNYDIDHIYPRS
LTKDDSFDNLVLCERTANAKKSDIYPIDNRIQTKQKPFWAFLKHQGLISE
RKYERLTRIAPLTADDLSGFIARQLVETNQSVKATTTLLRRLYPDIDVVF
VKAENVSDFRHNNNFIKVRSLNHHHHAKDAYLNIVVGNVYHEKFTRNFRL
FFKKNGANRTYNLAKMFNYDVICTNAQDGKAWDVKTSMNTVKKMMASNDV
RVTRRLLEQSGALADATIYKASVAAKAKDGAYIGMKTKYSVFADVTKYGG
MTKIKNAYSIIVQYTGKKGEEIKEIVPLPIYLINRNATDIELIDYVKSVI
PKAKDISIKYRKLCINQLVKVNGFYYYLGGKTNDKIYIDNAIELVVPHDI
ATYIKLLDKYDLLRKENKTLKASSITTSIYNINTSTVVSLNKVGIDVFDY
FMSKLRTPLYMKMKGNKVDELSSTGRSKFIKMTLEEQSIYLLEVLNLLTN
SKTTFDVKPLGITGSRSTIGVKIHNLDEFKIINESITGLYSNEVTIV

SEQ ID NO: 310

MTKLNQPYGIGLDIGSNSIGFAVVDANSHLLRLKGETAIGARLFREGQSA
ADRRGSRTTRRRLSRTRWRLSFLRDFFAPHITKIDPDFFLRQKYSEISPK
DKDRFKYEKRLFNDRTDAEFYEDYPSMYHLRLHLMTHTHKADPREIFLAI
HHILKSRGHFLTPGAAKDFNTDKVDLEDIFPALTEAYAQVYPDLELTFDL
AKADDFKAKLLDEQATPSDTQKALVNLLLSSDGEKEIVKKRKQVLTEFAK
AITGLKTKFNLALGTEVDEADASNWQFSMGQLDDKWSNIETSMTDQGTEI
FEQIQELYRARLLNGIVPAGMSLSQAKVADYGQHKEDLELFKTYLKKLND
HELAKTIRGLYDRYINGDDAKPFLREDFVKALTKEVTAHPNEVSEQLLNR
MGQANFMLKQRTKANGAIPIQLQQRELDQIIANQSKYYDWLAAPNPVEAH
RWKMPYQLDELLNFHIPYYVGPLITPKQQAESGENVFAWMVRKDPSGNIT
PYNFDEKVDREASANTFIQRMKTTDTYLIGEDVLPKQSLLYQKYEVLNEL
NNVRINNECLGTDQKQRLIREVFERHSSVTIKQVADNLVAHGDFARRPEI
RGLADEKRFLSSLSTYHQLKEILHEAIDDPTKLLDIENIITWSTVFEDHT
IFETKLAEIEWLDPKKINELSGIRYRGWGQFSRKLLDGLKLGNGHTVIQE
LMLSNHNLMQILADETLKETMTELNQDKLKTDDIEDVINDAYTSPSNKKA
LRQVLRVVEDIKHAANGQDPSWLFIETADGTGTAGKRTQSRQKQIQTVYA
NAAQELIDSAVRGELEDKIADKASFTDRLVLYFMQGGRDIYTGAPLNIDQ
LSHYDIDHILPQSLIKDDSLDNRVLVNATINREKNNVFASTLFAGKMKAT
WRKWHEAGLISGRKLRNLMLRPDEIDKFAKGFVARQLVETRQIIKLTEQI
AAAQYPNTKIIAVKAGLSHQLREELDFPKNRDVNHYHHAFDAFLAARIGT
YLLKRYPKLAPFFTYGEFAKVDVKKFREFNFIGALTHAKKNIIAKDTGEI
VWDKERDIRELDRIYNFKRMLITHEVYFETADLFKQTIYAAKDSKERGGS
KQLIPKKQGYPTQVYGGYTQESGSYNALVRVAEADTTAYQVIKISAQNAS
KIASANLKSREKGKQLLNEIVVKQLAKRRKNWKPSANSFKIVIPRFGMGT
LFQNAKYGLFMVNSDTYYRNYQELWLSRENQKLLKKLFSIKYEKTQMNHD
ALQVYKAIIDQVEKFFKLYDINQFRAKLSDAIERFEKLPINTDGNKIGKT
ETLRQILIGLQANGTRSNVKNLGIKTDLGLLQVGSGIKLDKDTQIVYQSP
SGLFKRRIPLADL

SEQ ID NO: 311

MTKEYYLGLDVGTNSVGWAVTDSQYNLCKFKKKDMWGIRLFESANTAKDR
RLQRGNRRRLERKKQRIDLLQEIFSPEICKIDPTFFIRLNESRLHLEDKS
NDFKYPLFIEKDYSDIEYYKEFPTIFHLRKHLIESEEKQDIRLIYLALHN
IIKTRGHFLIDGDLQSAKQLRPILDTFLLSLQEEQNLSVSLSENQKDEYE
EILKNRSIAKSEKVKKLKNLFEISDELEKEEKKAQSAVIENFCKFIVGNK
GDVCKFLRVSKEELEIDSFSFSEGKYEDDIVKNLEEKVPEKVYLFEQMKA
MYDWNILVDILETEEYISFAKVKQYEKHKTNLRLLRDIILKYCTKDEYNR
MFNDEKEAGSYTAYVGKLKKNNKKYWIEKKRNPEEFYKSLGKLLDKIEPL
KEDLEVLTMMIEECKNHTLLPIQKNKDNGVIPHQVHEVELKKILENAKKY
YSFLTETDKDGYSVVQKIESIFRFRIPYYVGPLSTRHQEKGSNVWMVRKP
GREDRIYPWNMEEIIDFEKSNENFITRMTNKCTYLIGEDVLPKHSLLYSK
YMVLNELNNVKVRGKKLPTSLKQKVFEDLFENKSKVTGKNLLEYLQIQDK
DIQIDDLSGFDKDFKTSLKSYLDFKKQIFGEEIEKESIQNMIEDIIKWIT
IYGNDKEMLKRVIRANYSNQLTEEQMKKITGFQYSGWGNFSKMFLKGISG
SDVSTGETFDIITAMWETDNNLMQILSKKFTFMDNVEDFNSGKVGKIDKI
TYDSTVKEMFLSPENKRAVWQTIQVAEEIKKVMGCEPKKIFIEMARGGEK
VKKRTKSRKAQLLELYAACEEDCRELIKEIEDRDERDFNSMKLFLYYTQF
GKCMYSGDDIDINELIRGNSKWDRDHIYPQSKIKDDSIDNLVLVNKTYNA
KKSNELLSEDIQKKMHSFWLSLLNKKLITKSKYDRLTRKGDFTDEELSGF
IARQLVETRQSTKAIADIFKQIYSSEVVYVKSSLVSDFRKKPLNYLKSRR
VNDYHHAKDAYLNIVVGNVYNKKFTSNPIQWMKKNRDTNYSLNKVFEHDV
VINGEVIWEKCTYHEDTNTYDGGTLDRIRKIVERDNILYTEYAYCEKGEL
FNATIQNKNGNSTVSLKKGLDVKKYGGYFSANTSYFSLIEFEDKKGDRAR
HIIGVPIYIANMLEHSPSAFLEYCEQKGYQNVRILVEKIKKNSLLIINGY
PLRIRGENEVDTSFKRAIQLKLDQKNYELVRNIEKFLEKYVEKKGNYPID
ENRDHITHEKMNQLYEVLLSKMKKFNKKGMADPSDRIEKSKPKFIKLEDL
IDKINVINKMLNLLRCDNDTKADLSLIELPKNAGSFVVKKNTIGKSKIIL
VNQSVTGLYENRREL

SEQ ID NO: 312

MARDYSVGLDIGTSSVGWAAIDNKYHLIRAKSKNLIGVRLFDSAVTAEKR
RGYRTTRRRLSRRHWRLRLLNDIFAGPLTDFGDENFLARLKYSWVHPQDQ
SNQAHFAAGLLFDSKEQDKDFYRKYPTIYHLRLALMNDDQKHDLREVYLA
IHHLVKYRGHFLIEGDVKADSAFDVHTFADAIQRYAESNNSDENLLGKID

-continued

EKKLSAALTDKHGSKSQRAETAETAFDILDLQSKKQIQAILKSVVGNQAN

LMAIFGLDSSAISKDEQKNYKFSFDDADIDEKIADSEALLSDTEFEFLCD

LKAAFDGLTLKMLLGDDKTVSAAMVRRFNEHQKDWEYIKSHIRNAKNAGN

GLYEKSKKFDGINAAYLALQSDNEDDRKKAKKIFQDEISSADIPDDVKAD

FLKKIDDDQFLPIQRTKNNGTIPHQLHRNELEQIIEKQGIYYPFLKDTYQ

ENSHELNKITALINFRVPYYVGPLVEEEQKIADDGKNIPDPTNHWMVRKS

NDTITPWNLSQVVDLDKSGRRFIERLTGTDTYLIGEPTLPKNSLLYQKFD

VLQELNNIRVSGRRLDIRAKQDAFEHLFKVQKTVSATNLKDFLVQAGYIS

EDTQIEGLADVNGKNFNNALTTYNYLVSVLGREFVENPSNEELLEEITEL

QTVFEDKKVLRRQLDQLDGLSDHNREKLSRKHYTGWGRISKKLLTTKIVQ

NADKIDNQTFDVPRMNQSIIDTLYNTKMNLMEIINNAEDDFGVRAWIDKQ

NTTDGDEQDVYSLIDELAGPKEIKRGIVQSFRILDDITKAVGYAPKRVYL

EFARKTQESHLTNSRKNQLSTLLKNAGLSELVTQVSQYDAAALQNDRLYL

YFLQQGKDMYSGEKLNLDNLSNYDIDHIIPQAYTKDNSLDNRVLVSNITN

RRKSDSSNYLPALIDKMRPFWSVLSKQGLLSKHKFANLTRTRDFDDMEKE

RFIARSLVETRQIIKNVASLIDSHFGGETKAVAIRSSLTADMRRYVDIPK

NRDINDYHHAFDALLFSTVGQYTENSGLMKKGQLSDSAGNQYNRYIKEWI

HAARLNAQSQRVNPFGFVVGSMRNAAPGKLNPETGEITPEENADWSIADL

DYLHKVMNFRKITVTRRLKDQKGQLYDESRYPSVLHDAKSKASINFDKHK

PVDLYGGFSSAKPAYAALIKFKNKFRLVNVLRQWTYSDKNSEDYILEQIR

GKYPKAEMVLSHIPYGQLVKKDGALVTISSATELHNFEQLWLPLADYKLI

NTLLKTKEDNLVDILHNRLDLPEMTIESAFYKAFDSILSFAFNRYALHQN

ALVKLQAHRDDFNALNYEDKQQTLERILDALHASPASSDLKKINLSSGFG

RLFSPSHFTLADTDEFIFQSVTGLFSTQKTVAQLYQETK

SEQ ID NO: 313

MVYDVGLDIGTGSVGWVALDENGKLARAKGKNLVGVRLFDTAQTAADRRG

FRTTRRRLSRRKWRLRLLDELFSAEINEIDSSFFQRLKYSYVHPKDEENK

AHYYGGYLFPTEEETKKFHRSYPTIYHLRQELMAQPNKRFDIREIYLAIH

HLVKYRGHFLSSQEKITIGSTYNPEDLANAIEVYADEKGLSWELNNPEQL

TEIISGEAGYGLNKSMKADEALKLFEFDNNQDKVAIKTLLAGLTGNQIDF

AKLFGKDISDKDEAKLWKLKLDDEALEEKSQTILSQLTDEEIELFHAVVQ

AYDGFVLIGLLNGADSVSAAMVQLYDQHREDRKLLKSLAQKAGLKHKRFS

EIYEQLALATDEATIKNGISTARELVEESNLSKEVKEDTLRRLDENEFLP

KQRTKANSVIPHQLHLAELQKILQNQGQYYPFLLDTFEKEDGQDNKIEEL

LRFRIPYYVGPLVTKKDVEHAGGDADNHWVERNEGFEKSRVTPWNFDKVF

NRDKAARDFIERLTGNDTYLIGEKTLPQNSLRYQLFTVLNELNNVRVNGK

KFDSKTKADLINDLFKARKTVSLSALKDYLKAQGKGDVTITGLADESKFN

SSLSSYNDLKKTFDAEYLENEDNQETLEKIIEIQTVFEDSKIASRELSKL

PLDDDQVKKLSQTHYTGWGRLSEKLLDSKIIDERGQKVSILDKLKSTSQN

FMSIINNDKYGVQAWITEQNTGSSKLTFDEKVNELTTSPANKRGIKQSFA

VLNDIKKAMKEEPRRVYLEFAREDQTSVRSVPRYNQLKEKYQSKSLSEEA

-continued

KVLKKTLDGNKNKMSDDRYFLYFQQQGKDMYTGRPINFERLSQDYDIDHI

IPQAFTKDDSLDNRVLVSRPENARKSDSFAYTDEVQKQDGSLWTSLLKSG

FINRKKYERLTKAGKYLDGQKTGFIARQLVETRQIIKNVASLIEGEYENS

KAVAIRSEITADMRLLVGIKKHREINSFHHAFDALLITAAGQYMQNRYPD

RDSTNVYNEFDRYTNDYLKNLRQLSSRDEVRRLKSFGFVVGTMRKGNEDW

SEENTSYLRKVMMFKNILTTKKTEKDRGPLNKETIFSPKSGKKLIPLNSK

RSDTALYGGYSNVYSAYMTLVRANGKNLLIKIPISIANQIEVGNLKINDY

IVNNPAIKKFEKILISKLPLGQLVNEDGNLIYLASNEYRHNAKQLWLSTT

DADKIASISENSSDEELLEAYDILTSENVKNRFPFFKKDIDKLSQVRDEF

LDSDKRIAVIQTILRGLQIDAAYQAPVKIISKKVSDWHKLQQSGGIKLSD

NSEMIYQSATGIFETRVKISDLL

SEQ ID NO: 314

IVDYCIGLDLGTGSVGWAVVDMNHRLMKRNGKHLWGSRLFSNAETAANRR

ASRSIRRRYNKRRERIRLLRAILQDMVLEKDPTFFIRLEHTSFLDEEDKA

KYLGTDYKDNYNLFIDEDFNDYTYYHKYPTIYHLRKALCESTEKADPRLI

YLALHHIVKYRGNFLYEGQKFNMDASNIEDKLSDIFTQFTSFNNIPYEDD

EKKNLEILEILKKPLSKKAKVDEVMTLIAPEKDYKSAFKELVTGIAGNKM

NVTKMILCEPIKQGDSEIKLKFSDSNYDDQFSEVEKDLGEYVEFVDALHN

VYSWVELQTIMGATHTDNASISEAMVSRYNKHHDDLKLLKDCIKNNVPNK

YFDMFRNDSEKSKGYYNYINRPSKAPVDEFYKYVKKCIEKVDTPEAKQIL

NDIELENFLLKQNSRTNGSVPYQMQLDEMIKIIDNQAEYYPILKEKREQL

LSILTFRIPYYFGPLNETSEHAWIKRLEGKENQRILPWNYQDIVDVDATA

EGFIKRMRSYCTYFPDEEVLPKNSLIVSKYEVYNELNKIRVDDKLLEVDV

KNDIYNELFMKNKTVTEKKLKNWLVNNQCCSKDAEIKGFQKENQFSTSLT

PWIDFTNIFGKIDQSNFDLIENIIYDLTVFEDKKIMKRRLKKKYALPDDK

VKQILKLKYKDWSRLSKKLLDGIVADNRFGSSVTVLDVLEMSRLNLMEII

NDKDLGYAQMIEEATSCPEDGKFTYEEVERLAGSPALKRGIWQSLQIVEE

ITKVMKCRPKYIYIEFERSEEAKERTESKIKKLENVYKDLDEQTKKEYKS

VLEELKGFDNTKKISSDSLFLYFTQLGKCMYSGKKLDIDSLDKYQIDHIV

PQSLVKDDSFDNRVLVVPSENQRKLDDLVVPFDIRDKMYRFWKLLFDHEL

ISPKKFYSLIKTEYTERDEERFINRQLVETRQITKNVTQIIEDHYSTTKV

AAIRANLSHEFRVKNHIYKNRDINDYHHAHDAYIVALIGGFMRDRYPNMH

DSKAVYSEYMKMFRKNKNDQKRWKDGFVINSMNYPYEVDGKLIWNPDLIN

EIKKCFYYKDCYCTTKLDQKSGQLFNLTVLSNDAHADKGVTKAVVPVNKN

RSDVHKYGGFSGLQYTIVAIEGQKKKGKKTELVKKISGVPLHLKAASINE

KINYIEEKEGLSDVRIIKDNIPVNQMIEMDGGEYLLTSPTEYVNARQLVL

NEKQCALIADIYNAIYKQDYDNLDDILMIQLYIELTNKMKVLYPAYRGIA

EKFESMNENYVVISKEEKANIIKQMLIVMHRGPQNGNIVYDDFKISDRIG

RLKTKNHNLNNIVFISQSPTGIYTKKYKL

SEQ ID NO: 315

MKSEKKYYIGLDVGTNSVGWAVTDEFYNILRAKGKDLWGVRLFEKADTAA

NTRIFRSGRRRNDRKGMRLQILREIFEDEIKKVDKDFYDRLDESKFWAED

-continued

KKVSGKYSLFNDKNFSDKQYFEKFPTIFHLRKYLMEEHGKVDIRYYFLAI

NQMMKRRGHFLIDGQISHVTDDKPLKEQLILLINDLLKIELEEELMDSIF

EILADVNEKRTDKKNNLKELIKGQDFNKQEGNILNSIFESIVTGKAKIKN

IISDEDILEKIKEDNKEDFVLTGDSYEENLQYFEEVLQENITLFNTLKST

YDFLILQSILKGKSTLSDAQVERYDEHKKDLEILKKVIKKYDEDGKLFKQ

VFKEDNGNGYVSYIGYYLNKNKKITAKKKISNIEFTKYVKGILEKQCDCE

DEDVKYLLGKIEQENFLLKQISSINSVIPHQIHLFELDKILENLAKNYPS

FNNKKEEFTKIEKIRKTFTFRIPYYVGPLNDYHKNNGGNAWIFRNKGEKI

RPWNFEKIVDLHKSEEEFIKRMLNQCTYLPEETVLPKSSILYSEYMVLNE

LNNLRINGKPLDTDVKLKLIEELFKKKTKVTLKSIRDYMVRNNFADKEDF

DNSEKNLEIASNMKSYIDFNNILEDKFDVEMVEDLIEKITIHTGNKKLLK

KYIEETYPDLSSSQIQKIINLKYKDWGRLSRKLLDGIKGTKKETEKTDTV

INFLRNSSDNLMQIIGSQNYSFNEYIDKLRKKYIPQEISYEVVENLYVSP

SVKKMIWQVIRVTEEITKVMGYDPDKIFIEMAKSEEEKKTTISRKNKLLD

LYKAIKKDERDSQYEKLLTGLNKLDDSDLRSRKLYLYYTQMGRDMYTGEK

IDLDKLFDSTHYDKDHIIPQSMKKDDSIINNLVLVNKNANQTTKGNIYPV

PSSIRNNPKIYNYWKYLMEKEFISKEKYNRLIRNTPLTNEELGGFINRQL

VETRQSTKAIKELFEKFYQKSKIIPVKASLASDLRKDMNTLKSREVNDLH

HAHDAFLNIVAGDVWNREFTSNPINYVKENREGDKVKYSLSKDFTRPRKS

KGKVIWTPEKGRKLIVDTLNKPSVLISNESHVKKGELFNATIAGKKDYKK

GKIYLPLKKDDRLQDVSKYGGYKAINGAFFFLVEHTKSKKRIRSIELFPL

HLLSKFYEDKNTVLDYAINVLQLQDPKIIIDKINYRTEIIIDNFSYLIST

KSNDGSITVKPNEQMYWRVDEISNLKKIENKYKKDAILTEEDRKIMESYI

DKIYQQFKAGKYKNRRTTDTIIEKYEIIDLDTLDNKQLYQLLVAFISLSY

KTSNNAVDFTVIGLGTECGKPRITNLPDNTYLVYKSITGIYEKRIRIK

SEQ ID NO: 316

MKLRGIEDDYSIGLDMGTSSVGWAVTDERGTLAHFKRKPTWGSRLFREAQ

TAAVARMPRGQRRRYVRRRWRLDLLQKLFEQQMEQADPDFFIRLRQSRLL

RDDRAEEHADYRWPLFNDCKFTERDYYQRFPTIYHVRSWLMETDEQADIR

LIYLALHNIVKHRGNFLREGQSLSAKSARPDEALNHLRETLRVWSSERGF

ECSIADNGSILAMLTHPDLSPSDRRKKIAPLFDVKSDDAAADKKLGIALA

GAVIGLKTEFKNIFGDFPCEDSSIYLSNDEAVDAVRSACPDDCAELFDRL

CEVYSAYVLQGLLSYAPGQTISANMVEKYRRYGEDLALLKKLVKIYAPDQ

YRMFFSGATYPGTGIYDAAQARGYTKYNLGPKKSEYKPSESMQYDDFRKA

VEKLFAKTDARADERYRMMMDRFDKQQFLRRLKTSDNGSIYHQLHLEELK

AIVENQGRFYPFLKRDADKLVSLVSFRIPYYVGPLSTRNARTDQHGENRF

AWSERKPGMQDEPIFPWNWESIIDRSKSAEKFILRMTGMCTYLQQEPVLP

KSSLLYEEFCVLNELNGAHWSIDGDDEHRFDAADREGIIEELFRRKRTVS

YGDVAGWMERERNQIGAHVCGGQGEKGFESKLGSYIFFCKDVFKVERLEQ

SDYPMIERIILWNTLFEDRKILSQRLKEEYGSRLSAEQIKTICKKRFTGW

GRLSEKFLTGITVQVDEDSVSIMDVLREGCPVSGKRGRAMVMMEILRDEE

-continued

LGFQKKVDDFNRAFFAENAQALGVNELPGSPAVRRSLNQSIRIVDEIASI

AGKAPANIFIEVTRDEDPKKKGRRTKRRYNDLKDALEAFKKEDPELWREL

CETAPNDMDERLSLYFMQRGKCLYSGRAIDIHQLSNAGIYEVDHIIPRTY

VKDDSLENKALVYREENQRKTDMLLIDPEIRRRMSGYWRMLHEAKLIGDK

KFRNLLRSRIDDKALKGFIARQLVETGQMVKLVRSLLEARYPETNIISVK

ASISHDLRTAAELVKCREANDFHHAHDAFLACRVGLFIQKRHPCVYENPI

GLSQVVRNYVRQQADIFKRCRTIPGSSGFIVNSFMTSGFDKETGEIFKDD

WDAEAEVEGIRRSLNFRQCFISRMPFEDHGVFWDATIYSPRAKKTAALPL

KQGLNPSRYGSFSREQFAYFFIYKARNPRKEQTLFEFAQVPVRLSAQIRQ

DENALERYARELAKDQGLEFIRIERSKILKNQLIEIDGDRLCITGKEEVR

NACELAFAQDEMRVIRMLVSEKPVSRECVISLFNRILLHGDQASRRLSKQ

LKLALLSEAFSEASDNVQRNVVLGLIAIFNGSTNMVNLSDIGGSKFAGNV

RIKYKKELASPKVNVHLIDQSVTGMFERRTKIGL

SEQ ID NO: 317

MENKQYYIGLDVGTNSVGWAVTDTSYNLLRAKGKDMWGARLFEKANTAAE

RRTKRTSRRRSEREKARKAMLKELFADEINRVDPSFFIRLEESKFFLDDR

SENNRQRYTLFNDATFTDKDYYEKYKTIFHLRSALINSDEKFDVRLVFLA

ILNLFSHRGHFLNASLKGDGDIQGMDVFYNDLVESCEYFEIELPRITNID

NFEKILSQKGKSRTKILEELSEELSISKKDKSKYNLIKLISGLEASVVEL

YNIEDIQDENKKIKIGFRESDYEESSLKVKEIIGDEYFDLVERAKSVHDM

GLLSNIIGNSKYLCEARVEAYENHHKDLLKIKELLKKYDKKAYNDMFRKM

TDKNYSAYVGSVNSNIAKERRSVDKRKIEDLYKYIEDTALKNIPDDNKDK

IEILEKIKLGEFLKKQLTASNGVIPNQLQSRELRAILKKAENYLPFLKEK

GEKNLTVSEMIIQLFEFQIPYYVGPLDKNPKKDNKANSWAKIKQGGRILP

WNFEDKVDVKGSRKEFIEKMVRKCTYISDEHTLPKQSLLYEKFMVLNEIN

NIKIDGEKISVEAKQKIYNDLFVKGKKVSQKDIKKELISLNIMDKDSVLS

GTDTVCNAYLSSIGKFTGVFKEEINKQSIVDMIEDIIFLKTVYGDEKRFV

KEEIVEKYGDEIDKDKIKRILGFKFSNWGNLSKSFLELEGADVGTGEVRS

IIQSLWETNFNLMELLSSRFTYMDELEKRVKKLEKPLSEWTIEDLDDMYL

SSPVKRMIWQSMKIVDEIQTVIGYAPKRIFVEMTRSEGEKVRTKSRKDRL

KELYNGIKEDSKQWVKELDSKDESYFRSKKMYLYYLQKGRCMYSGEVIEL

DKLMDDNLYDIDHIYPRSFVKDDSLDNLVLVKKEINNRKQNDPITPQIQA

SCQGFWKILHDQGFMSNEKYSRLTRKTQEFSDEEKLSFINRQIVETGQAT

KCMAQILQKSMGEDVDVVFSKARLVSEFRHKFELFKSRLINDFHHANDAY

LNIVVGNSYFVKFTRNPANFIKDARKNPDNPVYKYHMDRFFERDVKSKSE

VAWIGQSEGNSGTIVIVKKTMAKNSPLITKKVEEGHGSITKETIVGVKEI

KFGRNKVEKADKTPKKPNLQAYRPIKTSDERLCNILRYGGRTSISISGYC

LVEYVKKRKTIRSLEAIPVYLGRKDSLSEEKLLNYFRYNLNDGGKDSVSD

IRLCLPFISTNSLVKIDGYLYYLGGKNDDRIQLYNAYQLKMKKEEVEYIR

KIEKAVSMSKFDEIDREKNPVLTEEKNIELYNKIQDKFENTVFSKRMSLV

-continued

KYNKKDLSFGDFLKNKKSKFEEIDLEKQCKVLYNIIFNLSNLKEVDLSDI

GGSKSTGKCRCKKNITNYKEFKLIQQSITGLYSCEKDLMTI

SEQ ID NO: 318

MKNLKEYYIGLDIGTASVGWAVTDESYNIPKFNGKKMWGVRLFDDAKTAE

ERRTQRGSRRRLNRRKERINLLQDLFATEISKVDPNFFLRLDNSDLYRED

KDEKLKSKYTLFNDKDFKDRDYHKKYPTIHHLIMDLIEDEGKKDIRLLYL

ACHYLLKNRGHFIFEGQKFDTKNSFDKSINDLKIHLRDEYNIDLEFNNED

LIEIITDTTLNKTNKKKELKNIVGDTKFLKAISAIMIGSSQKLVDLFEDG

EFEETTVKSVDFSTTAFDDKYSEYEEALGDTISLLNILKSIYDSSILENL

LKDADKSKDGNKYISKAFVKKFNKHGKDLKTLKRIIKKYLPSEYANIFRN

KSINDNYVAYTKSNITSNKRTKASKFTKQEDFYKFIKKHLDTIKETKLNS

SENEDLKLIDEMLTDIEFKTFIPKLKSSDNGVIPYQLKLMELKKILDNQS

KYYDFLNESDEYGTVKDKVESIMEFRIPYYVGPLNPDSKYAWIKRENTKI

TPWNFKDIVDLDSSREEFIDRLIGRCTYLKEEKVLPKASLIYNEFMVLNE

LNNLKLNEFLITEEMKKAIFEELFKTKKKVTLKAVSNLLKKEFNLTGDIL

LSGTDGDFKQGLNSYIDFKNIIGDKVDRDDYRIKIEEIIKLIVLYEDDKT

YLKKKIKSAYKNDFTDDEIKKIAALNYKDWGRLSKRFLTGIEGVDKTTGE

KGSIIYFMREYNLNLMELMSGHYTFTEEVEKLNPVENRELCYEMVDELYL

SPSVKRMLWQSLRVVDEIKRIIGKDPKKIFIEMARAKEAKNSRKESRKNK

LLEFYKFGKKAFINEIGEERYNYLLNEINSEEESKFRWDNLYLYYTQLGR

CMYSLEPIDLADLKSNNIYDQDHIYPKSKIYDDSLENRVLVKKNLNHEKG

NQYPIPEKVLNKNAYGFWKILFDKGLIGQKKYTRLTRRTPFEERELAEFI

ERQIVETRQATKETANLLKNICQDSEIVYSKAENASRFRQEFDIIKCRTV

NDLHHMHDAYLNIVVGNVYNTKFTKNPLNFIKDKDNVRSYNLENMFKYDV

VRGSYTAWIADDSEGNVKAATIKKVKRELEGKNYRFTRMSYIGTGGLYDQ

NLMRKGKGQIPQKENTNKSNIEKYGGYNKASSAYFALIESDGKAGRERTL

ETIPIMVYNQEKYGNTEAVDKYLKDNLELQDPKILKDKIKINSLIKLDGF

LYNIKGKTGDSLSIAGSVQLIVNKEEQKLIKKMDKFLVKKKDNKDIKVTS

FDNIKEEELIKLYKTLSDKLNNGIYSNKRNNQAKNISEALDKFKEISIEE

KIDVLNQIILLFQSYNNGCNLKSIGLSAKTGVVFIPKKLNYKECKLINQS

ITGLFENEVDLLNL

SEQ ID NO: 319

MGKMYYLGLDIGTNSVGYAVTDPSYHLLKFKGEPMWGAHVFAAGNQSAER

RSFRTSRRRLDRRQQRVKLVQEIFAPVISPIDPRFFIRLHESALWRDDVA

ETDKHIFFNDPTYTDKEYYSDYPTIHHLIVDLMESSEKHDPRLVYLAVAW

LVAHRGHFLNEVDKDNIGDVLSFDAFYPEFLAFLSDNGVSPWVCESKALQ

ATLLSRNSVNDKYKALKSLIFGSQKPEDNFDANISEDGLIQLLAGKKVKV

NKLFPQESNDASFTLNDKEDAIEEILGTLTPDECEWIAHIRRLFDWAIMK

HALKDGRTISESKVKLYEQHHHDLTQLKYFVKTYLAKEYDDIFRNVDSET

TKNYVAYSYHVKEVKGTLPKNKATQEEFCKYVLGKVKNIECSEADKVDFD

EMIQRLTDNSFMPKQVSGENRVIPYQLYYYELKTILNKAASYLPFLTQCG

KDAISNQDKLLSIMTFRIPYFVGPLRKDNSEHAWLERKAGKIYPWNFNDK

-continued

VDLDKSEEAFIRRMTNTCTYYPGEDVLPLDSLIYEKFMILNEINNIRIDG

YPISVDVKQQVFGLFEKKRRVTVKDIQNLLLSLGALDKHGKLTGIDTTIH

SNYNTYHHFKSLMERGVLTRDDVERIVERMTYSDDTKRVRLWLNNNYGTL

TADDVKHISRLRKHDFGRLSKMFLTGLKGVHKETGERASILDFMWNTNDN

LMQLLSECYTFSDEITKLQEAYYAKAQLSLNDFLDSMYISNAVKRPIYRT

LAVVNDIRKACGTAPKRIFIEMARDGESKKKRSVTRREQIKNLYRSIRKD

FQQEVDFLEKILENKSDGQLQSDALYLYFAQLGRDMYTGDPIKLEHIKDQ

SFYNIDHIYPQSMVKDDSLDNKVLVQSEINGEKSSRYPLDAAIRNKMKPL

WDAYYNHGLISLKKYQRLTRSTPFTDDEKWDFINRQLVETRQSTKALAIL

LKRKFPDTEIVYSKAGLSSDFRHEFGLVKSRNINDLHHAKDAFLAIVTGN

VYHERFNRRWFMVNQPYSVKTKTLFTHSIKNGNFVAWNGEEDLGRIVKML

KQNKNTIHFTRFSFDRKEGLFDIQPLKASTGLVPRKAGLDVVKYGGYDKS

TAAYYLLVRFTLEDKKTQHKLMMIPVEGLYKARIDHDKEFLTDYAQTTIS

EILQKDKQKVINIMFPMGTRHIKLNSMISIDGFYLSIGGKSSKGKSVLCH

AMVPLIVPHKIECYIKAMESFARKFKENNKLRIVEKFDKITVEDNLNLYE

LFLQKLQHNPYNKFFSTQFDVLTNGRSTFTKLSPEEQVQTLLNILSIFKT

CRSSGCDLKSINGSAQAARIMISADLTGLSKKYSDIRLVEQSASGLFVSK

SQNLLEYL

SEQ ID NO: 320

MTKKEQPYNIGLDIGTSSVGWAVTNDNYDLLNIKKKNLWGVRLFEEAQTA

KETRLNRSTRRRYRRRKNRINWLNEIFSEELAKTDPSFLIRLQNSWVSKK

DPDRKRDKYNLFIDGPYTDKEYYREFPTIFHLRKELILNKDKADIRLIYL

ALHNILKYRGNFTYEHQKFNISNLNNNLSKELIELNQQLIKYDISFPDDC

DWNHISDILIGRGNATQKSSNILKDFTLDKETKKLLKEVINLILGNVAHL

NTIFKTSLTKDEEKLNFSGKDIESKLDDLDSILDDDQFTVLDAANRIYST

ITLNEILNGESYFSMAKVNQYENHAIDLCKLRDMWHTTKNEEAVEQSRQA

YDDYINKPKYGTKELYTSLKKFLKVALPTNLAKEAEEKISKGTYLVKPRN

SENGVVPYQLNKIEMEKIIDNQSQYYPFLKENKEKLLSILSFRIPYYVGP

LQSAEKNPFAWMERKSNGHARPWNFDEIVDREKSSNKFIRRMTVTDSYLV

GEPVLPKNSLIYQRYEVLNELNNIRITENLKTNPIGSRLTVETKQRIYNE

LFKKYKKVTVKKLTKWLIAQGYYKNPILIGLSQKDEFNSTLTTYLDMKKI

FGSSFMEDNKNYDQIEELIEWLTIFEDKQILNEKLHSSKYSYTPDQIKKI

SNMRYKGWGRLSKKILMDITTETNTPQLLQLSNYSILDLMWATNNNFISI

MSNDKYDFKNYIENHNLNKNEDQNISDLVNDIHVSPALKRGITQSIKIVQ

EIVKFMGHAPKHIFIEVTRETKKSEITTSREKRIKRLQSKLLNKANDFKP

QLREYLVPNKKIQEELKKHKNDLSSERIMLYFLQNGKSLYSEESLNINKL

SDYQVDHILPRTYIPDDSLENKALVLAKENQRKADDLLLNSNVIDRNLER

WTYMLNNNMIGLKKFKNLTRRVITDKDKLGFIHRQLVQTSQMVKGVANIL

DNMYKNQGTTCIQARANLSTAFRKALSGQDDTYHFKHPELVKNRNVNDFH

HAQDAYLASFLGTYRLRRFPTNEMLLMNGEYNKFYGQVKELYSKKKKLPD

SRKNGFIISPLVNGTTQYDRNTGEIIWNVGFRDKILKIFNYHQCNVTRKT

-continued

EIKTGQFYDQTIYSPKNPKYKKLIAQKKDMDPNIYGGFSGDNKSSITIVK
IDNNKIKPVAIPIRLINDLKDKKTLQNWLEENVKHKKSIQIIKNNVPIGQ
IIYSKKVGLLSLNSDREVANRQQLILPPEHSALLRLLQIPDEDLDQILAF
YDKNILVEILQELITKMKKFYPFYKGEREFLIANIENFNQATTSEKVNSL
EELITLLHANSTSAHLIFNNIEKKAFGRKTHGLTLNNTDFIYQSVTGLYE
TRIHIE

SEQ ID NO: 321

MTKFNKNYSIGLDIGVSSVGYAVVTEDYRVPAFKFKVLGNTEKEKIKKNL
IGSTTFVSAQPAKGTRVFRVNRRRIDRRNHRITYLRDIFQKEIEKVDKNF
YRRLDESFRVLGDKSEDLQIKQPFFGDKELETAYHKKYPTIYHLRKHLAD
ADKNSPVADIREVYMAISHILKYRGHFLTLDKINPNNINMQNSWIDFIES
CQEVFDLEISDESKNIADIFKSSENRQEKVKKILPYFQQELLKKDKSIFK
QLLQLLFGLKTKFKDCFELEEEPDLNFSKENYDENLENFLGSLEEDFSDV
FAKLKVLRDTILLSGMLTYTGATHARFSATMVERYEEHRKDLQRFKFFIK
QNLSEQDYLDIFGRKTQNGFDVDKETKGYVGYITNKMVLTNPQKQKTIQQ
NFYDYISGKITGIEGAEYFLNKISDGTFLRKLRTSDNGAIPNQIHAYELE
KIIERQGKDYPFLLENKDKLLSILTFKIPYYVGPLAKGSNSRFAWIKRAT
SSDILDDNDEDTRNGKIRPWNYQKLINMDETRDAFITNLIGNDIILLNEK
VLPKRSLIYEEVMLQNELTRVKYKDKYGKAHFFDSELRQNIINGLFKNNS
KRVNAKSLIKYLSDNHKDLNAIEIVSGVEKGKSFNSTLKTYNDLKTIFSE
ELLDSEIYQKELEEIIKVITVFDDKKSIKNYLTKFFGHLEILDEEKINQL
SKLRYSGWGRYSAKLLLDIRDEDTGFNLLQFLRNDEENRNLTKLISDNTL
SFEPKIKDIQSKSTIEDDIFDEIKKLAGSPAIKRGILNSIKIVDELVQII
GYPPHNIVIEMARENMTTEEGQKKAKTRKTKLESALKNIENSLLENGKVP
HSDEQLQSEKLYLYYLQNGKDMYTLDKTGSPAPLYLDQLDQYEVDHIIPY
SFLPIDSIDNKVLTHRENNQQKLNNIPDKETVANMKPFWEKLYNAKLISQ
TKYQRLTTSERTPDGVLTESMKAGFIERQLVETRQIIKHVARILDNRFSD
TKIITLKSQLITNFRNTFHIAKIRELNDYHHAHDAYLAVVVGQTLLKVYP
KLAPELIYGHHAHFNRHEENKATLRKHLYSNIMRFFNNPDSKVSKDIWDC
NRDLPIIKDVIYNSQINFVKRTMIKKGAFYNQNPVGKFNKQLAANNRYPL
KTKALCLDTSIYGGYGPMNSALSIIIIAERFNEKKGKIETVKEFHDIFII
DYEKFNNNPFQFLNDTSENGFLKKNNINRVLGFYRIPKYSLMQKIDGTRM
LFESKSNLHKATQFKLTKTQNELFFHMKRLLTKSNLMDLKSKSAIKESQN
FILKHKEEFDNISNQLSAFSQKMLGNTTSLKNLIKGYNERKIKEIDIRDE
TIKYFYDNFIKMFSFVKSGAPKDINDFFDNKCTVARMRPKPDKKLLNATL
IHQSITGLYETRIDLSKLGED

SEQ ID NO: 322

MKQEYFLGLDMGTGSLGWAVTDSTYQVMRKHGKALWGTRLFESASTAEER
RMFRTARRRLDRRNWRIQVLQEIFSEEISKVDPGFFLRMKESKYYPEDKR
DAEGNCPELPYALFVDDNYTDKNYHKDYPTIYHLRKMLMETTEIPDIRLV
YLVLHHMMKHRGHFLLSGDISQIKEFKSTFEQLIQNIQDEELEWHISLDD

-continued

AAIQFVEHVLKDRNLTRSTKKSRLIKQLNAKSACEKAILNLLSGGTVKLS
DIFNNKELDESERPKVSFADSGYDDYIGIVEAELAEQYYIIASAKAVYDW
SVLVEILGNSVSISEAKIKVYQKHQADLKTLKKIVRQYMTKEDYKRVFVD
TEEKLNNYSAYIGMTKKNGKKVDLKSKQCTQADFYDFLKKNVIKVIDHKE
ITQEIESEIEKENFLPKQVTKDNGVIPYQVHDYELKKILDNLGTRMPFIK
ENAEKIQQLFEFRIPYYVGPLNRVDDGKDGKFTWSVRKSDARIYPWNFTE
VIDVEASAEKFIRRMTNKCTYLVGEDVLPKDSLVYSKFMVLNELNNLRLN
GEKISVELKQRIYEELFCKYRKVTRKKLERYLVIEGIAKKGVEITGIDGD
FKASLTAYHDFKERLTDVQLSQRAKEAIVLNVVLFGDDKKLLKQRLSKMY
PNLTTGQLKGICSLSYQGWGRLSKTFLEEITVPAPGTGEVWNIMTALWQT
NDNLMQLLSRNYGFTNEVEEFNTLKKETDLSYKTVDELYVSPAVKRQIWQ
TLKVVKEIQKVMGNAPKRVFVEMAREKQEGKRSDSRKKQLVELYRACKNE
ERDWITELNAQSDQQLRSDKLFLYYIQKGRCMYSGETIQLDELWDNTKYD
IDHIYPQSKTMDDSLNNRVLVKKNYNAIKSDTYPLSLDIQKKMMSFWKML
QQQGFITKEKYVRLVRSDELSADELAGFIERQIVETRQSTKAVATILKEA
LPDTEIVYVKAGNVSNFRQTYELLKVREMNDLHHAKDAYLNIVVGNAYFV
KFTKNAAWFIRNNPGRSYNLKRMFEFDIERSGEIAWKAGNKGSIVTVKKV
MQKNNILVTRKAYEVKGGLFDQQIMKKGKGQVPIKGNDERLADIEKYGGY
NKAAGTYFMLVKSLDKKGKEIRTIEFVPLYLKNQIEINHESAIQYLAQER
GLNSPEILLSKIKIDTLFKVDGFKMWLSGRTGNQLIFKGANQLILSHQEA
AILKGVVKYVNRKNENKDAKLSERDGMTEEKLLQLYDTFLDKLSNTVYSI
RLSAQIKTLTEKRAKFIGLSNEDQCIVLNEILHMFQCQSGSANLKLIGGP
GSAGILVMNNNITACKQISVINQSPTGIYEKEIDLIKL

SEQ ID NO: 323

MKKPYSIGLDIGTNSVGWAVVTDDYKVPAKKMKVLGNTDKSHIEKNLLGA
LLFDSGNTAEDRRLKRTARRRYTRRRNRILYLQEIFSEEMGKVDDSFFHR
LEDSFLVTEDKRGERHPIFGNLEEEVKYHENFPTIYHLRQYLADNPEKVD
LRLVYLALAHIIKFRGHFLIEGKFDTRNNDVQRLFQEFLAVYDNTFENSS
LQEQNVQVEEILTDKISKSAKKDRVLKLFPNEKSNGRFAEFLKLIVGNQA
DFKKHFELEEKAPLQFSKDTYEEELEVLLAQIGDNYAELFLSAKKLYDSI
LLSGILTVTDVGTKAPLSASMIQRYNEHQMDLAQLKQFIRQKLSDKYNEV
FSDVSKDGYAGYIDGKTNQEAFYKYLKGLLNKIEGSGYFLDKIEREDFLR
KQRTFDNGSIPHQIHLQEMRAIIRRQAEFYPFLADNQDRIEKLLTFRIPY
YVGPLARGKSDFAWLSRKSADKITPWNFDEIVDKESSAEAFINRMTNYDL
YLPNQKVLPKHSLLYEKFTVYNELTKVKYKTEQGKTAFFDANMKQEIFDG
VFKVYRKVTKDKLMDFLEKEFDEFRIVDLTGLDKENKVFNASYGTYHDLC
KILDKDFLDNSKNEKILEDIVLTLTLFEDREMIRKRLENYSDLLTKEQVK
KLERRHYTGWGRLSAELIHGIRNKESRKTILDYLIDDGNSNRNFMQLIND
DALSFKEEIAKAQVIGETDNLNQVVSDIAGSPAIKKGILQSLKIVDELVK
IMGHQPENIVVEMARENQFTNQGRRNSQQRLKGLTDSIKEFGSQILKEHP
VENSQLQNDRLFLYYLQNGRDMYTGEELDIDYLSQYDIDHIIPQAFIKDN

-continued

SIDNRVLTSSKENRGKSDDVPSKDVVRKMKSYWSKLLSAKLITQRKFDNL

TKAERGGLTDDDKAGFIKRQLVETRQITKHVARILDERFNTETDENNKKI

RQVKIVTLKSNLVSNFRKEFELYKVREINDYHHAHDAYLNAVIGKALLGV

YPQLEPEFVYGDYPHFHGHKENKATAKKFFYSNIMNFFKKDDVRTDKNGE

IIWKKDEHISNIKKVLSYPQVNIVKKVEEQTGGFSKESILPKGNSDKLIP

RKTKKFYWDTKKYGGFDSPIVAYSILVIADIEKGKSKKLKTVKALVGVTI

MEKMTFERDPVAFLERKGYRNVQEENIIKLPKYSLFKLENGRKRLLASAR

ELQKGNEIVLPNHLGTLLYHAKNIHKVDEPKHLDYVDKHKDEFKELLDVV

SNFSKKYTLAEGNLEKIKELYAQNNGEDLKELASSFINLLTFTAIGAPAT

FKFFDKNIDRKRYTSTTEILNATLIHQSITGLYETRIDLNKLGGD

SEQ ID NO: 324

MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD

SEQ ID NO: 325

MTKPYSIGLDIGTNSVGWAVTTDNYKVPSKKMKVLGNTSKKYIKKNLLGV

LLFDSGITAEGRRLKRTARRRYTRRRNRILYLQEIFSTEMATLDDAFFQR

-continued

LDDSFLVPDDKRDSKYPIFGNLVEEKAYHDEFPTIYHLRKYLADSTKKAD

LRLVYLALAHMIKYRGHFLIEGEFNSKNNDIQKNFQDFLDTYNAIFESDL

SLENSKQLEEIVKDKISKLEKKDRILKLFPGEKNSGIFSEFLKLIVGNQA

DFRKCFNLDEKASLHFSKESYDEDLETLLGYIGDDYSDVFLKAKKLYDAI

LLSGFLTVTDNETEAPLSSAMIKRYNEHKEDLALLKEYIRNISLKTYNEV

FKDDTKNGYAGYIDGKTNQEDFYVYLKKLLAEFEGADYFLEKIDREDFLR

KQRTFDNGSIPYQIHLQEMRAILDKQAKFYPFLAKNKERIEKILTFRIPY

YVGPLARGNSDFAWSIRKRNEKITPWNFEDVIDKESSAEAFINRMTSFDL

YLPEEKVLPKHSLLYETFNVYNELTKVRFIAESMRDYQFLDSKQKKDIVR

LYFKDKRKVTDKDIIEYLHAIYGYDGIELKGIEKQFNSSLSTYHDLLNII

NDKEFLDDSSNEAIIEEIIHTLTIFEDREMIKQRLSKFENIFDKSVLKKL

SRRHYTGWGKLSAKLINGIRDEKSGNTILDYLIDDGISNRNFMQLIHDDA

LSFKKKIQKAQIIGDEDKGNIKEVVKSLPGSPAIKKGILQSIKIVDELVK

VMGGRKPESIVVEMARENQYTNQGKSNSQQRLKRLEKSLKELGSKILKEN

IPAKLSKIDNNALQNDRLYLYYLQNGKDMYTGDDLDIDRLSNYDIDHIIP

QAFLKDNSIDNKVLVSSASNRGKSDDVPSLEVVKKRKTFWYQLLKSKLIS

QRKFDNLTKAERGGLSPEDKAGFIQRQLVETRQITKHVARLLDEKFNNKK

DENNRAVRTVKIITLKSTLVSQFRKDFELYKVREINDFHHAHDAYLNAVV

ASALLKKYPKLEPEFVYGDYPKYNSFRERKSATEKVYFYSNIMNIFKKSI

SLADGRVIERPLIEVNEETGESVWNKESDLATVRRVLSYPQVNVVKKVEE

QNHGLDRGKPKGLFNANLSSKPKPNSNENLVGAKEYLDPKKYGGYAGISN

SFTVLVKGTIEKGAKKKITNVLEFQGISILDRINYRKDKLNFLLEKGYKD

IELIIELPKYSLFELSDGSRRMLASILSTNNKRGEIHKGNQIFLSQKFVK

LLYHAKRISNTINENHRKYVENHKKEFEELFYYILEFNENYVGAKKNGKL

LNSAFQSWQNHSIDELCSSFIGPTGSERKGLFELTSRGSAADFEFLGVKI

PRYRDYTPSSLLKDATLIHQSVTGLYETRIDLAKLGEG

SEQ ID NO: 326

MKKQKFSDYYLGFDIGTNSVGWCVTDLDYNVLRFNKKDMWGSRLFDEAKT

AAERRVQRNSRRRLKRRKWRLNLLEEIFSDEIMKIDSNFFRRLKESSLWL

EDKNSKEKFTLFNDDNYKDYDFYKQYPTIFHLRDELIKNPEKKDIRLIYL

ALHSIFKSRGHFLFEGQNLKEIKNFETLYNNLISFLEDNGINKSIDKDNI

EKLEKIICDSGKGLKDKEKEFKGIFNSDKQLVAIFKLSVGSSVSLNDLFD

TDEYKKEEVEKEKISFREQIYEDDKPIYYSILGEKIELLDIAKSFYDFMV

LNNILSDSNYISEAKVKLYEEHKKDLKNLKYIIRKYNKENYDKLFKDKNE

NNYPAYIGLNKEKDKKEVVEKSRLKIDDLIKVIKGYLPKPERIEEKDKTI

FNEILNKIELKTILPKQRISDNGTLPYQIHEVELEKILENQSKYYDFLNY

EENGVSTKDKLLKTFKFRIPYYVGPLNSYHKDKGGNSWIVRKEEGKILPW

NFEQKVDIEKSAEEFIKRMTNKCTYLNGEDVIPKDSFLYSEYIILNELNK

VQVNDEFLNEENKRKIIDELFKENKKVSEKKFKEYLLVNQIANRTVELKG

IKDSFNSNYVSYIKFKDIFGEKLNLDIYKEISEKSILWKCLYGDDKKIFE

KKIKNEYGDILNKDEIKKINSFKFNTWGRLSEKLLTGIEFINLETGECYS

-continued

SVMEALRRTNYNLMELLSSKFTLQESIDNENKEMNEVSYRDLIEESYVSP
SLKRAILQTLKIYEEIKKITGRVPKKVFIEMARGGDESMKNKKIPARQEQ
LKKLYDSCGNDIANFSIDIKEMKNSLSSYDNNSLRQKKLYLYYLQFGKCM
YTGREIDLDRLLQNNDTYDIDHIYPRSKVIKDDSFDNLVLVLKNENAEKS
NEYPVKKEIQEKMKSFWRFLKEKNFISDEKYKRLTGKDDFELRGFMARQL
VNVRQTTKEVGKILQQIEPEIKIVYSKAEIASSFREMFDFIKVRELNDTH
HAKDAYLNIVAGNVYNTKFTEKPYRYLQEIKENYDVKKIYNYDIKNAWDK
ENSLEIVKKNMEKNTVNITRFIKEEKGELFNLNPIKKGETSNEIISIKPK
LYDGKDNKLNEKYGYYTSLKAAYFIYVEHEKKNKKVKTFERITRIDSTLI
KNEKNLIKYLVSQKKLLNPKIIKKIYKEQTLIIDSYPYTFTGVDSNKKVE
LKNKKQLYLEKKYEQILKNALKFVEDNQGETEENYKFIYLKKRNNNEKNE
TIDAVKERYNIEFNEMYDKFLEKLSSKDYKNYINNKLYTNFLNSKEKFKK
LKLWEKSLILREFLKIFNKNTYGKYEIKDSQTKEKLFSFPEDTGRIRLGQ
SSLGNNKELLEESVTGLFVKKIKL

SEQ ID NO: 327

MKNYTIGLDIGVASVGWVCIDENYKILNYNNRHAFGVHEFESAESAAGRR
LKRGMRRRYNRRKKRLQLLQSLFDSYITDSGFFSKTDSQHFWKNNNEFEN
RSLTEVLSSLRISSRKYPTIYHLRSDLIESNKKMDLRLVYLALHNLVKYR
GHFLQEGNWSEAASAEGMDDQLLELVTRYAELENLSPLDLSESQWKAAET
LLLNRNLTKTDQSKELTAMFGKEYEPFCKLVAGLGVSLHQLFPSSEQALA
YKETKTKVQLSNENVEEVMELLLEEESALLEAVQPFYQQVVLYELLKGET
YVAKAKVSAFKQYQKDMASLKNLLDKTFGEKVYRSYFISDKNSQREYQKS
HKVEVLCKLDQFNKEAKFAETFYKDLKKLLEDKSKTSIGTTEKDEMLRII
KAIDSNQFLQKQKGIQNAAIPHQNSLYEAEKILRNQQAHYPFITTEWIEK
VKQILAFRIPYYIGPLVKDTTQSPFSWVERKGDAPITPWNFDEQIDKAAS
AEAFISRMRKTCTYLKGQEVLPKSSLTYERFEVLNELNGIQLRTTGAESD
FRHRLSYEMKCWIIDNVFKQYKTVSTKRLLQELKKSPYADELYDEHTGEI
KEVFGTQKENAFATSLSGYISMKSILGAVVDDNPAMTEELIYWIAVFEDR
EILHLKIQEKYPSITDVQRQKLALVKLPGWGRFSRLLIDGLPLDEQGQSV
LDHMEQYSSVFMEVLKNKGFGLEKKIQKMNQHQVDGTKKIRYEDIEELAG
SPALKRGIWRSVKIVEELVSIFGEPANIVLEVAREDGEKKRTKSRKDQWE
ELTKTTLKNDPDLKSFIGEIKSQGDQRFNEQRFWLYVTQQGKCLYTGKAL
DIQNLSMYEVDHILPQNFVKDDSLDNLALVMPEANQRKNQVGQNKMPLEI
IEANQQYAMRTLWERLHELKLISSGKLGRLKKPSFDEVDKDKFIARQLVE
TRQIIKHVRDLLDERFSKSDIHLVKAGIVSKFRRFSEIPKIRDYNNKHHA
MDALFAAALIQSILGKYGKNFLAFDLSKKDRQKQWRSVKGSNKEFFLFKN
FGNLRLQSPVTGEEVSGVEYMKHVYFELPWQTTKMTQTGDGMFYKESIFS
PKVKQAKYVSPKTEKFVHDEVKNHSICLVEFTFMKKEKEVQETKFIDLKV
IEHHQFLKEPESQLAKFLAEKETNSPIIHARIIRTIPKYQKIWIEHFPYY
FISTRELHNARQFEISYELMEKVKQLSERSSVEELKIVFGLLIDQMNDNY
PIYTKSSIQDRVQKFVDTQLYDFKSFEIGFEELKKAVAANAQRSDTFGSR
ISKKPKPEEVAIGYESITGLKYRKPRSVVGTKR

SEQ ID NO: 328

MKKEIKDYFLGLDVGTGSVGWAVTDTDYKLLKANRKDLWGMRCFETAETA
EVRRLHRGARRRIERRKKRIKLLQELFSQEIAKTDEGFFQRMKESPFYAE
DKTILQENTLFNDKDFADKTYHKAYPTINHLIKAWIENKVKPDPRLLYLA
CHNIIKKRGHFLFEGDFDSENQFDTSIQALFEYLREDMEVDIDADSQKVK
EILKDSSLKNSEKQSRLNKILGLKPSDKQKKAITNLISGNKINFADLYDN
PDLKDAEKNSISFSKDDFDALSDDLASILGDSFELLLKAKAVYNCSVLSK
VIGDEQYLSFAKVKIYEKHKTDLTKLKNVIKKHFPKDYKKVFGYNKNEKN
NNNYSGYVGVCKTKSKKLIINNSVNQEDFYKFLKTILSAKSEIKEVNDIL
TEIETGTFLPKQISKSNAEIPYQLRKMELEKILSNAEKHFSFLKQKDEKG
LSHSEKIIMLLTFKIPYYIGPINDNHKKFFPDRCWVVKKEKSPSGKTTPW
NFFDHIDKEKTAEAFITSRTNFCTYLVGESVLPKSSLLYSEYTVLNEINN
LQIIIDGKNICDIKLKQKIYEDLFKKYKKITQKQISTFIKHEGICNKTDE
VIILGIDKECTSSLKSYIELKNIFGKQVDEISTKNMLEEIIRWATIYDEG
EGKTILKTKIKAEYGKYCSDEQIKKILNLKFSGWGRLSRKFLETVTSEMP
GFSEPVNIITAMRETQNNLMELLSSEFTFTENIKKINSGFEDAEKQFSYD
GLVKPLFLSPSVKKMLWQTLKLVKEISHITQAPPKKIFIEMAKGAELEPA
RTKTRLKILQDLYNNCKNDADAFSSEIKDLSGKIENEDNLRLRSDKLYLY
YTQLGKCMYCGKPIEIGHVFDTSNYDIDHIYPQSKIKDDSISNRVLVCSS
CNKNKEDKYPLKSEIQSKQRGFWNFLQRNNFISLEKLNRLTRATPISDDE
TAKFIARQLVETRQATKVVAAKVLEKMFPETKIVYSKAETVSMFRNKFDIV
KCREINDFHHAHDAYLNIVVGNVYNTKFTNNPWNFIKEKRDNPKIADTYN
YYKVFDYDVKRNNITAWEKGKTIITVKDMLKRNTPIYTRQAACKKGELFN
QTIMKKGLGQHPLKKEGPFSNISKYGGYNKVSAAYYTLIEYEEKGNKIRS
LETIPLYLVKDIQKDQDVLKSYLTDLLGKKEFKILVPKIKINSLLKINGF
PCHITGKTNDSFLLRPAVQFCCSNNEVLYFKKIIRFSEIRSQREKIGKTI
SPYEDLSFRSYIKENLWKKTKNDEIGEKEFYDLLQKKNLEIYDMLLTKHK
DTIYKKRPNSATIDILVKGKEKFKSLIIENQFEVILEILKLFSATRNVSD
LQHIGGSKYSGVAKIGNKISSLDNCILIYQSITGIFEKRIDLLKV

SEQ ID NO: 329

MEGQMKNNGNNLQQGNYYLGLDVGTSSVGWAVTDTDYNVLKFRGKSMWGA
RLFDEASTAEERRTHRGNRRRLARRKYRLLLLEQLFEKEIRKIDDNFFVR
LHESNLWADDKSKPSKFLLFNDTNFTDKDYLKKYPTIYHLRSDLIHNSTE
HDIRLVFLALHHLIKYRGHFIYDNSANGDVKTLDEAVSDFEEYLNENDIE
FNIENKKEFINVLSDKHLTKKEKKISLKKLYGDITDSENINISVLIEMLS
GSSISLSNLFKDIEFDGKQNLSLDSDIEETLNDVVDILGDNIDLLIHAKE
VYDIAVLTSSLGKHKYLCDAKVELFEKNKKDLMILKKYIKKNHPEDYKKI
FSSPTEKKNYAAYSQTNSKNVCSQEEFCLFIKPYIRDMVKSENEDEVRIA
KEVEDKSFLTKLKGTNNSVVPYQIHERELNQILKNIVAYLPFMNDEQEDI
SVVDKIKLIFKFKIPYYVGPLNTKSTRSWVYRSDEKIYPWNFSNVIDLDK

-continued

TAHEFMNRLIGRCTYTNDPVLPMDSLLYSKYNVLNEINPIKVNGKAIPVE

VKQAIYTDLFENSKKKVTRKSIYIYLLKNGYIEKEDIVSGIDIEIKSKLK

SHHDFTQIVQENKCTPEEIERIIKGILVYSDDKSMLRRWLKNNIKGLSEN

DVKYLAKLNYKEWGRLSKTLLTDIYTINPEDGEACSILDIMWNTNATLME

ILSNEKYQFKQNIENYKAENYDEKQNLHEELDDMYISPAARRSIWQALRI

VDEIVDIKKSAPKKIFIEMAREKKSAMKKKRTESRKDTLLELYKSCKSQA

DGFYDEELFEKLSNESNSRLRRDQLYLYYTQMGRSMYTGKRIDFDKLIND

KNTYDIDHIYPRSKIKDDSITNRVLVEKDINGEKTDIYPISEDIRQKMQP

FWKILKEKGLINEEKYKRLTRNYELTDEELSSFVARQLVETQQSTKALAT

LLKKEYPSAKIVYSKAGNVSEFRNRKDKELPKFREINDLHHAKDAYLNIV

VGNVYDTKFTEKFFNNIRNENYSLKRVFDFSVPGAWDAKGSTFNTIKKYM

AKNNPIIAFAPYEVKGELFDQQIVPKGKGQFPIKQGKDIEKYGGYNKLSS

AFLFAVEYKGKKARERSLETVYIKDVELYLQDPIKYCESVLGLKEPQIIK

PKILMGSLFSINNKKLVVTGRSGKQYVCHHIYQLSINDEDSQYLKNIAKY

LQEEPDGNIERQNILNITSVNNIKLFDVLCTKFNSNTYEIILNSLKNDVN

EGREKFSELDILEQCNILLQLLKAFKCNRESSNLEKLNNKKQAGVIVIPH

LFTKCSVFKVIHQSITGLFEKEMDLLK

SEQ ID NO: 330

MGRKPYILSLDIGTGSVGYACMDKGFNVLKYHDKDALGVYLFDGALTAQE

RRQFRTSRRRKNRRIKRLGLLQELLAPLVQNPNFYQFQRQFAWKNDNMDF

KNKSLSEVLSFLGYESKKYPTIYHLQEALLLKDEKFDPELIYMALYHLVK

YRGHFLFDHLKIENLTNNDNMHDFVELIETYENLNNIKLNLDYEKTKVIY

EILKDNEMTKNDRAKRVKNMEKKLEQFSIMLLGLKFNEGKLFNHADNAEE

LKGANQSHTFADNYEENLTPFLTVEQSEFIERANKIYLSLTLQDILKGKK

SMAMSKVAAYDKFRNELKQVKDIVYKADSTRTQFKKIFVSSKKSLKQYDA

TPNDQTFSSLCLFDQYLIRPKKQYSLLIKELKKIIPQDSELYFEAENDTL

LKVLNTTDNASIPMQINLYEAETILRNQQKYHAEITDEMIEKVLSLIQFR

IPYYVGPLVNDHTASKFGWMERKSNESIKPWNFDEVVDRSKSATQFIRRM

TNKCSYLINEDVLPKNSLLYQEMEVLNELNATQIRLQTDPKNRKYRMMPQ

IKLFAVEHIFKKYKTVSHSKFLEIMLNSNHRENFMNHGEKLSIFGTQDDK

KFASKLSSYQDMTKIFGDIEGKRAQIEEIIQWITIFEDKKILVQKLKECY

PELTSKQINQLKKLNYSGWGRLSEKLLTHAYQGHSIIELLRHSDENFMEI

LTNDVYGFQNFIKEENQVQSNKIQHQDIANLTTSPALKKGIWSTIKLVRE

LTSIFGEPEKIIMEFATEDQQKGKKQKSRKQLWDDNIKKNKLKSVDEYKY

IIDVANKLNNEQLQQEKLWLYLSQNGKCMYSGQSIDLDALLSPNATKHYE

VDHIFPRSFIKDDSIDNKVLVIKKMNQTKGDQVPLQFIQQPYERIAYWKS

LNKAGLISDSKLHKLMKPEFTAMDKEGFIQRQLVETRQISVHVRDFLKEE

YPNTKVIPMKAKMVSEFRKKFDIPKIRQMNDAHHAIDAYLNGVVYHGAQL

AYPNVDLFDFNFKWEKVREKWKALGEFNTKQKSRELFFFKKLEKMEVSQG

ERLISKIKLDMNHFKINYSRKLANIPQQFYNQTAVSPKTAELKYESNKSN

EVVYKGLTPYQTYVVAIKSVNKKGKEKMEYQMIDHYVFDFYKFQNGNEKE

-continued

LALYLAQRENKDEVLDAQIVYSLNKGDLLYINNHPCYFVSRKEVINAKQF

ELTVEQQLSLYNVMNNKETNVEKLLIEYDFIAEKVINEYHHYLNSKLKEK

RVRTFFSESNQTHEDFIKALDELFKVVTASATRSDKIGSRKNSMTHRAFL

GKGKDVKIAYTSISGLKTTKPKSLFKLAESRNEL

SEQ ID NO: 331

MAKILGLDLGTNSIGWAVVERENIDFSLIDKGVRIFSEGVKSEKGIESSR

AAERTGYRSARKIKYRRKLRKYETLKVLSLNRMCPLSIEEVEEWKKSGFK

DYPLNPEFLKWLSTDEESNVNPYFFRDRASKHKVSLFELGRAFYHIAQRR

GFLSNRLDQSAEGILEEHCPKIEAIVEDLISIDEISTNITDYFFETGILD

SNEKNGYAKDLDEGDKKLVSLYKSLLAILKKNESDFENCKSEIIERLNKK

DVLGKVKGKIKDISQAMLDGNYKTLGQYFYSLYSKEKIRNQYTSREEHYL

SEFITICKVQGIDQINEEEKINEKKFDGLAKDLYKAIFFQRPLKSQKGLI

GKCSFEKSKSRCAISHPDFEEYRMWTYLNTIKIGTQSDKKLRFLTQDEKL

KLVPKFYRKNDFNFDVLAKELIEKGSSFGFYKSSKKNDFFYWFNYKPTDT

VAACQVAASLKNAIGEDWKTKSFKYQTINSNKEQVSRTVDYKDLWHLLTV

ATSDVYLYEFAIDKLGLDEKNAKAFSKTKLKKDFASLSLSAINKILPYLK

EGLLYSHAVFVANIENIVDENIWKDEKQRDYIKTQISEIIENYTLEKSRF

EIINGLLKEYKSENEDGKRVYYSKEAEQSFENDLKKKLVLFYKSNEIENK

EQQETIFNELLPIFIQQLKDYEFIKIQRLDQKVLIFLKGKNETGQIFCTE

EKGTAEEKEKKIKNRLKKLYHPSDIEKFKKKIIKDEFGNEKIVLGSPLTP

SIKNPMAMRALHQLRKVLNALILEGQIDEKTIIHIEMARELNDANKRKGI

QDYQNDNKKFREDAIKEIKKLYFEDCKKEVEPTEDDILRYQLWMEQNRSE

IYEEGKNISICDIIGSNPAYDIEHTIPRSRSQDNSQMNKTLCSQRFNREV

KKQSMPIELNNHLEILPRIAHWKEEADNLTREIEIISRSIKAAATKEIKD

KKIRRRHYLTLKRDYLQGKYDRFIWEEPKVGFKNSQIPDTGIITKYAQAY

LKSYFKKVESVKGGMVAEFRKIWGIQESFIDENGMKHYKVKDRSKHTHHT

IDAITIACMTKEKYDVLAHAWTLEDQQNKKEARSIIEASKPWKTFKEDLL

KIEEEILVSHYTPDNVKKQAKKIVRVRGKKQFVAEVERDVNGKAVPKKAA

SGKTIYKLDGEGKKLPRLQQGDTIRGSLHQDSIYGAIKNPLNTDEIKYVI

RKDLESIKGSDVESIVDEVVKEKIKEAIANKVLLLSSNAQQKNKLVGTVW

MNEEKRIAINKVRIYANSVKNPLHIKEHSLLSKSKHVHKQKVYGQNDENY

AMAIYELDGKRDFELINIFNLAKLIKQGQGFYPLHKKKEIKGKIVFVPIE

KRNKRDVVLKRGQQVVFYDKEVENPKDISEIVDFKGRIYIIEGLSIQRIV

RPSGKVDEYGVIMLRYFKEARKADDIKQDNFKPDGVFKLGENKPTRKMNH

QFTAFVEGIDFKVLPSGKFEKI

SEQ ID NO: 332

MEFKKVLGLDIGTNSIGCALLSLPKSIQDYGKGGRLEWLTSRVIPLDADY

MKAFIDGKNGLPQVITPAGKRRQKRGSRRLKHRYKLRRSRLIRVFKTLNW

LPEDFPLDNPKRIKETISTEGKFSFRISDYVPISDESYREFYREFGYPEN

EIEQVIEEINFRRKTKGKNKNPMIKLLPEDWVVYYLRKKALIKPTTKEEL

IRIIYLFNQRRGFKSSRKDLTETAILDYDEFAKRLAEKEKYSAENYETKF

VSITKVKEVVELKTDGRKGKKRFKVILEDSRIEPYEIERKEKPDWEGKEY

-continued

TFLVTQKLEKGKFKQNKPDLPKEEDWALCTTALDNRMGSKHPGEFFFDEL
LKAFKEKRGYKIRQYPVNRWRYKKELEFIWTKQCQLNPELNNLNINKEIL
RKLATVLYPSQSKFFGPKIKEFENSDVLHIISEDIIYYQRDLKSQKSLIS
ECRYEKRKGIDGEIYGLKCIPKSSPLYQEFRIWQDIHNIKVIRKESEVNG
KKKINIDETQLYINENIKEKLFELFNSKDSLSEKDILELISLNIINSGIK
ISKKEEETTHRINLFANRKELKGNETKSRYRKVFKKLGFDGEYILNHPSK
LNRLWHSDYSNDYADKEKTEKSILSSLGWKNRNGKWEKSKNYDVFNLPLE
VAKAIANLPPLKKEYGSYSALAIRKMLVVMRDGKYWQHPDQIAKDQENTS
LMLFDKNLIQLTNNQRKVLNKYLLTLAEVQKRSTLIKQKLNEIEHNPYKL
ELVSDQDLEKQVLKSFLEKKNESDYLKGLKTYQAGYLIYGKHSEKDVPIV
NSPDELGEYIRKKLPNNSLRNPIVEQVIRETIFIVRDVWKSFGIIDEIHI
ELGRELKNNSEERKKTSESQEKNFQEKERARKLLKELLNSSNFEHYDENG
NKIFSSFTVNPNPDSPLDIEKFRIWKNQSGLTDEELNKKLKDEKIPTEIE
VKKYILWLTQKCRSPYTGKIIPLSKLFDSNVYEIEHIIPRSKMKNDSTNN
LVICELGVNKAKGDRLAANFISESNGKCKFGEVEYTLLKYGDYLQYCKDT
FKYQKAKYKNLLATEPPEDFIERQINDTRYIGRKLAELLTPVVKDSKNII
FTIGSITSELKITWGLNGVWKDILRPRFKRLESIINKKLIFQDEDDPNKY
HFDLSINPQLDKEGLKRLDHRHHALDATIIAATTREHVRYLNSLNAADND
EEKREYFLSLCNHKIRDFKLPWENFTSEVKSKLLSCVVSYKESKPILSDP
FNKYLKWEYKNGKWQKVFAIQIKNDRWKAVRRSMFKEPIGTVWIKKIKEV
SLKEAIKIQAIWEEVKNDPVRKKKEKYIYDDYAQKVIAKIVQELGLSSSM
RKQDDEKLNKFINEAKVSAGVNKNLNTTNKTIYNLEGRFYEKIKVAEYVL
YKAKRMPLNKKEYIEKLSLQKMFNDLPNFILEKSILDNYPEILKELESDN
KYIIEPHKKNNPVNRLLLEHILEYHNNPKEAFSTEGLEKLNKKAINKIGK
PIKYITRLDGDINEEEIFRGAVFETDKGSNVYFVMYENNQTKDREFLKPN
PSISVLKAIEHKNKIDFFAPNRLGFSRIILSPGDLVYVPTNDQYVLIKDN
SSNETIINWDDNEFISNRIYQVKKFTGNSCYFLKNDIASLILSYSASNGV
GEFGSQNISEYSVDDPPIRIKDVCIKIRVDRLGNVRPL

SEQ ID NO: 333

MKHILGLDLGTNSIGWALIERNIEEKYGKIIGMGSRIVPMGAELSKFEQG
QAQTKNADRRTNRGARRLNKRYKQRRNKLIYILQKLDMLPSQIKLKEDFS
DPNKIDKITILPISKKQEQLTAFDLVSLRVKALTEKVGLEDLGKIIYKYN
QLRGYAGGSLEPEKEDIFDEEQSKDKKNKSFIAFSKIVFLGEPQEEIFKN
KKLNRRAIIVETEEGNFEGSTFLENIKVGDSLELLINISASKSGDTITIK
LPNKTNWRKKMENIENQLKEKSKEMGREFYISEFLLELLKENRWAKIRNN
TILRARYESEFEAIWNEQVKHYPFLENLDKKTLIEIVSFIFPGEKESQKK
YRELGLEKGLKYIIKNQVVFYQRELKDQSHLISDCRYEPNEKAIAKSHPV
FQEYKVWEQINKLIVNTKIEAGTNRKGEKKYKYIDRPIPTALKEWIFEEL
QNKKEITFSAIFKKLKAEFDLREGIDFLNGMSPKDKLKGNETKLQLQKSL
GELWDVLGLDSINRQIELWNILYNEKGNEYDLTSDRTSKVLEFINKYGNN
IVDDNAEETAIRISKIKFARAYSSLSLKAVERILPLVRAGKYFNNDFSQQ

-continued

LQSKILKLLNENVEDPFAKAAQTYLDNNQSVLSEGGVGNSIATILVYDKH
TAKEYSHDELYKSYKEINLLKQGDLRNPLVEQIINEALVLIRDIWKNYGI
KPNEIRVELARDLKNSAKERATIHKRNKDNQTINNKIKETLVKNKKELSL
ANIEKVKLWEAQRHLSPYTGQPIPLSDLFDKEKYDVDHIIPISRYFDDSF
TNKVISEKSVNQEKANRTAMEYFEVGSLKYSIFTKEQFIAHVNEYFSGVK
RKNLLATSIPEDPVQRQIKDTQYIAIRVKEELNKIVGNENVKTTTGSITD
YLRNHWGLTDKFKLLLKERYEALLESEKFLEAEYDNYKKDFDSRKKEYEE
KEVLFEEQELTREEFIKEYKENYIRYKKNKLIIKGWSKRIDHRHHAIDAL
IVACTEPAHIKRLNDLNKVLQDWLVEHKSEFMPNFEGSNSELLEEILSLP
ENERTEIFTQIEKFRAIEMPWKGFPEQVEQKLKEIIISHKPKDKLLLQYN
KAGDRQIKLRGQLHEGTLYGISQGKEAYRIPLTKFGGSKFATEKNIQKIV
SPFLSGFIANHLKEYNNKKEEAFSAEGIMDLNNKLAQYRNEKGELKPHTP
ISTVKIYYKDPSKNKKKKDEEDLSLQKLDREKAFNEKLYVKTGDNYLFAV
LEGEIKTKKTSQIKRLYDIISFFDATNFLKEEFRNAPDKKTFDKDLLFRQ
YFEERNKAKLLFTLKQGDFVYLPNENEEVILDKESPLYNQYWGDLKERGK
NIYVVQKFSKKQIYFIKHTIADIIKKDVEFGSQNCYETVEGRSIKENCFK
LEIDRLGNIVKVIKR

SEQ ID NO: 334

MHVEIDFPHFSRGDSHLAMNKNEILRGSSVLYRLGLDLGSNSLGWFVTHL
EKRGDRHEPVALGPGGVRIFPDGRDPQSGTSNAVDRRMARGARKRRDRFV
ERRKELIAALIKYNLLPDDARERRALEVLDPYALRKTALTDTLPAHHVGR
ALFHLNQRRGFQSNRKTDSKQSEDGAIKQAASRLATDKGNETLGVFFADM
HLRKSYEDRQTAIRAELVRLGKDHLTGNARKKIWAKVRKRLFGDEVLPRA
DAPHGVRARATITGTKASYDYYPTRDMLRDEFNAIWAGQSAHHATITDEA
RTEIEHIIFYQRPLKPAIVGKCTLDPATRPFKEDPEGYRAPWSHPLAQRF
RILSEARNLEIRDTGKGSRRLTKEQSDLVVAALLANREVKFDKLRTLLKL
PAEARFNLESDRRAALDGDQTAARLSDKKGFNKAWRGFPPERQIAIVARL
EETEDENELIAWLEKECALDGAAAARVANTTLPDGHCRLGLRAIKKIVPI
MQDGLDEDGVAGAGYHIAAKRAGYDHAKLPTGEQLGRLPYYGQWLQDAVV
GSGDARDQKEKQYGQFPNPTVHIGLGQLRRVVNDLIDKYGPPTEISIEFT
RALKLSEQQKAERQREQRRNQDKNKARAEELAKFGRPANPRNLLKMRLWE
ELAHDPLDRKCVYTGEQISIERLLSDEVDIDHILPVAMTLDDSPANKIIC
MRYANRHKRKQTPSEAFGSSPTLQGHRYNWDDIAARATGLPRNKRWRFDA
NAREEFDKRGGFLARQLNETGWLARLAKQYLGAVTDPNQIWVVPGRLTSM
LRGKWGLNGLLPSDNYAGVQDKAEEFLASTDDMEFSGVKNRADHRHHAID
GLVTALTDRSLLWKMANAYDEEHEKFVIEPPWPTMRDDLKAALEKMVVSH
KPDHGIEGKLHEDSAYGFVKPLDATGLKEEEAGNLVYRKAIESLNENEVD
RIRDIQLRTIVRDHVNVEKTKGVALADALRQLQAPSDDYPQFKHGLRHVR
ILKKEKGDYLVPIANRASGVAYKAYSAGENFCVEVFETAGGKWDGEAVRR

-continued

FDANKKNAGPKIAHAPQWRDANEGAKLVMRIHKGDLIRLDHEGRARIMVV
HRLDAAAGRFKLADHNETGNLDKRHATNNDIDPFRWLMASYNTLKKLAAV
PVRVDELGRVWRVMPN

SEQ ID NO: 335

METTLGIDLGTNSIGLALVDQEEHQILYSGVRIFPEGINKDTIGLGEKEE
SRNATRRAKRQMRRQYFRKKLRKAKLLELLIAYDMCPLKPEDVRRWKNWD
KQQKSTVRQFPDTPAFREWLKQNPYELRKQAVTEDVTRPELGRILYQMIQ
RRGFLSSRKGKEEGKIFTGKDRMVGIDETRKNLQKQTLGAYLYDIAPKNG
EKYRFRTERVRARYTLRDMYIREFEIIWQRQAGHLGLAHEQATRKKNIFL
EGSATNVRNSKLITHLQAKYGRGHVLIEDTRITVTFQLPLKEVLGGKIEI
EEEQLKFKSNESVLFWQRPLRSQKSLLSKCVFEGRNFYDPVHQKWIIAGP
TPAPLSHPEFEEFRAYQFINNIIYGKNEHLTAIQREAVFELMCTESKDFN
FEKIPKHLKLFEKFNFDDTTKVPACTTISQLRKLFPHPVWEEKREEIWHC
FYFYDDNTLLFEKLQKDYALQTNDLEKIKKIRLSESYGNVSLKAIRRINP
YLKKGYAYSTAVLLGGIRNSFGKRFEYFKEYEPEIEKAVCRILKEKNAEG
EVIRKIKDYLVHNRFGFAKNDRAFQKLYHHSQAITTQAQKERLPETGNLR
NPIVQQGLNELRRTVNKLLATCREKYGPSFKFDHIHVEMGRELRSSKTER
EKQSRQIRENEKKNEAAKVKLAEYGLKAYRDNIQKYLLYKEIEEKGGTVC
CPYTGKTLNISHTLGSDNSVQIEHIIPYSISLDDSLANKTLCDATFNREK
GELTPYDFYQKDPSPEKWGASSWEEIEDRAFRLLPYAKAQRFIRRKPQES
NEFISRQLNDTRYISKKAVEYLSAICSDVKAFPGQLTAELRHLWGLNNIL
QSAPDITFPLPVSATENHREYYVITNEQNEVIRLFPKQGETPRTEKGELL
LTGEVERKVFRCKGMQEFQTDVSDGKYWRRIKLSSSVTWSPLFAPKPISA
DGQIVLKGRIEKGVFVCNQLKQKLKTGLPDGSYWISLPVISQTFKEGESV
NNSKLTSQQVQLFGRVREGIFRCHNYQCPASGADGNFWCTLDTDTAQPAF
TPIKNAPPGVGGGQIILTGDVDDKGIFHADDDLHYELPASLPKGKYYGIF
TVESCDPTLIPIELSAPKTSKGENLIEGNIWVDEHTGEVRFDPKKNREDQ
RHHAIDAIVIALSSQSLFQRLSTYNARRENKKRGLDSTEHFPSPWPGFAQ
DVRQSVVPLLVSYKQNPKTLCKISKTLYKDGKKIHSCGNAVRGQLHKETV
YGQRTAPGATEKSYHIRKDIRELKTSKHIGKVVDITIRQMLLKHLQENYH
IDITQEFNIPSNAFFKEGVYRIFLPNKHGEPVPIKKIRMKEELGNAERLK
DNINQYVNPRNNHHVMIYQDADGNLKEEIVSFWSVIERQNQGQPIYQLPR
EGRNIVSILQINDTFLIGLKEEEPEVYRNDLSTLSKHLYRVQKLSGMYYT
FRHHLASTLNNEREEFRIQSLEAWKRANPVKVQIDEIGRITFLNGPLC

SEQ ID NO: 336

MESSQILSPIGIDLGGKFTGVCLSHLEAFAELPNHANTKYSVILIDHNNF
QLSQAQRRATRHRVRNKKRNQFVKRVALQLFQHILSRDLNAKEETALCHY
LNNRGYTYVDTDLDEYIKDETTINLLKELLPSESEHNFIDWFLQKMQSSE
FRKILVSKVEEKKDDKELKNAVKNIKNFITGFEKNSVEGHRHRKVYFENI
KSDITKDNQLDSIKKKIPSVCLSNLLGHLSNLQWKNLHRYLAKNPKQFDE
QTFGNEFLRMLKNFRHLKGSQESLAVRNLIQQLEQSQDYISILEKTPPEI
TIPPYEARTNTGMEKDQSLLLNPEKLNNLYPNWRNLIPGIIDAHPFLEKD
LEHTKLRDRKRIISPSKQDEKRDSYILQRYLDLNKKIDKFKIKKQLSFLG
QGKQLPANLIETQKEMETHFNSSLVSVLIQIASAYNKEREDAAQGIWFDN
AFSLCELSNINPPRKQKILPLLVGAILSEDFINNKDKWAKFKIFWNTHKI
GRTSLKSKCKEIEEARKNSGNAFKIDYEEALNHPEHSNNKALIKIIQTIP
DIIQAIQSHLGHNDSQALIYHNPFSLSQLYTILETKRDGFHKNCVAVTCE
NYWRSQKTEIDPEISYASRLPADSVRPFDGVLARMMQRLAYEIAMAKWEQ
IKHIPDNSSLLIPIYLEQNRFEFEESFKKIKGSSSDKTLEQAIEKQNIQW
EEKFQRIINASMNICPYKGASIGGQGEIDHIYPRSLSKKHFGVIFNSEVN
LIYCSSQGNREKKEEHYLLEHLSPLYLKHQFGTDNVSDIKNFISQNVANI
KKYISFHLLTPEQQKAARHALFLDYDDEAFKTITKFLMSQQKARVNGTQK
FLGKQIMEFLSTLADSKQLQLEFSIKQITAEEVHDHRELLSKQEPKLVKS
RQQSFPSHAIDATLTMSIGLKEFPQFSQELDNSWFINHLMPDEVHLNPVR
SKEKYNKPNISSTPLFKDSLYAERFIPVWVKGETFAIGFSEKDLFEIKPS
NKEKLFTLLKTYSTKNPGESLQELQAKSKAKWLYFPINKTLALEFLHHYF
HKEIVTPDDTTVCHFINSLRYYTKKESITVKILKEPMPVLSVKFESSKKN
VLGSFKHTIALPATKDWERLFNHPNFLALKANPAPNPKEFNEFIRKYFLS
DNNPNSDIPNNGHNIKPQKHKAVRKVFSLPVIPGNAGTMMRIRRKDNKGQ
PLYQLQTIDDTPSMGIQINEDRLVKQEVLMDAYKTRNLSTIDGINNSEGQ
AYATFDNWLTLPVSTFKPEIIKLEMKPHSKTRRYIRITQSLADFIKTIDE
ALMIKPSDSIDDPLNMPNEIVCKNKLFGNELKPRDGKMKIVSTGKIVTYE
FESDSTPQWIQTLYVTQLKKQP

SEQ ID NO: 337

MKKIVGLDLGTNSIGWALINAYINKEHLYGIEACGSRIIPMDAAILGNFD
KGNSISQTADRTSYRGIRRLRERHLLRRERLHRILDLLGFLPKHYSDSLN
RYGKFLNDIECKLPWVKDETGSYKFIFQESFKEMLANFTEHHPILIANNK
KVPYDWTIYYLRKKALTQKISKEELAWILLNFNQKRGYYQLRGEEEETPN
KLVEYYSLKVEKVEDSGERKGKDTWYNVHLENGMIYRRTSNIPLDWEGKT
KEFIVTTDLEADGSPKKDKEGNIKRSFRAPKDDDWTLIKKKTEADIDKIK
MTVGAYIYDTLLQKPDQKIRGKLVRTIERKYYKNELYQILKTQSEFHEEL
RDKQLYIACLNELYPNNEPRRNSISTRDFCHLFIEDIIFYQRPLKSKKSL
IDNCPYEENRYIDKESGEIKHASIKCIAKSHPLYQEFRLWQFIVNLRIYR
KETDVDVTQELLPTEADYVTLFEWLNEKKEIDQKAFFKYPPFGFKKTTSN
YRWNYVEDKPYPCNETHAQIIARLGKAHIPKAFLSKEKEETLWHILYSIE
DKQEIEKALHSFANKNNLSEEFIEQFKNFPPFKKEYGSYSAKAIKKLLPL
MRMGKYWSIENIDNGTRIRINKIIDGEYDENIRERVRQKAINLTDITHFR
ALPLWLACYLVYDRHSEVKDIVKWKTPKDIDLYLKSFKQHSLRNPIVEQV
ITETLRTVRDIWQQVGHIDEIHIELGREMKNPADKRARMSQQMIKNENTN
LRIKALLTEFLNPEFGIENVRPYSPSQQDLLRIYEEGVLNSILELPEDIG
IILGKFNQTDTLKRPTRSEILRYKLWLEQKYRSPYTGEMIPLSKLFTPAY
EIEHIIPQSRYFDDSLSNKVICESEINKLKDRSLGYEFIKNHHGEKVELA
FDKPVEVLSVEAYEKLVHESYSHNRSKMKKLLMEDIPDQFIERQLNDSRY

-continued

ISKVVKSLLSNIVREENEQEAISKNVIPCTGGITDRLKKDWGINDVWNKI

VLPRFIRLNELTESTRFTSINTNNTMIPSMPLELQKGFNKKRIDHRHHAM

DAIIIACANRNIVNYLNNVSASKNTKITRRDLQTLLCHKDKTDNNGNYKW

VIDKPWETFTQDTLTALQKITVSFKQNLRVINKTTNHYQHYENGKKIVSN

QSKGDSWAIRKSMHKETVHGEVNLRMIKTVSFNEALKKPQAIVEMDLKKK

ILAMLELGYDTKRIKNYFEENKDTWQDINPSKIKVYYFTKETKDRYFAVR

KPIDTSFDKKIKESITDTGIQQIMLRHLETKDNDPTLAFSPDGIDEMNR

NILILNKGKKHQPIYKVRVYEKAEKFTVGQKGNKRTKFVEAAKGTNLFFA

IYETEEIDKDTKKVIRKRSYSTIPLNVVIERQKQGLSSAPEDENGNLPKY

ILSPNDLVYVPTQEEINKGEVVMPIDRDRIYKMVDSSGITANFIPASTAN

LIFALPKATAEIYCNGENCIQNEYGIGSPQSKNQKAITGEMVKEICFPIK

VDRLGNIIQVGSCILTN

SEQ ID NO: 338

MSRSLTFSFDIGYASIGWAVIASASHDDADPSVCGCGTVLFPKDDCQAFK

RREYRRLRRNIRSRRVRIERIGRLLVQAQIITPEMKETSGHPAPFYLASE

ALKGHRTLAPIELWHVLRWYAHNRGYDNNASWSNSLSEDGGNGEDTERVK

HAQDLMDKHGTATMAETICRELKLEEGKADAPMEVSTPAYKNLNTAFPRL

IVEKEVRRILELSAPLIPGLTAEIIELIAQHHPLTTEQRGVLLQHGIKLA

RRYRGSLLFGQLIPRFDNRIISRCPVTWAQVYEAELKKGNSEQSARERAE

KLSKVPTANCPEFYEYRMARILCNIRADGEPLSAEIRRELMNQARQEGKL

TKASLEKAISSRLGKETETNVSNYFTLHPDSEEALYLNPAVEVLQRSGIG

QILSPSVYRIAANRLRRGKSVTPNYLLNLLKSRGESGEALEKKIEKESKK

KEADYADTPLKPKYATGRAPYARTVLKKVVEEILDGEDPTRPARGEAHPD

GELKAHDGCLYCLLDTDSSVNQHQKERRLDTMTNNHLVRHRMLILDRLLK

DLIQDFADGQKDRISRVCVEVGKELTTFSAMDSKKIQRELTLRQKSHTDA

VNRLKRKLPGKALSANLIRKCRIAMDMNWTCPFTGATYGDHELENLELEH

IVPHSFRQSNALSSLVLTWPGVNRMKGQRTGYDFVEQEQENPVPDKPNLH

ICSLNNYRELVEKLDDKKGHEDDRRRKKKRKALLMVRGLSHKHQSQNHEA

MKEIGMTEGMMTQSSHLMKLACKSIKTSLPDAHIDMIPGAVTAEVRKAWD

VFGVFKELCPEAADPDSGKILKENLRSLTHLHHALDACVLGLIPYIIPAH

HNGLLRRVLAMRRIPEKLIPQVRPVANQRHYVLNDDGRMMLRDLSASLKE

NIREQLMEQRVIQHVPADMGGALLKETMQRVLSVDGSGEDAMVSLSKKKD

GKKEKNQVKASKLVGVFPEGPSKLKALKAAIEIDGNYGVALDPKPVVIRH

IKVFKRIMALKEQNGGKPVRILKKGMLIHLTSSKDPKHAGVWRIESIQDS

KGGVKLDLQRAHCAVPKNKTHECNWREVDLISLLKKYQMKRYPTSYTGTP

R

SEQ ID NO: 339

MTQKVLGLDLGTNSIGSAVRNLDLSDDLQWQLEFFSSDIFRSSVNKESNG

REYSLAAQRSAHRRSRGLNEVRRRRLWATLNLLIKHGFCPMSSESLMRWC

TYDKRKGLFREYPIDDKDFNAWILLDFNGDGRPDYSSPYQLRRELVTRQF

DFEQPIERYKLGRALYHIAQHRGFKSSKGETLSQQETNSKPSSTDEIPDV

-continued

AGAMKASEEKLSKGLSTYMKEHNLLTVGAAFAQLEDEGVRVRNNNDYRAI

RSQFQHEIETIFKFQQGLSVESELYERLISEKKNVGTIFYKRPLRSQRGN

VGKCTLERSKPRCAIGHPLFEKFRAWTLINNIKVRMSVDTLDEQLPMKLR

LDLYNECFLAFVRTEFKFEDIRKYLEKRLGIHFSYNDKTINYKDSTSVAG

CPITARFRKMLGEEWESFRVEGQKERQAHSKNNISFHRVSYSIEDIWHFC

YDAEEPEAVLAFAQETLRLERKKAEELVRIWSAMPQGYAMLSQKAIRNIN

KILMLGLKYSDAVILAKVPELVDVSDEELLSIAKDYYLVEAQVNYDKRIN

SIVNGLIAKYKSVSEEYRFADHNYEYLLDESDEKDIIRQIENSLGARRWS

LMDANEQTDILQKVRDRYQDFFRSHERKFVESPKLGESFENYLTKKFPMV

EREQWKKLYHPSQITIYRPVSVGKDRSVLRLGNPDIGAIKNPTVLRVLNT

LRRRVNQLLDDGVISPDETRVVVETARELNDANRKWALDTYNRIRHDENE

KIKKILEEFYPKRDGISTDDIDKARYVIDQREVDYFTGSKTYNKDIKKYK

FWLEQGGQCMYTGRTINLSNLFDPNAFDIEHTIPESLSFDSSDMNLTLCD

AHYNRFIKKNHIPTDMPNYDKAITIDGKEYPAITSQLQRWVERVERLNRN

VEYWKGQARRAQNKDRKDQCMREMHLWKMELEYWKKKLERFTVTEVTDGF

KNSQLVDTRVITRHAVLYLKSIFPHVDVQRGDVTAKFRKILGIQSVDEKK

DRSLHSHHAIDATTLTIIPVSAKRDRMLELFAKIEEINKMLSFSGSEDRT

GLIQELEGLKNKLQMEVKVCRIGHNVSEIGTFINDNIIVNHHIKNQALTP

VRRRLRKKGYIVGGVDNPRWQTGDALRGEIHKASYYGAITQFAKDDEGKV

LMKEGRPQVNPTIKFVIRRELKYKKSAADSGFASWDDLGKAIVDKELFAL

MKGQFPAETSFKDACEQGIYMIKKGKNGMPDIKLHHIRHVRCEAPQSGLK

IKEQTYKSEKEYKRYFYAAVGDLYAMCCYTNGKIREFRIYSLYDVSCHRK

SDIEDIPEFITDKKGNRLMLDYKLRTGDMILLYKDNPAELYDLDNVNLSR

RLYKINRFESQSNLVLMTHHLSTSKERGRSLGKTVDYQNLPESIRSSVKS

LNFLIMGENRDFVIKNGKIIFNHR

SEQ ID NO: 340

MLVSPISVDLGGKNTGFFSFTDSLDNSQSGTVIYDESFVLSQVGRRSKRH

SKRNNLRNKLVKRLFLLILQEHHGLSIDVLPDEIRGLFNKRGYTYAGFEL

DEKKKDALESDTLKEFLSEKLQSIDRDSDVEDFLNQIASNAESFKDYKKG

FEAVFASATHSPNKKLELKDELKSEYGENAKELLAGLRVTKEILDEFDKQ

ENQGNLPRAKYFEELGEYIATNEKVKSFFDSNSLKLTDMTKLIGNISNYQ

LKELRRYFNDKEMEKGDIWIPNKLHKITERFVRSWHPKNDADRQRRAELM

KDLKSKEIMELLTTTEPVMTIPPYDDMNNRGAVKCQTLRLNEEYLDKHLP

NWRDIAKRLNHGKFNDDLADSTVKGYSEDSTLLHRLLDTSKEIDIYELRG

KKPNELLVKTLGQSDANRLYGFAQNYYELIRQKVRAGIWVPVKNKDDSLN

LEDNSNMLKRCNHNPPHKKNQIHNLVAGILGVKLDEAKFAEFEKELWSAK

VGNKKLSAYCKNIEELRKTHGNTFKIDIEELRKKDPAELSKEEKAKLRLT

DDVILNEWSQKIANFFDIDDKHRQRFNNLFSMAQLHTVIDTPRSGFSSTC

KRCTAENRFRSETAFYNDETGEFHKKATATCQRLPADTQRPFSGKIERYI

DKLGYELAKIKAKELEGMEAKEIKVPIILEQNAFEYEESLRKSKTGSNDR

VINSKKDRDGKKLAKAKENAEDRLKDKDKRIKAFSSGICPYCGDTIGDDG

-continued

EIDHILPRSHTLKIYGTVFNPEGNLIYVHQKCNQAKADSIYKLSDIKAGV

SAQWIEEQVANIKGYKTFSVLSAEQQKAFRYALFLQNDNEAYKKVVDWLR

TDQSARVNGTQKYLAKKIQEKLTKMLPNKHLSFEFILADATEVSELRRQY

ARQNPLLAKAEKQAPSSHAIDAVMAFVARYQKVFKDGTPPNADEVAKLAM

LDSWNPASNEPLTKGLSTNQKIEKMIKSGDYGQKNMREVFGKSIFGENAI

GERYKPIVVQEGGYYIGYPATVKKGYELKNCKVVTSKNDIAKLEKIIKNQ

DLISLKENQYIKIFSINKQTISELSNRYFNMNYKNLVERDKEIVGLLEFI

VENCRYYTKKVDVKFAPKYIHETKYPFYDDWRRFDEAWRYLQENQNKTSS

KDRFVIDKSSLNEYYQPDKNEYKLDVDTQPIWDDFCRWYFLDRYKTANDK

KSIRIKARKTFSLLAESGVQGKVFRAKRKIPTGYAYQALPMDNNVIAGDY

ANILLEANSKTLSLVPKSGISIEKQLDKKLDVIKKTDVRGLAIDNNSFFN

ADFDTHGIRLIVENTSVKVGNFPISAIDKSAKRMIFRALFEKEKGKRKKK

TTISFKESGPVQDYLKVFLKKIVKIQLRTDGSISNIVVRKNAADFTLSFR

SEHIQKLLK

SEQ ID NO: 341

MAYRLGLDIGITSVGWAVVALEKDESGLKPVRIQDLGVRIFDKAEDSKTG

ASLALPRREARSARRRTRRRRHRLWRVKRLLEQHGILSMEQIEALYAQRT

SSPDVYALRVAGLDRCLIAEEIARVLIHIAHRRGFQSNRKSEIKDSDAGK

LLKAVQENENLMQSKGYRTVAEMLVSEATKTDAEGKLVHGKKHGYVSNVR

NKAGEYRHTVSRQAIVDEVRKIFAAQRALGNDVMSEELEDSYLKILCSQR

NFDDGPGGDSPYGHGSVSPDGVRQSIYERMVGSCTFETGEKRAPRSSYSF

ERFQLLTKVVNLRIYRQQEDGGRYPCELTQTERARVIDCAYEQTKITYGK

LRKLLDMKDTESFAGLTYGLNRSRNKTEDTVFVEMKFYHEVRKALQRAGV

FIQDLSIETLDQIGWILSVWKSDDNRRKKLSTLGLSDNVIEELLPLNGSK

FGHLSLKAIRKILPFLEDGYSYDVACELAGYQFQGKTEYVKQRLLPPLGE

GEVTNPVVRRALSQAIKVVNAVIRKHGSPESIHIELARELSKNLDERRKI

EKAQKENQKNNEQIKDEIREILGSAHVTGRDIVKYKLFKQQQEFCMYSGE

KLDVTRLFEPGYAEVDHIIPYGISFDDSYDNKVLVKTEQNRQKGNRTPLE

YLRDKPEQKAKFIALVESIPLSQKKKNHLLMDKRAIDLEQEGFRERNLSD

TRYITRALMNHIQAWLLFDETASTRSKRVVCVNGAVTAYMRARWGLTKDR

DAGDKHHAADAVVVACIGDSLIQRVTKYDKFKRNALADRNRYVQQVSKSE

GITQYVDKETGEVFTWESFDERKFLPNEPLEPWPFFRDELLARLSDDPSK

NIRAIGLLTYSETEQIDPIFVSRMPTRKVTGAAHKETIRSPRIVKVDDNK

GTEIQVVVSKVALTELKLTKDGEIKDYFRPEDDPRLYNTLRERLVQFGGD

AKAAFKEPVYKISKDGSVRTPVRKVKIQEKLTLGVPVHGGRGIAENGGMV

RIDVFAKGGKYYFVPIYVADVLKRELPNRLATAHKPYSEWRVVDDSYQFK

FSLYPNDAVMIKPSREVDITYKDRKEPVGCRIMYFVSANIASASISLRTH

DNSGELEGLGIQGLEVFEKYVVGPLGDTHPVYKERRMPFRVERKMN

SEQ ID NO: 342

MPVLSPLSPNAAQGRRRWSLALDIGEGSIGWAVAEVDAEGRVLQLTGTGV

TLFPSAWSNENGTYVAHGAADRAVRGQQQRHDSRRRRLAGLARLCAPVLE

RSPEDLKDLTRTPPKADPRAIFFLRADAARRPLDGPELFRVLHHMAAHRG

-continued

IRLAELQEVDPPPESDADDAAPAATEDEDGTRRAAADERAFRRLMAEHMH

RHGTQPTCGEIMAGRLRETPAGAQPVTRARDGLRVGGGVAVPTRALIEQE

FDAIRAIQAPRHPDLPWDSLRRLVLDQAPIAVPPATPCLFLEELRRRGET

FQGRTITREAIDRGLTVDPLIQALRIRETVGNLRLHERITEPDGRQRYVP

RAMPELGLSHGELTAPERDTLVRALMHDPDGLAAKDGRIPYTRLRKLIGY

DNSPVCFAQERDTSGGGITVNPTDPLMARWIDGWVDLPLKARSLYVRDVV

ARGADSAALARLLAEGAHGVPPVAAAAVPAATAAILESDIMQPGRYSVCP

WAAEAILDAWANAPTEGFYDVTRGLFGFAPGEIVLEDLRRARGALLAHLP

RTMAAARTPNRAAQQRGPLPAYESVIPSQLITSLRRAHKGRAADWSAADP

EERNPFLRTWTGNAATDHILNQVRKTANEVITKYGNRRGWDPLPSRITVE

LAREAKHGVIRRNEIAKENRENEGRRKKESAALDTFCQDNTVSWQAGGLP

KERAALRLRLAQRQEFFCPYCAERPKLRATDLFSPAETEIDHVIERRMGG

DGPDNLVLAHKDCNNAKGKKTPHEHAGDLLDSPALAALWQGWRKENADRL

KGKGHKARTPREDKDFMDRVGWRFEEDARAKAEENQERRGRRMLHDTARA

TRLARLYLAAAVMPEDPAEIGAPPVETPPSPEDPTGYTAIYRTISRVQPV

NGSVTHMLRQRLLQRDKNRDYQTHHAEDACLLLLAGPAVVQAFNTEAAQH

GADAPDDRPVDLMPTSDAYHQQRRARALGRVPLATVDAALADIVMPESDR

QDPETGRVHWRLTRAGRGLKRRIDDLTRNCVILSRPRRPSETGTPGALHN

ATHYGRREITVDGRTDTVVTQRMNARDLVALLDNAKIVPAARLDAAAPGD

TILKEICTEIADRHDRVVDPEGTHARRWISARLAALVPAHAEAVARDIAE

LADLDALADADRTPEQEARRSALRQSPYLGRAISAKKADGRARAREQEIL

TRALLDPHWGPRGLRHLIMREARAPSLVRIRANKTDAFGRPVPDAAVWVK

TDGNAVSQLWRLTSVVTDDGRRIPLPKPIEKRIEISNLEYARLNGLDEGA

GVTGNNAPPRPLRQDIDRLTPLWRDHGTAPGGYLGTAVGELEDKARSALR

GKAMRQTLTDAGITAEAGWRLDSEGAVCDLEVAKGDTVKKDGKTYKVGVI

TQGIFGMPVDAAGSAPRTPEDCEKFEEQYGIKPWKAKGIPLA

SEQ ID NO: 343

MNYTEKEKLFMKYILALDIGIASVGWAILDKESETVIEAGSNIFPEASAA

DNQLRRDMRGAKRNNRRLKTRINDFIKLWENNNLSIPQFKSTEIVGLKVR

AITEEITLDELYLILYSYLKHRGISYLEDALDDTVSGSSAYANGLKLNAK

ELETHYPCEIQQERLNTIGKYRGQSQIINENGEVLDLSNVFTIGAYRKEI

QRVFEIQKKYHPELTDEFCDGYMLIFNRKRKYYEGPGNEKSRTDYGRFTT

KLDANGNYITEDNIFEKLIGKCSVYPDELRAAAASYTAQEYNVLNDLNNL

TINGRKLEENEKHEIVERIKSSNTINMRKIISDCMGENIDDFAGARIDKS

GKEIFHKFEVYNKMRKALLEIGIDISNYSREELDEIGYIMTINTDKEAMM

EAFQKSWIDLSDDVKQCLINMRKTNGALFNKWQSFSLKIMNELIPEMYAQ

PKEQMTLLTEMGVTKGTQEEFAGLKYIPVDVVSEDIFNPVVRRSVRISFK

ILNAVLKKYKALDTIVIEMPRDRNSEEQKKRINDSQKLNEKEMEYIEKKL

AVTYGIKLSPSDFSSQKQLSLKLKLWNEQDGICLYSGKTIDPNDIINNPQ

LFEIDHIIPRSISFDDARSNKVLVYRSENQKKGNQTPYYYLTHSHSEWSF

EQYKATVMNLSKKKEYAISRKKIQNLLYSEDITKMDVLKGFINRNINDTS

-continued

YASRLVLNTIQNFFMANEADTKVKVIKGSYTHQMRCNLKLDKNRDESYSH
HAVDAMLIGYSELGYEAYHKLQGEFIDFETGEILRKDMWDENMSDEVYAD
YLYGKKWANIRNEVVKAEKNVKYWHYVMRKSNRGLCNQTIRGTREYDGKQ
YKINKLDIRTKEGIKVFAKLAFSKKDSDRERLLVYLNDRRTFDDLCKIYE
DYSDAANPFVQYEKETGDIIRKYSKKHNGPRIDKLKYKDGEVGACIDISH
KYGFEKGSKKVILESLVPYRMDVYYKEENHSYYLVGVKQSDIKFEKGRNV
IDEEAYARILVNEKMIQPGQSRADLENLGFKFKLSFYKNDIIEYEKDGKI
YTERLVSRTMPKQRNYIETKPIDKAKFEKQNLVGLGKTKFIKKYRYDILG
NKYSCSEEKFTSFC

SEQ ID NO: 344

MLRLYCANNLVLNNVQNLWKYLLLLIFDKKIIFLFKIKVILIRRYMENNN
KEKIVIGFDLGVASVGWSIVNAETKEVIDLGVRLFSEPEKADYRRAKRTT
RRLLRRKKFKREKFHKLILKNAEIFGLQSRNEILNVYKDQSSKYRNILKL
KINALKEEIKPSELVWILRDYLQNRGYFYKNEKLTDEFVSNSFPSKKLHE
HYEKYGFFRGSVKLDNKLDNKKDKAKEKDEEEESDAKKESEELIFSNKQW
INEIVKVFENQSYLTESFKEEYLKLFNYVRPFNKGPGSKNSRTAYGVFST
DIDPETNKFKDYSNIWDKTIGKCSLFEEEIRAPKNLPSALIFNLQNEICT
IKNEFTEFKNWWLNAEQKSEILKFVFTELFNWKDKKYSDKKFNKNLQDKI
KKYLLNFALENFNLNEEILKNRDLENDTVLGLKGVKYYEKSNATADAALE
FSSLKPLYVFIKFLKEKKLDLNYLLGLENTEILYFLDSIYLAISYSSDLK
ERNEWFKKLLKELYPKIKNNNLEIIENVEDIFEITDQEKFESFSKTHSLS
REAFNHIIPLLLSNNEGKNYESLKHSNEELKKRTEKAELKAQQNQKYLKD
NFLKEALVPLSVKTSVLQAIKIFNQIIKNFGKKYEISQVVIEMARELTKP
NLEKLLNNATNSNIKILKEKLDQTEKFDDFTKKKFIDKIENSVVFRNKLF
LWFEQDRKDPYTQLDIKINEIEDETEIDHVIPYSKSADDSWFNKLLVKKS
TNQLKKNKTVWEYYQNESDPEAKWNKFVAWAKRIYLVQKSDKESKDNSEK
NSIFKNKKPNLKFKNITKKLFDPYKDLGFLARNLNDTRYATKVFRDQLNN
YSKHHSKDDENKLFKVVCMNGSITSFLRKSMWRKNEEQVYRFNFWKKDRD
QFFHHAVDASIIAIFSLLTKTLYNKLRVYESYDVQRREDGVYLINKETGE
VKKADKDYWKDQHNFLKIRENAIEIKNVLNNVDFQNQVRYSRKANTKLNT
QLFNETLYGVKEFENNFYKLEKVNLFSRKDLRKFILEDLNEESEKNKKNE
NGSRKRILTEKYIVDEILQILENEEFKDSKSDINALNKYMDSLPSKFSEF
FSQDFINKCKKENSLILTFDAIKHNDPKKVIKIKNLKFFREDATLKNKQA
VHKDSKNQIKSFYESYKCVGFIWLKNKNDLEESIFVPINSRVIHFGDKDK
DIFDFDSYNKEKLLNEINLKRPENKKFNSINEIEFVKFVKPGALLLNFEN
QQIYYISTLESSSLRAKIKLLNKMDKGKAVSMKKITNPDEYKIIEHVNPL
GINLNWTKKLENNN

SEQ ID NO: 345

MLMSKHVLGLDLGVGSIGWCLIALDAQGDPAEILGMGSRVVPLNNATKAI
EAFNAGAAFTASQERTARRTMRRGFARYQLRRYRLRRELEKVGMLPDAAL
IQLPLLELWELRERAATAGRRLTLPELGRVLCHINQKRGYRHVKSDAAAI

-continued

VGDEGEKKKDSNSAYLAGIRANDEKLQAEHKTVGQYFAEQLRQNQSESPT
GGISYRIKDQIFSRQCYIDEYDQIMAVQRVHYPDILTDEFIRMLRDEVIF
MQRPLKSCKHLVSLCEFEKQERVMRVQQDDGKGGWQLVERRVKFGPKVAP
KSSPLFQLCCIYEAVNNIRLTRPNGSPCDITPEERAKIVAHLQSSASLSF
AALKKLLKEKALIADQLTSKSGLKGNSTRVALASALQPYPQYHHLLDMEL
ETRMMTVQLTDEETGEVTEREVAVVTDSYVRKPLYRLWHILYSIEEREAM
RRALITQLGMKEEDLDGGLLDQLYRLDFVKPGYGNKSAKFICKLLPQLQQ
GLGYSEACAAVGYRHSNSPTSEEITERTLLEKIPLLQRNELRQPLVEKIL
NQMINLVNALKAEYGIDEVRVELARELKMSREERERMARNNKDREERNKG
VAAKIRECGLYPTKPRIQKYMLWKEAGRQCLYCGRSIEEEQCLREGGMEV
EHIIPKSVLYDDSYGNKTCACRRCNKEKGNRTALEYIRAKGREAEYMKRI
NDLLKEKKISYSKHQRLRWLKEDIPSDFLERQLRLTQYISRQAMAILQQG
IRRVSASEGGVTARLRSLWGYGKILHTLNLDRYDSMGETERVSREGEATE
ELHITNWSKRMDHRHHAIDALVVACTRQSYIQRLNRLSSEFGREDKKKED
QEAQEQQATETGRLSNLERWLTQRPHFSVRTVSDKVAEILISYRPGQRVV
TRGRNIYRKKMADGREVSCVQRGVLVPRGELMEASFYGKILSQGRVRIVK
RYPLHDLKGEVVDPHLRELITTYNQELKSREKGAPIPPLCLDKDKKQEVR
SVRCYAKTLSLDKAIPMCFDEKGEPTAFVKSASNHHLALYRTPKGKLVES
IVTFWDAVDRARYGIPLVITHPREVMEQVLQRGDIPEQVLSLLPPSDWVF
VDSLQQDEMVVIGLSDEELQRALEAQNYRKISEHLYRVQKMSSSYYVFRY
HLETSVADDKNTSGRIPKFHRVQSLKAYEERNIRKVRVDLLGRISLL

SEQ ID NO: 346

MSDLVLGLDIGIGSVGVGILNKVTGEIIHKNSRIFPAAQAENNLVRRTNR
QGRRLARRKKHRRVRLNRLFEESGLITDFTKISINLNPYQLRVKGLTDEL
SNEELFIALKNMVKHRGISYLDDASDDGNSSVGDYAQIVKENSKQLETKT
PGQIQLERYQTYGQLRGDFTVEKDGKKHRLINVFPTSAYRSEALRILQTQ
QEFNPQITDEFINRYLEILTGKRKYYHGPGNEKSRTDYGRYRTSGETLDN
IFGILIGKCTFYPDEFRAAKASYTAQEFNLLNDLNNLTVPTETKKLSKEQ
KNQIINYVKNEKAMGPAKLFKYIAKLLSCDVADIKGYRIDKSGKAEIHTF
EAYRKMKTLETLDIEQMDRETLDKLAYVLTLNTEREGIQEALEHEFADGS
FSQKQVDELVQFRKANSSIFGKGWHNFSVKLMMELIPELYETSEEQMTIL
TRLGKQKTTSSSNKTKYIDEKLLTEEIYNPVVAKSVRQAIKIVNAAIKEY
GDFDNIVIEMARETNEDDEKKAIQKIQKANKDEKDAAMLKAANQYNGKAE
LPHSVFHGHKQLATKIRLWHQQGERCLYTGKTISIHDLINNSNQFEVDHI
LPLSITFDDSLANKVLVYATANQEKGQRTPYQALDSMDDAWSFRELKAFV
RESKTLSNKKKEYLLTEEDISKFDVRKKFIERNLVDTRYASRVVLNALQE
HFRAHKIDTKVSVVRGQFTSQLRRHWGIEKTRDTYHHHAVDALIIAASSQ
LNLWKKQKNTLVSYSEDQLLDIETGELISDDEYKESVFKAPYQHFVDTLK
SKEFEDSILFSYQVDSKFNRKISDATIYATRQAKVGKDKADETYVLGKIK
DIYTQDGYDAFMKIYKKDKSKFLMYRHDPQTFEKVIEPILENYPNKQINE
KGKEVPCNPFLKYKEEHGYIRKYSKKGNGPEIKSLKYYDSKLGNHIDITP

-continued

KDSNNKVVLQSVSPWRADVYFNKTTGKYEILGLKYADLQFEKGTGTYKIS

QEKYNDIKKKEGVDSDSEFKFTLYKNDLLLVKDTETKEQQLFRFLSRTMP

KQKHYVELKPYDKQKFEGGEALIKVLGNVANSGQCKKGLGKSNISIYKVR

TDVLGNQHIIKNEGDKPKLDF

SEQ ID NO: 347

MNAEHGKEGLLIMEENFQYRIGLDIGITSVGWAVLQNNSQDEPVRITDLG

VRIFDVAENPKNGDALAAPRRDARTTRRRLRRRRHRLERIKFLLQENGLI

EMDSFMERYYKGNLPDVYQLRYEGLDRKLKDEELAQVLIHIAKHRGFRST

RKAETKEKEGGAVLKATTENQKIMQEKGYRTVGEMLYLDEAFHTECLWNE

KGYVLTPRNRPDDYKHTILRSMLVEEVHAIFAAQRAHGNQKATEGLEEAY

VEIMTSQRSFDMGPGLQPDGKPSPYAMEGFGDRVGKCTFEKDEYRAPKAT

YTAELFVALQKINHTKLIDEFGTGRFFSEEERKTIIGLLLSSKELKYGTI

RKKLNIDPSLKFNSLNYSAKKEGETEEERVLDTEKAKFASMFWTYEYSKC

LKDRTEEMPVGEKADLFDRIGEILTAYKNDDSRSSRLKELGLSGEEIDGL

LDLSPAKYQRVSLKAMRKMQPYLEDGLIYDKACEAAGYDFRALNDGNKKH

LLKGEEINAIVNDITNPVVKRSVSQTIKVINAIIQKYGSPQAVNIELARE

MSKNFQDRTNLEKEMKKRQQENERAKQQIIELGKQNPTGQDILKYRLWND

QGGYCLYSGKKIPLEELFDGGYDIDHILPYSITFDDSYRNKVLVTAQENR

QKGNRTPYEYFGADEKRWEDYEASVRLLVRDYKKQQKLLKKNFTEEERKE

FKERNLNDTKYITRVVYNMIRQNLELEPFNHPEKKKQVWAVNGAVTSYLR

KRWGLMQKDRSTDRHHAMDAVVIACCTDGMIHKISRYMQGRELAYSRNFK

FPDEETGEILNRDNFTREQWDEKFGVKVPLPWNSFRDELDIRLLNEDPKN

FLLTHADVQRELDYPGWMYGEEESPIEEGRYINYIRPLFVSRMPNHKVTG

SAHDATIRSARDYETRGVVITKVPLTDLKLNKDNEIEGYYDKDSDRLLYQ

ALVRQLLLHGNDGKKAFAEDFHKPKADGTEGPVVRKVKIEKKQTSGVMVR

GGTGIAANGEMVRIDVFRENGKYYFVPVYTADVVRKVLPNRAATHTKPYS

EWRVMDDANFVFSLYSRDLIHVKSKKDIKTNLVNGGLLLQKEIFAYYTGA

DIATASIAGFANDSNFKFRGLGIQSLEIFEKCQVDILGNISVVRHENRQE

FH

SEQ ID NO: 348

MRVLGLDAGIASLGWALIEIEESNRGELSQGTIIGAGTWMFDAPEEKTQA

GAKLKSEQRRTFRGQRRVVRRRRQRMNEVRRILHSHGLLPSSDRDALKQP

GLDPWRIRAEALDRLLGPVELAVALGHIARHRGFKSNSKGAKTNDPADDT

SKMKRAVNETREKLARFGSAAKMLVEDESFVLRQTPTKNGASEIVRRFRN

REGDYSRSLLRDDLAAEMRALFTAQARFQSAIATADLQTAFTKAAFFQRP

LQDSEKLVGPCPFEVDEKRAPKRGYSFELFRFLSRLNHVTLRDGKQERTL

TRDELALAAADFGAAAKVSFTALRKKLKLPETTVFVGVKADEESKLDVVA

RSGKAAEGTARLRSVIVDALGELAWGALLCSPEKLDKIAEVISFRSDIGR

ISEGLAQAGCNAPLVDALTAAASDGRFDPFTGAGHISSKAARNILSGLRQ

GMTYDKACCAADYDHTASRERGAFDVGGHGREALKRILQEERISRELVGS

PTARKALIESIKQVKAIVERYGVPDRIHVELARDVGKSIEEREEITRGIE

KRNRQKDKLRGLFEKEVGRPPQDGARGKEELLRFELWSEQMGRCLYTDDY

-continued

ISPSQLVATDDAVQVDHILPWSRFADDSYANKTLCMAKANQDKKGRTPYE

WFKAEKTDTEWDAFIVRVEALADMKGFKKRNYKLRNAEEAAAKFRNRNLN

DTRWACRLLAEALKQLYPKGEKDKDGKERRRVFSRPGALTDRLRRAWGLQ

WMKKSTKGDRIPDDRHHALDAIVIAATTESLLQRATREVQEIEDKGLHYD

LVKNVTPPWPGFREQAVEAVEKVFVARAERRRARGKAHDATIRHIAVREG

EQRVYERRKVAELKLADLDRVKDAERNARLIEKLRNWIEAGSPKDDPPLS

PKGDPIFKVRLVTKSKVNIALDTGNPKRPGTVDRGEMARVDVFRKASKKG

KYEYYLVPIYPHDIATMKTPPIRAVQAYKPEDEWPEMDSSYEFCWSLVPM

TYLQVISSKGEIFEGYYRGMNRSVGAIQLSAHSNSSDVVQGIGARTLTEF

KKFNVDRFGRKHEVERELRTWRGETWRGKAYI

SEQ ID NO: 349

MGNYYLGLDVGIGSIGWAVINIEKKRIEDFNVRIFKSGEIQEKNRNSRAS

QQCRRSRGLRRLYRRKSHRKLRLKNYLSIIGLTTSEKIDYYYETADNNVI

QLRNKGLSEKLTPEEIAACLIHICNNRGYKDFYEVNVEDIEDPDERNEYK

EEHDSIVLISNLMNEGGYCTPAEMICNCREFDEPNSVYRKFHNSAASKNH

YLITRHMLVKEVDLILENQSKYYGILDDKTIAKIKDIIFAQRDFEIGPGK

NERFRRFTGYLDSIGKCQFFKDQERGSRFTVIADIYAFVNVLSQYTYTNN

RGESVFDTSFANDLINSALKNGSMDKRELKAIAKSYHIDISDKNSDTSLT

KCFKYIKVVKPLFEKYGYDWDKLIENYTDTDNNVLNRIGIVLSQAQTPKR

RREKLKALNIGLDDGLINELTKLKLSGTANVSYKYMQGSIEAFCEGDLYG

KYQAKFNKEIPDIDENAKPQKLPPFKNEDDCEFFKNPVVFRSINETRKLI

NAIIDKYGYPAAVNIETADELNKTFEDRAIDTKRNNDNQKENDRIVKEII

ECIKCDEVHARHLIEKYKLWEAQEGKCLYSGETITKEDMLRDKDKLFEVD

HIVPYSLILDNTINNKALVYAEENQKKGQRTPLMYMNEAQAADYRVRVNT

MFKSKKCSKKKYQYLMLPDLNDQELLGGWRSRNLNDTRYICKYLVNYLRK

NLRFDRSYESSDEDDLKIRDHYRVFPVKSRFTSMFRRWWLNEKTWGRYDK

AELKKLTYLDHAADAIIIANCRPEYVVLAGEKLKLNKMYHQAGKRITPEY

EQSKKACIDNLYKLFRMDRRTAEKLLSGHGRLTPIIPNLSEEVDKRLWDK

NIYEQFWKDDKDKKSCEELYRENVASLYKGDPKFASSLSMPVISLKPDHK

YRGTITGEEAIRVKEIDGKLIKLKRKSISEITAESINSIYTDDKILIDSL

KTIFEQADYKDVGDYLKKTNQHFFTTSSGKRVNKVTVIEKVPSRWLRKEI

DDNNFSLLNDSSYYCIELYKDSKGDNNLQGIAMSDIVHDRKTKKLYLKPD

FNYPDDYYTHVMYIFPGDYLRIKSTSKKSGEQLKFEGYFISVKNVNENSF

RFISDNKPCAKDKRVSITKKDIVIKLAVDLMGKVQGENNGKGISCGEPLS

LLKEKN

SEQ ID NO: 350

MLSRQLLGASHLARPVSYSYNVQDNDVHCSYGERCFMRGKRYRIGIDVGL

NSVGLAAVEVSDENSPVRLLNAQSVIHDGGVDPQKNKEAITRKNMSGVAR

RTRRMRRRKRERLHKLDMLLGKFGYPVIEPESLDKPFEEWHVRAELATRY

IEDDELRRESISIALRHMARHRGWRNPYRQVDSLISDNPYSKQYGELKEK

AKAYNDDATAAEEESTPAQLVVAMLDAGYAEAPRLRWRTGSKKPDAEGYL

-continued

PVRLMQEDNANELKQIFRVQRVPADEWKPLFRSVFYAVSPKGSAEQRVGQ

DPLAPEQARALKASLAFQEYRIANVITNLRIKDASAELRKLTVDEKQSIY

DQLVSPSSEDITWSDLCDFLGFKRSQLKGVGSLTEDGEERISSRPPRLTS

VQRIYESDNKIRKPLVAWWKSASDNEHEAMIRLLSNTVDIDKVREDVAYA

SAIEFIDGLDDDALTKLDSVDLPSGRAAYSVETLQKLTRQMLTTDDDLHE

ARKTLFNVTDSWRPPADPIGEPLGNPSVDRVLKNVNRYLMNCQQRWGNPV

SVNIEHVRSSFSSVAFARKDKREYEKNNEKRSIFRSSLSEQLRADEQMEK

VRESDLRRLEAIQRQNGQCLYCGRTITFRTCEMDHIVPRKGVGSTNTRTN

FAAVCAECNRMKSNTPFAIWARSEDAQTRGVSLAEAKKRVTMFTFNPKSY

APREVKAFKQAVIARLQQTEDDAAIDNRSIESVAWMADELHRRIDWYFNA

KQYVNSASIDDAEAETMKTTVSVFQGRVTASARRAAGIEGKIHFIGQQSK

TRLDRRHHAVDASVIAMMNTAAAQTLMERESLRESQRLIGLMPGERSWKE

YPYEGTSRYESFHLWLDNMDVLLELLNDALDNDRIAVMQSQRYVLGNSIA

HDATIHPLEKVPLGSAMSADLIRRASTPALWCALTRLPDYDEKEGLPEDS

HREIRVHDTRYSADDEMGFFASQAAQIAVQEGSADIGSAIHHARVYRCWK

TNAKGVRKYFYGMIRVFQTDLLRACHDDLFTVPLPPQSISMRYGEPRVVQ

ALQSGNAQYLGSLVVGDEIEMDFSSLDVDGQIGEYLQFFSQFSGGNLAWK

HWVVDGFFNQTQLRIRPRYLAAEGLAKAFSDDVVPDGVQKIVTKQGWLPP

VNTASKTAVRIVRRNAFGEPRLSSAHHMPCSWQWRHE

SEQ ID NO: 351

MYSIGLDLGISSVGWSVIDERTGNVIDLGVRLFSAKNSEKNLERRTNRGG

RRLIRRKTNRLKDAKKILAAVGFYEDKSLKNSCPYQLRVKGLTEPLSRGE

IYKVTLHILKKRGISYLDEVDTEAAKESQDYKEQVRKNAQLLTKYTPGQI

QLQRLKENNRVKTGINAQGNYQLNVFKVSAYANELATILKTQQAFYPNEL

TDDWIALFVQPGIAEEAGLIYRKRPYYHGPGNEANNSPYGRWSDFQKTGE

PATNIFDKLIGKDFQGELRASGLSLSAQQYNLLNDLTNLKIDGEVPLSSE

QKEYILTELMTKEFTRFGVNDVVKLLGVKKERLSGWRLDKKGKPEIHTLK

GYRNWRKIFAEAGIDLATLPTETIDCLAKVLTLNTEREGIENTLAFELPE

LSESVKLLVLDRYKELSQSISTQSWHRFSLKTLHLLIPELMNATSEQNTL

LEQFQLKSDVRKRYSEYKKLPTKDVLAEIYNPTVNKTVSQAFKVIDALLV

KYGKEQIRYITIEMPRDDNEEDEKKRIKELHAKNSQRKNDSQSYFMQKSG

WSQEKFQTTIQKNRRFLAKLLYYYEQDGICAYTGLPISPELLVSDSTEID

HIIPISISLDDSINNKVLVLSKANQVKGQQTPYDAWMDGSFKKINGKFSN

WDDYQKWVESRHFSHKKENNLLETRNIFDSEQVEKFLARNLNDTRYASRL

VLNTLQSFFTNQETKVRVVNGSFTHTLRKKWGADLDKTRETHHHHAVDAT

LCAVTSFVKVSRYHYAVKEETGEKVMREIDFETGEIVNEMSYWEFKKSKK

YERKTYQVKWPNFREQLKPVNLHPRIKFSHQVDRKANRKLSDATIYSVRE

KTEVKTLKSGKQKITTDEYTIGKIKDIYTLDGWEAFKKKQDKLLMKDLDE

KTYERLLSIAETTPDFQEVEEKNGKVKRVKRSPFAVYCEENDIPAIQKYA

KKNNGPLIRSLKYYDGKLNKHINITKDSQGRPVEKTKNGRKVTLQSLKPY

RYDIYQDLETKAYYTVQLYYSDLRFVEGKYGITEKEYMKKVAEQTKGQVV

-continued

RFCFSLQKNDGLEIEWKDSQRYDVRFYNFQSANSINFKGLEQEMMPAENQ

FKQKPYNNGAINLNIAKYGKEGKKLRKFNTDILGKKHYLFYEKEPKNIIK

SEQ ID NO: 352

MYFYKNKENKLNKKVVLGLDLGIASVGWCLTDISQKEDNKFPIILHGVRL

FETVDDSDDKLLNETRRKKRGQRRRNRRLFTRKRDFIKYLIDNNIIELEF

DKNPKILVRNFIEKYINPFSKNLELKYKSVTNLPIGFHNLRKAAINEKYK

LDKSELIVLLYFYLSLRGAFFDNPEDTKSKEMNKNEIEIFDKNESIKNAE

FPIDKIIEFYKISGKIRSTINLKFGHQDYLKEIKQVFEKQNIDFMNYEKF

AMEEKSFFSRIRNYSEGPGNEKSFSKYGLYANENGNPELIINEKGQKIYT

KIFKTLWESKIGKCSYDKKLYRAPKNSFSAKVFDITNKLTDWKHKNEYIS

ERLKRKILLSRFLNKDSKSAVEKILKEENIKFENLSEIAYNKDDNKINLP

IINAYHSLTTIFKKHLINFENYLISNENDLSKLMSFYKQQSEKLFVPNEK

GSYEINQNNNVLHIFDAISNILNKFSTIQDRIRILEGYFEFSNLKKDVKS

SEIYSEIAKLREFSGTSSLSFGAYYKFIPNLISEGSKNYSTISYEEKALQ

NQKNNFSHSNLFEKTWVEDLIASPTVKRSLRQTMNLLKEIFKYSEKNNLE

IEKIVVEVTRSSNNKHERKKIEGINKYRKEKYEELKKVYDLPNENTTLLK

KLWLLRQQQGYDAYSLRKIEANDVINKPWNYDIDHIVPRSISFDDSFSNL

VIVNKLDNAKKSNDLSAKQFIEKIYGIEKLKEAKENWGNWYLRNANGKAF

NDKGKFIKLYTIDNLDEFDNSDFINRNLSDTSYITNALVNHLTFSNSKYK

YSVVSVNGKQTSNLRNQIAFVGIKNNKETEREWKRPEGFKSINSNDFLIR

EEGKNDVKDDVLIKDRSFNGHHAEDAYFITIISQYFRSFKRIERLNVNYR

KETRELDDLEKNNIKFKEKASFDNFLLINALDELNEKLNQMRFSRMVITK

KNTQLFNETLYSGKYDKGKNTIKKVEKLNLLDNRTDKIKKIEEFFDEDKL

KENELTKLHIFNHDKNLYETLKIIWNEVKIEIKNKNLNEKNYFKYFVNKK

LQEGKISFNEWVPILDNDFKIIRKIRYIKFSSEEKETDEIIFSQSNFLKI

DQRQNFSFHNTLYWVQIWVYKNQKDQYCFISIDARNSKFEKDEIKINYEK

LKTQKEKLQIINEEPILKINKGDLFENEEKELFYIVGRDEKPQKLEIKYI

LGKKIKDQKQIQKPVKKYFPNWKKVNLTYMGEIFKK

SEQ ID NO: 353

MDNKNYRIGIDVGLNSIGFCAVEVDQHDTPLGFLNLSVYRHDAGIDPNGK

KTNTTRLAMSGVARRTRRLFRKRKRRLAALDRFIEAQGWTLPDHADYKDP

YTPWLVRAELAQTPIRDENDLHEKLAIAVRHIARHRGWRSPWVPVRSLHV

EQPPSDQYLALKERVEAKTLLQMPEGATPAEMVVALDLSVDVNLRPKNRE

KTDTRPENKKPGFLGGKLMQSDNANELRKIAKIQGLDDALLRELIELVFA

ADSPKGASGELVGYDVLPGQHGKRRAEKAHPAFQRYRIASIVSNLRIRHL

GSGADERLDVETQKRVFEYLLNAKPTADITWSDVAEEIGVERNLLMGTAT

QTADGERASAKPPVDVTNVAFATCKIKPLKEWWLNADYEARCVMVSALSH

AEKLTEGTAAEVEVAEFLQNLSDEDNEKLDSFSLPIGRAAYSVDSLERLT

KRMIENGEDLFEARVNEFGVSEDWRPPAEPIGARVGNPAVDRVLKAVNRY

LMAAEAEWGAPLSVNIEHVREGFISKRQAVEIDRENQKRYQRNQAVRSQI

ADHINATSGVRGSDVTRYLAIQRQNGECLYCGTAITFVNSEMDHIVPRAG

LGSTNTRDNLVATCERCNKSKSNKPFAVWAAECGIPGVSVAEALKRVDFW

-continued

IADGFASSKEHRELQKGVKDRLKRKVSDPEIDNRSMESVAWMARELAHRV
QYYFDEKHTGTKVRVFRGSLTSAARKASGFESRVNFIGGNGKTRLDRRHH
AMDAATVAMLRNSVAKTLVLRGNIRASERAIGAAETWKSFRGENVADRQI
FESWSENMRVLVEKFNLALYNDEVSIFSSLRLQLGNGKAHDDTITKLQMH
KVGDAWSLTEIDRASTPALWCALTRQPDFTWKDGLPANEDRTIIVNGTHY
GPLDKVGIFGKAAASLLVRGGSVDIGSAIHHARIYRIAGKKPTYGMVRVF
APDLLRYRNEDLFNVELPPQSVSMRYAEPKVREAIREGKAEYLGWLVVGD
ELLLDLSSETSGQIAELQQDFPGTTHWTVAGFFSPSRLRLRPVYLAQEGL
GEDVSEGSKSIIAGQGWRPAVNKVFGSAMPEVIRRDGLGRKRRFSYSGLP
VSWQG

SEQ ID NO: 354

MRLGLDIGTSSIGWWLYETDGAGSDARITGVVDGGVRIFSDGRDPKSGAS
LAVDRRAARAMRRRRDRYLRRRATLMKVLAETGLMPADPAEAKALEALDP
FALRAAGLDEPLPLPHLGRALFHLNQRRGFKSNRKTDRGDNESGKIKDAT
ARLDMEMMANGARTYGEFLHKRRQKATDPRHVPSVRTRLSIANRGGPDGK
EEAGYDFYPDRRHLEEEFHKLWAAQGAHHPELTETLRDLLFEKIFFQRPL
KEPEVGLCLFSGHHGVPPKDPRLPKAHPLTQRRVLYETVNQLRVTADGRE
ARPLTREERDQVIHALDNKKPTKSLSSMVLKLPALAKVLKLRDGERFTLE
TGVRDAIACDPLRASPAHPDRFGPRWSILDADAQWEVISRIRRVQSDAEH
AALVDWLTEAHGLDRAHAEATAHAPLPDGYGRLGLTATTRILYQLTADVV
TYADAVKACGWHHSDGRTGECFDRLPYYGEVLERHVIPGSYHPDDDDITR
FGRITNPTVHIGLNQLRRLVNRIIETHGKPHQIVVELARDLKKSEEQKRA
DIKRIRDTTEAAKKRSEKLEELEIEDNGRNRMLLRLWEDLNPDDAMRRFC
PYTGTRISAAMIFDGSCDVDHILPYSRTLDDSFPNRTLCLREANRQKRNQ
TPWQAWGDTPHWHAIAANLKNLPENKRWRFAPDAMTRFEGENGFLDRALK
DTQYLARISRSYLDTLFTKGGHVWVVPGRFTEMLRRHWGLNSLLSDAGRG
AVKAKNRTTHRHHAIDAAVIAATDPGLLNRISRAAGQGEAAGQSAELIAR
DTPPPWEGFRDDLRVRLDRIIVSHRADHGRIDHAARKQGRDSTAGQLHQE
TAYSIVDDIHVASRTDLLSLKPAQLLDEPGRSGQVRDPQLRKALRVATGG
KTGKDFENALRYFASKPGPYQAIRRVRIIKPLQAQARVPVPAQDPIKAYQ
GGSNHLFEIWRLPDGEIEAQVITSFEAHTLEGEKRPHPAAKRLLRVHKGD
MVALERDGRRVVGHVQKMDIANGLFIVPHNEANADTRNNDKSDPFKWIQI
GARPAIASGIRRVSVDEIGRLRDGGTRPI

SEQ ID NO: 355

MLHCIAVIRVPPSEEPGFFETHADSCALCHHGCMTYAANDKAIRYRVGID
VGLRSIGFCAVEVDDEDHPIRILNSVVHVHDAGTGGPGETESLRKRSGVA
ARARRRGRAEKQRLKKLDVLLEELGWGVSSNELLDSHAPWHIRKRLVSEY
IEDETERRQCLSVAMAHIARHRGWRNSFSKVDTLLLEQAPSDRMQGLKER
VEDRTGLQFSEEVTQGELVATLLEHDGDVTIRGFVRKGGKATKVHGVLEG
KYMQSDLVAELRQICRTQRVSETTFEKLVLSIFHSKEPAPSAARQRERVG
LDELQLALDPAAKQPRAERAHPAFQKFKVVATLANMRIREQSAGERSLTS

-continued

EELNRVARYLLNHTESESPTWDDVARKLEVPRHRLRGSSRASLETGGGLT
YPPVDDTTVRVMSAEVDWLADWWDCANDESRGHMIDAISNGCGSEPDDVE
DEEVNELISSATAEDMLKLELLAKKLPSGRVAYSLKTLREVTAAILETGD
DLSQAITRLYGVDPGWVPTPAPIEAPVGNPSVDRVLKQVARWLKFASKRW
GVPQTVNIEHTREGLKSASLLEEERERWERFEARREIRQKEMYKRLGISG
PFRRSDQVRYEILDLQDCACLYCGNEINFQTFEVDHIIPRVDASSDSRRT
NLAAVCHSCNSAKGGLAFGQWVKRGDCPSGVSLENAIKRVRSWSKDRLGL
TEKAMGKRKSEVISRLKTEMPYEEFDGRSMESVAWMAIELKKRIEGYFNS
DRPEGCAAVQVNAYSGRLTACARRAAHVDKRVRLIRLKGDDGHHKNRFDR
RNHAMDALVIALMTPAIARTIAVREDRREAQQLTRAFESWKNFLGSEERM
QDRWESWIGDVEYACDRLNELIDADKIPVTENLRLRNSGKLHADQPESLK
KARRGSKRPRPQRYVLGDALPADVINRVTDPGLWTALVRAPGFDSQLGLP
ADLNRGLKLRGKRISADFPIDYFPTDSPALAVQGGYVGLEFHHARLYRII
GPKEKVKYALLRVCAIDLCGIDCDDLFEVELKPSSISMRTADAKLKEAMG
NGSAKQIGWLVLGDEIQIDPTKFPKQSIGKFLKECGPVSSWRVSALDTPS
KITLKPRLLSNEPLLKTSRVGGHESDLVVAECVEKIMKKTGWVVEINALC
QSGLIRVIRRNALGEVRTSPKSGLPISLNLR

SEQ ID NO: 356

MRYRVGLDLGTASVGAAVFSMDEQGNPMELIWHYERLFSEPLVPDMGQLK
PKKAARRLARQQRRQIDRRASRLRRIAIVSRRLGIAPGRNDSGVHGNDVP
TLRAMAVNERIELGQLRAVLLRMGKKRGYGGTFKAVRKVGEAGEVASGAS
RLEEEMVALASVQNKDSVTVGEYLAARVEHGLPSKLKVAANNEYYAPEYA
LFRQYLGLPAIKGRPDCLPNMYALRHQIEHEFERIWATQSQFHDVMKDHG
VKEEIRNAIFFQRPLKSPADKVGRCSLQTNLPRAPRAQIAAQNFRIEKQM
ADLRWGMGRRAEMLNDHQKAVIRELLNQQKELSFRKIYKELERAGCPGPE
GKGLNMDRAALGGRDDLSGNTTLAAWRKLGLEDRWQELDEVTQIQVINFL
ADLGSPEQLDTDDWSCRFMGKNGRPRNFSDEFVAFMNELRMTDGFDRLSK
MGFEGGRSSYSIKALKALTEWMIAPHWRETPETHRVDEEAAIRECYPESL
ATPAQGGRQSKLEPPPLTGNEVVDVALRQVRHTINMMIDDLGSVPAQIVV
EMAREMKGGVTRRNDIEKQNKRFASERKKAAQSIEENGKTPTPARILRYQ
LWIEQGHQCPYCESNISLEQALSGAYTNFEHILPRTLTQIGRKRSELVLA
HRECNDEKGNRTPYQAFGHDDRRWRIVEQRANALPKKSSRKTRLLLLKDF
EGEALTDESIDEFADRQLHESSWLAKVTTQWLSSLGSDVYVSRGSLTAEL
RRRWGLDTVIPQVRFESGMPVVDEEGAEITPEEFEKFRLQWEGHRVTREM
RTDRRPDKRIDHRHHLVDAIVTALTSRSLYQQYAKAWKVADEKQRHGRVD
VKVELPMPILTIRDIALEAVRSVRISHKPDRYPDGRFFEATAYGIAQRLD
ERSGEKVDWLVSRKSLTDLAPEKKSIDVDKVRANISRIVGEAIRLHISNI
FEKRVSKGMTPQQALREPIEFQGNILRKVRCFYSKADDCVRIEHSSRRGH
HYKMLLNDGFAYMEVPCKEGILYGVPNLVRPSEAVGIKRAPESGDFIRFY
KGDTVKNIKTGRVYTIKQILGDGGGKLILTPVTETKPADLLSAKWGRLKV
GGRNIHLLRLCAE

SEQ ID NO: 357

MIGEHVRGGCLFDDHWTPNWGAFRLPNTVRTFTKAENPKDGSSLAEPRRQ
ARGLRRRLRRKTQRLEDLRRLLAKEGVLSLSDLETLFRETPAKDPYQLRA
EGLDRPLSFPEWVRVLYHITKHRGFQSNRRNPVEDGQERSRQEEEGKLLS
GVGENERLLREGGYRTAGEMLARDPKFQDHRRNRAGDYSHTLSRSLLLEE
ARRLFQSQRTLGNPHASSNLEEAFLHLVAFQNPFASGEDIRNKAGHCSLE
PDQIRAPRRSASAETFMLLQKTGNLRLIHRRTGEERPLTDKEREQIHLLA
WKQEKVTHKTLRRHLEIPEEWLFTGLPYHRSGDKAEEKLFVHLAGIHEIR
KALDKGPDPAVWDTLRSRRDLLDSIADTLTFYKNEDEILPRLESLGLSPE
NARALAPLSFSGTAHLSLSALGKLLPHLEEGKSYTQARADAGYAAPPPDR
HPKLPPLEEADWRNPVVFRALTQTRKVVNALVRRYGPPWCIHLETARELS
QPAKVRRRIETEQQANEKKKQQAEREFLDIVGTAPGPGDLLKMRLWREQG
GFCPYCEEYLNPTRLAEPGYAEMDHILPYSRSLDNGWHNRVLVHGKDNRD
KGNRTPFEAFGGDTARWDRLVAWVQASHLSAPKKRNLLREDFGEEAEREL
KDRNLTDTRFITKTAATLLRDRLTFHPEAPKDPVMTLNGRLTAFLRKQWG
LHKNRKNGDLHHALDAAVLAVASRSFVYRLSSHNAAWGELPRGREAENGF
SLPYPAFRSEVLARLCPTREEILLRLDQGGVGYDEAFRNGLRPVFVSRAP
SRRLRGKAHMETLRSPKWKDHPEGPRTASRIPLKDLNLEKLERMVGKDRD
RKLYEALRERLAAFGGNGKKAFVAPFRKPCRSGEGPLVRSLRIFDSGYSG
VELRDGGEVYAVADHESMVRVDVYAKKNRFYLVPVYVADVARGIVKNRAI
VAHKSEEEWDLVDGSFDFRFSLFPGDLVEIEKKDGAYLGYYKSCHRGDGR
LLLDRHDRMPRESDCGTFYVSTRKDVLSMSKYQVDPLGEIRLVGSEKPPF
VL

SEQ ID NO: 358

MEKKRKVTLGFDLGIASVGWAIVDSETNQVYKLGSRLFDAPDTNLERRTQ
RGTRRLLRRRKYRNQKFYNLVKRTEVFGLSSREAIENRFRELSIKYPNII
ELKTKALSQEVCPDEIAWILHDYLKNRGYFYDEKETKEDFDQQTVESMPS
YKLNEFYKKYGYFKGALSQPTESEMKDNKDLKEAFFFDFSNKEWLKEINY
FFNVQKNILSETFIEEFKKIFSFTRDISKGPGSDNMPSPYGIFGEFGDNG
QGGRYEHIWDKNIGKCSIFTNEQRAPKYLPSALIFNFLNELANIRLYSTD
KKNIQPLWKLSSVDKLNILLNLFNLPISEKKKKLTSTNINDIVKKESIKS
IMISVEDIDMIKDEWAGKEPNVYGVGLSGLNIEESAKENKFKFQDLKILN
VLINLLDNVGIKFEFKDRNDIIKNLELLDNLYLFLIYQKESNNKDSSIDL
FIAKNESLNIENLKLKLKEFLLGAGNEFENHNSKTHSLSKKAIDEILPKL
LDNNEGWNLEAIKNYDEEIKSQIEDNSSLMAKQDKKYLNDNFLKDAILPP
NVKVTFQQAILIFNKIIQKFSKDFEIDKVVIELAREMTQDQENDALKGIA
KAQKSKKSLVEERLEANNIDKSVFNDKYEKLIYKIFLWISQDFKDPYTGA
QISVNEIVNNKVEIDHIIPYSLCFDDSSANKVLVHKQSNQEKSNSLPYEY
IKQGHSGWNWDEFTKYVKRVFVNNVDSILSKKERLKKSENLLTASYDGYD
KLGFLARNLNDTRYATILFRDQLNNYAEHHLIDNKKMFKVIAMNGAVTSF
IRKNMSYDNKLRLKDRSDFSHHAYDAAIIALFSNKTKTLYNLIDPSLNGI
ISKRSEGYWVIEDRYTGEIKELKKEDWTSIKNNVQARKIAKEIEEYLIDL

DDEVFFSRKTKRKTNRQLYNETIYGIATKTDEDGITNYYKKEKFSILDDK
DIYLRLLREREKFVINQSNPEVIDQIIEIIESYGKENNIPSRDEAINIKY
TKNKINYNLYLKQYMRSLTKSLDQFSEEFINQMIANKTFVLYNPTKNTTR
KIKFLRLVNDVKINDIRKNQVINKFNGKNNEPKAFYENINSLGAIVFKNS
ANNFKTLSINTQIAIFGDKNWDIEDFKTYNMEKIEKYKEIYGIDKTYNFH
SFIFPGTILLDKQNKEFYYISSIQTVRDIIEIKFLNKIEFKDENKNQDTS
KTPKRLMFGIKSIMNNYEQVDISPFGINKKIFE

SEQ ID NO: 359

MGYRIGLDVGITSTGYAVLKTDKNGLPYKILTLDSVIYPRAENPQTGASL
AEPRRIKRGLRRRTRRTKFRKQRTQQLFIHSGLLSKPEIEQILATPQAKY
SVYELRVAGLDRRLTNSELFRVLYFFIGHRGFKSNRKAELNPENEADKKQ
MGQLLNSIEEIRKAIAEKGYRTVGELYLKDPKYNDHKRNKGYIDGYLSTP
NRQMLVDEIKQILDKQRELGNEKLTDEFYATYLLGDENRAGIFQAQRDFD
EGPGAGPYAGDQIKKMVGKDIFEPTEDRAAKATYTFQYFNLLQKMTSLNY
QNTTGDTWHTLNGLDRQAIIDAVFAKAEKPTKTYKPTDFGELRKLLKLPD
DARFNLVNYGSLQTQKEIETVEKKTRFVDFKAYHDLVKVLPEEMWQSRQL
LDHIGTALTLYSSDKRRRRYFAEELNLPAELIEKLLPLNFSKFGHLSIKS
MQNIIPYLEMGQVYSEATTNTGYDFRKKQISKDTIREEITNPVVRRAVTK
TIKIVEQIIRRYGKPDGINIELARELGRNFKERGDIQKRQDKNRQTNDKI
AAELTELGIPVNGQNIIRYKLHKEQNGVDPYTGDQIPFERAFSEGYEVDH
IIPYSISWDDSYTNKVLTSAKCNREKGNRIPMVYLANNEQRLNALTNIAD
NIIRNSRKRQKLLKQKLSDEELKDWKQRNINDTRFITRVLYNYFRQAIEF
NPELEKKQRVLPLNGEVTSKIRSRWGFLKVREDGDLHHAIDATVIAAITP
KFIQQVTKYSQHQEVKNNQALWHDAEIKDAEYAAEAQRMDADLFNKIFNG
FPLPWPEFLDELLARISDNPVEMMKSRSWNTYTPIEIAKLKPVFVVRLAN
HKISGPAHLDTIRSAKLFDEKGIVLSRVSITKLKINKKGQVATGDGIYDP
ENSNNGDKVVYSAIRQALEAHNGSGELAFPDGYLEYVDHGTKKLVRKVRV
AKKVSLPVRLKNKAAADNGSMVRIDVFNTGKKFVFVPIYIKDTVEQVLPN
KAIARGKSLWYQITESDQFCFSLYPGDMVHIESKTGIKPKYSNKENNTSV
VPIKNFYGYFDGADIATASILVRAHDSSYTARSIGIAGLLKFEKYQVDYF
GRYHKVHEKKRQLFVKRDE

SEQ ID NO: 360

MQKNINTKQNHIYIKQAQKIKEKLGDKPYRIGLDLGVGSIGFAIVSMEEN
DGNVLLPKEIIMVGSRIFKASAGAADRKLSRGQRNNHRHTRERMRYLWKV
LAEQKLALPVPADLDRKENSSEGETSAKRFLGDVLQKDIYELRVKSLDER
LSLQELGYVLYHIAGHRGSSAIRTFENDSEEAQKENTENKKIAGNIKRLM
AKKNYRTYGEYLYKEFFENKEKHKREKISNAANNHKFSPTRDLVIKEAEA
ILKKQAGKDGFHKELTEEYIEKLTKAIGYESEKLIPESGFCPYLKDEKRL
PASHKLNEERRLWETLNNARYSDPIVDIVTGEITGYYEKQFTKEQKQKLF
DYLLTGSELTPAQTKKLLGLKNTNFEDIILQGRDKKAQKIKGYKLIKLES
MPFWARLSEAQQDSFLYDWNSCPDEKLLTEKLSNEYHLTEEEIDNAFNEI

-continued

VLSSSYAPLGKSAMLIILEKIKNDLSYTEAVEEALKEGKLTKEKQAIKDR

LPYYGAVLQESTQKIIAKGFSPQFKDKGYKTPHTNKYELEYGRIANPVVH

QTLNELRKLVNEIIDILGKKPCEIGLETARELKKSAEDRSKLSREQNDNE

SNRNRIYEIYIRPQQQVIITRRENPRNYILKFELLEEQKSQCPFCGGQIS

PNDIINNQADIEHLFPIAESEDNGRNNLVISHSACNADKAKRSPWAAFAS

AAKDSKYDYNRILSNVKENIPHKAWRFNQGAFEKFIENKPMAARFKTDNS

YISKVAHKYLACLFEKPNIICVKGSLTAQLRMAWGLQGLMIPFAKQLITE

KESESFNKDVNSNKKIRLDNRHHALDAIVIAYASRGYGNLLNKMAGKDYK

INYSERNWLSKILLPPNNIVWENIDADLESFESSVKTALKNAFISVKHDH

SDNGELVKGTMYKIFYSERGYTLTTYKKLSALKLTDPQKKKTPKDFLETA

LLKFKGRESEMKNEKIKSAIENNKRLFDVIQDNLEKAKKLLEEENEKSKA

EGKKEKNINDASIYQKAISLSGDKYVQLSKKEPGKFFAISKPTPTTTGYG

YDTGDSLCVDLYYDNKGKLCGEIIRKIDAQQKNPLKYKEQGFTLFERIYG

GDILEVDFDIHSDKNSFRNNTGSAPENRVFIKVGTFTEITNNNIQIWFGN

IIKSTGGQDDSFTINSMQQYNPRKLILSSCGFIKYRSPILKNKEG

SEQ ID NO: 361

MAAFKPNPINYILGLDIGIASVGWAMVEIDEDENPICLIDLGVRVFERAE

VPKTGDSLAMARRLARSVRRLTRRRAHRLLRARRLLKREGVLQAADFDEN

GLIKSLPNTPWQLRAAALDRKLTPLEWSAVLLHLIKHRGYLSQRKNEGET

ADKELGALLKGVADNAHALQTGDFRTPAELALNKFEKESGHIRNQRGDYS

HTFSRKDLQAELILLFEKQKEFGNPHVSGGLKEGIETLLMTQRPALSGDA

VQKMLGHCTFEPAEPKAAKNTYTAERFIWLTKLNNLRILEQGSERPLTDT

ERATLMDEPYRKSKLTYAQARKLLGLEDTAFFKGLRYGKDNAEASTLMEM

KAYHAISRALEKEGLKDKKSPLNLSPELQDEIGTAFSLFKTDEDITGRLK

DRIQPEILEALLKHISFDKFVQISLKALRRIVPLMEQGKRYDEACAEIYG

DHYGKKNTEEKIYLPPIPADEIRNPVVLRALSQARKVINGVVRRYGSPAR

IHIETAREVGKSFKDRKEIEKRQEENRKDREKAAAKFREYFPNFVGEPKS

KDILKLRLYEQQHGKCLYSGKEINLGRLNEKGYVEIDHALPFSRTWDDSF

NNKVLVLGSENQNKGNQTPYEYFNGKDNSREWQEFKARVETSRFPRSKKQ

RILLQKFDEDGFKERNLNDTRYVNRFLCQFVADRMRLTGKGKKRVFASNG

QITNLLRGFWGLRKVRAENDRHHALDAVVVACSTVAMQQKITRFVRYKEM

NAFDGKTIDKETGEVLHQKTHFPQPWEFFAQEVMIRVFGKPDGKPEFEEA

DTPEKLRTLLAEKLSSRPEAVHEYVTPLFVSRAPNRKMSGQGHMETVKSA

KRLDEGVSVLRVPLTQLKLKDLEKMVNRERERPKLYEALKARLEAHKDDPA

KAFAEPFYKYDKAGNRTQQVKAVRVEQVQKTGVWVRNHNGIADNATMVRV

DVFEKGDKYYLVPIYSWQVAKGILPDRAVVQGKDEEDWQLIDDSFNFKFS

LHPNDLVEVITKKARMFGYFASCHRGTGNINIRIHDLDHKIGKNGILEGI

GVKTALSFQKYQIDELGKEIRPCRLKKRPPVR

SEQ ID NO: 362

MQTTNLSYILGLDLGIASVGWAVVEINENEDPIGLIDVGVRIFERAEVPK

TGESLALSRRLARSTRRLIRRRAHRLLLAKRFLKREGILSTIDLEKGLPN

QAWELRVAGLERRLSAIEWGAVLLHLIKHRGYLSKRKNESQTNNKELGAL

-continued

LSGVAQNHQLLQSDDYRTPAELALKKFAKEEGHIRNQRGAYTHTFNRLDL

LAELNLLFAQQHQFGNPHCKEHIQQYMTELLMWQKPALSGEAILKMLGKC

THEKNEFKAAKHTYSAERFVWLTKLNNLRILEDGAERALNEEERQLLINH

PYEKSKLTYAQVRKLLGLSEQAIFKHLRYSKENAESATFMELKAWHAIRK

ALENQGLKDTWQDLAKKPDLLDEIGTAFSLYKTDEDIQQYLTNKVPNSVI

NALLVSLNFDKFIELSLKSLRKILPLMEQGKRYDQACREIYGHHYGEANQ

KTSQLLPAIPAQEIRNPVVLRTLSQARKVINAIIRQYGSPARVHIETGRE

LGKSFKERREIQKQQEDNRTKRESAVQKFKELFSDFSSEPKSKDILKFRL

YEQQHGKCLYSGKEINIHRLNEKGYVEIDHALPFSRTWDDSFNNKVLVLA

SENQNKGNQTPYEWLQGKINSERWKNFVALVLGSQCSAAKKQRLLTQVID

DNKFIDRNLNDTRYIARFLSNYIQENLLLVGKNKKNVFTPNGQITALLRS

RWGLIKARENNNRHHALDAIVVACATPSMQQKITRFIRFKEVHPYKIENR

YEMVDQESGEIISPHFPEPWAYFRQEVNIRVFDNHPDTVLKEMLPDRPQA

NHQFVQPLFVSRAPTRKMSGQGHMETIKSAKRLAEGISVLRIPLTQLKPN

LLENMVNKEREPALYAGLKARLAEFNQDPAKAFATPFYKQGGQQVKAIRV

EQVQKSGVLVRENNGVADNASIVRTDVFIKNNKFFLVPIYTWQVAKGILP

NKAIVAHKNEDEWEEMDEGAKFKFSLFPNDLVELKTKKEYFFGYYIGLDR

ATGNISLKEHDGEISKGKDGVYRVGVKLALSFEKYQVDELGKNRQICRPQ

QRQPVR

SEQ ID NO: 363

MGIRFAFDLGTNSIGWAVWRTGPGVFGEDTAASLDGSGVLIFKDGRNPKD

GQSLATMRRVPRQSRKRRDRFVLRRRDLLAALRKAGLFPVDVEEGRRLAA

TDPYHLRAKALDESLTPHEMGRVIFHLNQRRGFRSNRKADRQDREKGKIA

EGSKRLAETLAATNCRTLGEFLWSRHRGTPRTRSPTRIRMEGEGAKALYA

FYPTREMVRAEFERLWTAQSRFAPDLLTPERHEEIAGILFRQRDLAPPKI

GCCTFEPSERRLPRALPSVEARGIYERLAHLRITTGPVSDRGLTRPERDV

LASALLAGKSLTFKAVRKTLKILPHALVNFEEAGEKGLDGALTAKLLSKP

DHYGAAWHGLSFAEKDTFVGKLLDEADEERLIRRLVTENRLSEDAARRCA

SIPLADGYGRLGRTANTEILAALVEETDETGTVVTYAEAVRRAGERTGRN

WHHSDERDGVILDRLPYYGEILQRHVVPGSGEPEEKNEAARWGRLANPTV

HIGLNQLRKVVNRLIAAHGRPDQIVVELARELKLNREQKERLDRENRKNR

EENERRTAILAEHGQRDTAENKIRLRLFEEQARANAGIALCPYTGRAIGI

AELFTSEVEIDHILPVSLTLDDSLANRVLCRREANREKRRQTPFQAFGAT

PAWNDIVARAAKLPPNKRWRFDPAALERFEREGGFLGRQLNETKYLSRLA

KIYLGKICDPDRVYVTPGTLTGLLRARWGLNSILSDSNFKNRSDHRHHAV

DAVVIGVLTRGMIQRIAHDAARAEDQDLDRVFRDVPVPFEDFRDHVRERV

STITVAVKPEHGKGGALHEDTSYGLVPDTDPNAALGNLVVRKPIRSLTAG

EVDRVRDRALRARLGALAAPFRDESGRVRDAKGLAQALEAFGAENGIRRV

RILKPDASVVTIADRRTGVPYRAVAPGENHHVDIVQMRDGSWRGFAASVF

-continued

EVNRPGWRPEWEVKKLGGKLVMRLHKGDMVELSDKDGQRRVKVVQQIEIS

ANRVRLSPHNDGGKLQDRHADADDPFRWDLATIPLLKDRGCVAVRVDPIG

VVTLRRSNV

SEQ ID NO: 364

MMEVFMGRLVLGLDIGITSVGFGIIDLDESEIVDYGVRLFKEGTAAENET

RRTKRGGRRLKRRRVTRREDMLHLLKQAGIISTSFHPLNNPYDVRVKGLN

ERLNGEELATALLHLCKHRGSSVETIEDDEAKAKEAGETKKVLSMNDQLL

KSGKYVCEIQKERLRTNGHIRGHENNFKTRAYVDEAFQILSHQDLSNELK

SAIITIISRKRMYYDGPGGPLSPTPYGRYTYFGQKEPIDLIEKMRGKCSL

FPNEPRAPKLAYSAELFNLLNDLNNLSIEGEKLTSEQKAMILKIVHEKGK

ITPKQLAKEVGVSLEQIRGFRIDTKGSPLLSELTGYKMIREVLEKSNDEH

LEDHVFYDEIAEILTKTKDIEGRKKQISELSSDLNEESVHQLAGLTKFTA

YHSLSFKALRLINEEMLKTELNQMQSITLFGLKQNNELSVKGMKNIQADD

TAILSPVAKRAQRETFKVVNRLREIYGEFDSIVVEMAREKNSEEQRKAIR

ERQKFFEMRNKQVADIIGDDRKINAKLREKLVLYQEQDGKTAYSLEPIDL

KLLIDDPNAYEVDHIIPISISLDDSITNKVLVTHRENQEKGNLTPISAFV

KGRFTKGSLAQYKAYCLKLKEKNIKTNKGYRKKVEQYLLNENDIYKYDIQ

KEFINRNLVDTSYASRVVLNTLTTYFKQNEIPTKVFTVKGSLTNAFRRKI

NLKKDRDEDYGHHAIDALIIASMPKMRLLSTIFSRYKIEDIYDESTGEVF

SSGDDSMYYDDRYFAFIASLKAIKVRKFSHKIDTKPNRSVADETIYSTRV

IDGKEKVVKKYKDIYDPKFTALAEDILNNAYQEKYLMALHDPQTFDQIVK

VVNYYFEEMSKSEKYFTKDKKGRIKISGMNPLSLYRDEHGMLKKYSKKGD

GPAITQMKYFDGVLGNHIDISAHYQVRDKKVVLQQISPYRTDFYYSKENG

YKFVTIRYKDVRWSEKKKKYVIDQQDYAMKKAEKKIDDTYEFQFSMHRDE

LIGITKAEGEALIYPDETWHNFNFFFHAGETPEILKFTATNNDKSNKIEV

KPIHCYCKMRLMPTISKKIVRIDKYATDVVGNLYKVKKNTLKFEFD

SEQ ID NO: 365

MKKILGVDLGITSFGYAILQETGKDLYRCLDNSVVMRNNPYDEKSGESSQ

SIRSTQKSMRRLIEKRKKRIRCVAQTMERYGILDYSETMKINDPKNNPIK

NRWQLRAVDAWKRPLSPQELFAIFAHMAKHRGYKSIATEDLIYELELELG

LNDPEKESEKKADERRQVYNALRHLEELRKKYGGETIAQTIHRAVEAGDL

RSYRNHDDYEKMIRREDIEEEIEKVLLRQAELGALGLPEEQVSELIDELK

ACITDQEMPTIDESLFGKCTFYKDELAAPAYSYLYDLYRLYKKLADLNID

GYEVTQEDREKVIEWVEKKIAQGKNLKKITHKDLRKILGLAPEQKIFGVE

DERIVKGKKEPRTFVPFFFLADIAKFKELFASIQKHPDALQIFRELAEIL

QRSKTPQEALDRLRALMAGKGIDTDDRELLELFKNKRSGTRELSHRYILE

ALPLFLEGYDEKEVQRILGFDDREDYSRYPKSLRHLHLREGNLFEKEENP

INNHAVKSLASWALGLIADLSWRYGPFDEIILETTRDALPEKIRKEIDKA

MREREKALDKIIGKYKKEFPSIDKRLARKIQLWERQKGLDLYSGKVINLS

QLLDGSADIEHIVPQSLGGLSTDYNTIVTLKSVNAAKGNRLPGDWLAGNP

DYRERIGMLSEKGLIDWKKRKNLLAQSLDEIYTENTHSKGIRATSYLEAL

VAQVLKRYYPFPDPELRKNGIGVRMIPGKVTSKTRSLLGIKSKSRETNFH

-continued

HAEDALILSTLTRGWQNRLHRMLRDNYGKSEAELKELWKKYMPHIEGLTL

ADYIDEAFRRFMSKGEESLFYRDMFDTIRSISYWVDKKPLSASSHKETVY

SSRHEVPTLRKNILEAFDSLNVIKDRHKLTTEEFMKRYDKEIRQKLWLHR

IGNTNDESYRAVEERATQIAQILTRYQLMDAQNDKEIDEKFQQALKELIT

SPIEVTGKLLRKMRFVYDKLNAMQIDRGLVETDKNMLGIHISKGPNEKLI

FRRMDVNNAHELQKERSGILCYLNEMLFIFNKKGLIHYGCLRSYLEKGQG

SKYIALFNPRFPANPKAQPSKFTSDSKIKQVGIGSATGIIKAHLDLDGHV

RSYEVFGTLPEGSIEWFKEESGYGRVEDDPHH

SEQ ID NO: 366

MRPIEPWILGLDIGTDSLGWAVFSCEEKGPPTAKELLGGGVRLFDSGRDA

KDHTSRQAERGAFRRARRQTRTWPWRRDRLIALFQAAGLTPPAAETRQIA

LALRREAVSRPLAPDALWAALLHLAHHRGFRSNRIDKRERAAAKALAKAK

PAKATAKATAPAKEADDEAGFWEGAEAALRQRMAASGAPTVGALLADDLD

RGQPVRMRYNQSDRDGVVAPTRALIAEELAEIVARQSSAYPGLDWPAVTR

LVLDQRPLRSKGAGPCAFLPGEDRALRALPTVQDFIIRQTLANLRLPSTS

ADEPRPLTDEEHAKALALLSTARFVEWPALRRALGLKRGVKFTAETERNG

AKQAARGTAGNLTEAILAPLIPGWSGWDLDRKDRVFSDLWAARQDRSALL

ALIGDPRGPTRVTEDETAEAVADAIQIVLPTGRASLSAKAARAIAQAMAP

GIGYDEAVTLALGLHHSHRPRQERLARLPYYAAALPDVGLDGDPVGPPPA

EDDGAAAEAYYGRIGNISVHIALNETRKIVNALLHRHGPILRLVMVETTR

ELKAGADERKRMIAEQAERERENAEIDVELRKSDRWMANARERRQRVRLA

RRQNNLCPYTSTPIGHADLLGDAYDIDHVIPLARGGRDSLDNMVLCQSDA

NKTKGDKTPWEAFHDKPGWIAQRDDFLARLDPQTAKALAWRFADDAGERV

ARKSAEDEDQGFLPRQLTDTGYIARVALRYLSLVTNEPNAVVATNGRLTG

LLRLAWDITPGPAPRDLLPTPRDALRDDTAARRFLDGLTPPPLAKAVEGA

VQARLAALGRSRVADAGLADALGLTLASLGGGGKNRADHRHHFIDAAMIA

VTTRGLINQINQASGAGRILDLRKWPRTNFEPPYPTFRAEVMKQWDHIHP

SIRPAHRDGGSLHAATVFGVRNRPDARVLVQRKPVEKLFLDANAKPLPAD

KIAEIIDGFASPRMAKRFKALLARYQAAHPEVPPALAALAVARDPAFGPR

GMTANTVIAGRSDGDGEDAGLITPFRANPKAAVRTMGNAVYEVWEIQVKG

RPRWTHRVLTRFDRTQPAPPPPPENARLVMRLRRGDLVYWPLESGDRLFL

VKKMAVDGRLALWPARLATGKATALYAQLSCPNINLNGDQGYCVQSAEGI

RKEKIRTTSCTALGRLRLSKKAT

SEQ ID NO: 367

MKYTLGLDVGIASVGWAVIDKDNNKIIDLGVRCFDKAEESKTGESLATAR

RIARGMRRRISRRSQRLRLVKKLFVQYEIIKDSSEFNRIFDTSRDGWKDP

WELRYNALSRILKPYELVQVLTHITKRRGFKSNRKEDLSTTKEGVVITSI

KNNSEMLRTKNYRTIGEMIFMETPENSNKRNKVDEYIHTIAREDLLNEIK

YIFSIQRKLGSPFVTEKLEHDFLNIWEFQRPFASGDSILSKVGKCTLLKE

ELRAPTSCYTSEYFGLLQSINNLVLVEDNNTLTLNNDQRAKIIEYAHFKN

EIKYSEIRKLLDIEPEILFKAHNLTHKNPSGNNESKKFYEMKSYHKLKST

-continued

LPTDIWGKLHSNKESLDNLFYCLTVYKNDNEIKDYLQANNLDYLIEYIAK

LPTFNKFKHLSLVAMKRIIPFMEKGYKYSDACNMAELDFTGSSKLEKCNK

LTVEPIIENVTNPVVIRALTQARKVINAIIQKYGLPYMVNIELAREAGMT

RQDRDNLKKEHENNRKAREKISDLIRQNGRVASGLDILKWRLWEDQGGRC

AYSGKPIPVCDLLNDSLTQIDHIYPYSRSMDDSYMNKVLVLTDENQNKRS

YTPYEVWGSTEKWEDFEARIYSMHLPQSKEKRLLNRNFITKDLDSFISRN

LNDTRYISRFLKNYIESYLQFSNDSPKSCVVCVNGQCTAQLRSRWGLNKN

REESDLHHALDAAVIACADRKIIKEITNYYNERENHNYKVKYPLPWHSFR

QDLMETLAGVFISRAPRRKITGPAHDETIRSPKHFNKGLTSVKIPLTTVT

LEKLETMVKNTKGGISDKAVYNVLKNRLIEHNNKPLKAFAEKIYKPLKNG

TNGAIIRSIRVETPSYTGVFRNEGKGISDNSLMVRVDVFKKKDKYYLVPI

YVAHMIKKELPSKAIVPLKPESQWELIDSTHEFLFSLYQNDYLVIKTKKG

ITEGYYRSCHRGTGSLSLMPHFANNKNVKIDIGVRTAISIEKYNVDILGN

KSIVKGEPRRGMEKYNSFKSN

SEQ ID NO: 368

MIRTLGIDIGIASIGWAVIEGEYTDKGLENKEIVASGVRVFTKAENPKNK

ESLALPRTLARSARRRNARKKGRIQQVKHYLSKALGLDLECFVQGEKLAT

LFQTSKDFLSPWELRERALYRVLDKEELARVILHIAKRRGYDDITYGVED

NDSGKIKKAIAENSKRIKEEQCKTIGEMMYKLYFQKSLNVRNKKESYNRC

VGRSELREELKTIFQIQQELKSPWVNEELIYKLLGNPDAQSKQEREGLIF

YQRPLKGFGDKIGKCSHIKKGENSPYRACKHAPSAEEFVALTKSINFLKN

LTNRHGLCFSQEDMCVYLGKILQEAQKNEKGLTYSKLKLLLDLPSDFEFL

GLDYSGKNPEKAVFLSLPSTFKLNKITQDRKTQDKIANILGANKDWEAIL

KELESLQLSKEQIQTIKDAKLNFSKHINLSLEALYHLLPLMREGKRYDEG

VEILQERGIFSKPQPKNRQLLPPLSELAKEESYFDIPNPVLRRALSEFRK

VVNALLEKYGGFHYFHIELTRDVCKAKSARMQLEKINKKNKSENDAASQL

LEVLGLPNTYNNRLKCKLWKQQEEYCLYSGEKITIDHLKDQRALQIDHAF

PLSRSLDDSQSNKVLCLTSSNQEKSNKTPYEWLGSDEKKWDMYVGRVYSS

NFSPSKKRKLTQKNFKERNEEDFLARNLVDTGYIGRVTKEYIKHSLSFLP

LPDGKKEHIRIISGSMTSTMRSFWGVQEKNRDHHLHHAQDAIIIACIEPS

MIQKYTTYLKDKETHRLKSHQKAQILREGDHKLSLRWPMSNFKDKIQESI

QNIIPSHHVSHKVTGELHQETVRTKEFYYQAFGGEEGVKKALKFGKIREI

NQGIVDNGAMVRVDIFKSKDKGKFYAVPIYTYDFAIGKLPNKAIVQGKKN

GIIKDWLEMDENYEFCFSLFKNDCIKIQTKEMQEAVLAIYKSTNSAKATI

ELEHLSKYALKNEDEEKMFTDTDKEKNKTMTRESCGIQGLKVFQKVKLSV

LGEVLEHKPRNRQNIALKTTPKHV

SEQ ID NO: 369

MKYSIGLDIGIASVGWSVINKDKERIEDMGVRIFQKAENPKDGSSLASSR

REKRGSRRRNRRKKHRLDRIKNILCESGLVKKNEIEKIYKNAYLKSPWEL

RAKSLEAKISNKEIAQILLHIAKRRGFKSFRKTDRNADDTGKLLSGIQEN

KKIMEEKGYLTIGDMVAKDPKFNTHVRNKAGSYLFSFSRKLLEDEVRKIQ

AKQKELGNTHFTDDVLEKYIEVFNSQRNFDEGPSKPSPYYSEIGQIAKMI

-continued

GNCTFESSEKRTAKNTWSGERFVFLQKLNNFRIVGLSGKRPLTEEERDIV

EKEVYLKKEVRYEKLRKILYLKEEERFGDLNYSKDEKQDKKTEKTKFISL

IGNYTIKKLNLSEKLKSEIEEDKSKLDKIIEILTFNKSDKTIESNLKKLE

LSREDIEILLSEEFSGTLNLSLKAIKKILPYLEKGLSYNEACEKADYDYK

NNGIKFKRGELLPVVDKDLIANPVVLRAISQTRKVVNAIIRKYGTPHTIH

VEVARDLAKSYDDRQTIIKENKKRELENEKTKKFISEEFGIKNVKGKLLL

KYRLYQEQEGRCAYSRKELSLSEVILDESMTDIDHIIPYSRSMDDSYSNK

VLVLSGENRKKSNLLPKEYFDRQGRDWDTFVLNVKAMKIHPRKKSNLLKE

KFTREDNKDWKSRALNDTRYISRFVANYLENALEYRDDSPKKRVFMIPGQ

LTAQLRARWRLNKVRENGDLHHALDAAVVAVTDQKAINNISNISRYKELK

NCKDVIPSIEYHADEETGEVYFEEVKDTRFPMPWSGFDLELQKRLESENP

REEFYNLLSDKRYLGWFNYEEGFIEKLRPVFVSRMPNRGVKGQAHQETIR

SSKKISNQIAVSKKPLNSIKLKDLEKMQGRDTDRKLYEALKNRLEEYDDK

PEKAFAEPFYKPTNSGKRGPLVRGIKVEEKQNVGVYVNGGQASNGSMVRI

DVFRKNGKFYTVPIYVHQTLLKELPNRAINGKPYKDWDLIDGSFEFLYSF

YPNDLIEIEFGKSKSIKNDNKLTKTEIPEVNLSEVLGYYRGMDTSTGAAT

IDTQDGKIQMRIGIKTVKNIKKYQVDVLGNVYKVKREKRQTF

SEQ ID NO: 370

MSKKVSRRYEEQAQEICQRLGSRPYSIGLDLGVGSIGVAVAAYDPIKKQP

SDLVFVSSRIFIPSTGAAERRQKRGQRNSLRHRANRLKFLWKLLAERNLM

LSYSEQDVPDPARLRFEDAVVRANPYELRLKGLNEQLTLSELGYALYHIA

NHRGSSSVRTFLDEEKSSDDKKLEEQQAMTEQLAKEKGISTFIEVLTAFN

TNGLIGYRNSESVKSKGVPVPTRDIISNEIDVLLQTQKQFYQEILSDEYC

DRIVSAILFENEKIVPEAGCCPYFPDEKKLPRCHFLNEERRLWEAINNAR

IKMPMQEGAAKRYQSASFSDEQRHILFHIARSGTDITPKLVQKEFPALKT

SIIVLQGKEKAIQKIAGFRFRRLEEKSFWKRLSEEQKDDFFSAWTNTPDD

KRLSKYLMKHLLLTENEVVDALKTVSLIGDYGPIGKTATQLLMKHLEDGL

TYTEALERGMETGEFQELSVWEQQSLLPYYGQILTGSTQALMGKYWHSAF

KEKRDSEGFFKPNTNSDEEKYGRIANPVVHQTLNELRKLMNELITILGAK

PQEITVELARELKVGAEKREDIIKQQTKQEKEAVLAYSKYCEPNNLDKRY

IERFRLLEDQAFVCPYCLEHISVADIAAGRADVDHIFPRDDTADNSYGNK

VVAHRQCNDIKGKRTPYAAFSNTSAWGPIMHYLDETPGMWRKRRKFETNE

EEYAKYLQSKGFVSRFESDNSYIAKAAKEYLRCLFNPNNVTAVGSLKGME

TSILRKAWNLQGIDDLLGSRHWSKDADTSPTMRKNRDDNRHHGLDAIVAL

YCSRSLVQMINTMSEQGKRAVEIEAMIPIPGYASEPNLSFEAQRELFRKK

ILEFMDLHAFVSMKTDNDANGALLKDTVYSILGADTQGEDLVFVVKKKIK

DIGVKIGDYEEVASAIRGRITDKQPKWYPMEMKDKIEQLQSKNEAALQKY

KESLVQAAAVLEESNRKLIESGKKPIQLSEKTISKKALELVGGYYYLISN

NKRTKTFVVKEPSNEVKGFAFDTGSNLCLDFYHDAQGKLCGEIIRKIQAM

NPSYKPAYMKQGYSLYVRLYQGDVCELRASDLTEAESNLAKTTHVRLPNA

-continued

KPGRTFVIIITFTEMGSGYQIYFSNLAKSKKGQDTSFTLTTIKNYDVRKV

QLSSAGLVRYVSPLLVDKIEKDEVALCGE

SEQ ID NO: 371

MNQKFILGLDIGITSVGYGLIDYETKNIIDAGVRLFPEANVENNEGRRSK
RGSRRLKRRRIHRLERVKKLLEDYNLLDQSQIPQSTNPYAIRVKGLSEAL
SKDELVIALLHIAKRRGIHKIDVIDSNDDVGNELSTKEQLNKNSKLLKDK
FVCQIQLERMNEGQVRGEKNRFKTADIIKEIIQLLNVQKNFHQLDENFIN
KYIELVEMRREYFEGPGKGSPYGWEGDPKAWYETLMGHCTYFPDELRSVK
YAYSADLFNALNDLNNLVIQRDGLSKLEYHEKYHIIENVFKQKKKPTLKQ
IANEINVNPEDIKGYRITKSGKPQFTEFKLYHDLKSVLFDQSILENEDVL
DQIAEILTIYQDKDSIKSKLTELDILLNEEDKENIAQLTGYTGTHRLSLK
CIRLVLEEQWYSSRNQMEIFTHLNIKPKKINLTAANKIPKAMIDEFILSP
VVKRTFGQAINLINKIIEKYGVPEDIIIELARENNSKDKQKFINEMQKKN
ENTRKRINEIIGKYGNQNAKRLVEKIRLHDEQEGKCLYSLESIPLEDLLN
NPNHYEVDHIIPRSVSFDNSYHNKVLVKQSENSKKSNLTPYQYFNSGKSK
LSYNQFKQHILNLSKSQDRISKKKKEYLLEERDINKFEVQKEFINRNLVD
TRYATRELTNYLKAYFSANNMNVKVKTINGSFTDYLRKVWKFKKERNHGY
KHHAEDALIIANADFLFKENKKLKAVNSVLEKPEIESKQLDIQVDSEDNY
SEMFIIPKQVQDIKDFRNFKYSHRVDKKPNRQLINDTLYSTRKKDNSTYI
VQTIKDIYAKDNTTLKKQFDKSPEKFLMYQHDPRTFEKLEVIMKQYANEK
NPLAKYHEETGEYLTKYSKKNNGPIVKSLKYIGNKLGSHLDVTHQFKSST
KKLVKLSIKPYRFDVYLTDKGYKFITISYLDVLKKDNYYYIPEQKYDKLK
LGKAIDKNAKFIASFYKNDLIKLDGEIYKIIGVNSDTRNMIELDLPDIRY
KEYCELNNIKGEPRIKKTIGKKVNSIEKLTTDVLGNVFTNTQYTKPQLLF
KRGN

SEQ ID NO: 372

MIMKLEKWRLGLDLGTNSIGWSVFSLDKDNSVQDLIDMGVRIFSDGRDPK
TKEPLAVARRTARSQRKLIYRRKLRRKQVFKFLQEQGLFPKTKEECMTLK
SLNPYELRIKALDEKLEPYELGRALFNLAVRRGFKSNRKDGSREEVSEKK
SPDEIKTQADMQTHLEKAIKENGCRTITEFLYKNQGENGGIRFAPGRMTY
YPTRKMYEEEFNLIRSKQEKYYPQVDWDDIYKAIFYQRPLKPQQRGYCIY
ENDKERTFKAMPCSQKLRILQDIGNLAYYEGGSKKRVELNDNQDKVLYEL
LNSKDKVTFDQMRKALCLADSNSFNLEENRDFLIGNPTAVKMRSKNRFGK
LWDEIPLEEQDLIIETIITADEDDAVYEVIKKYDLTQEQRDFIVKNTILQ
SGTSMLCKEVSEKLVKRLEEIADLKYHEAVESLGYKFADQTVEKYDLLPY
YGKVLPGSTMEIDLSAPETNPEKHYGKISNPTVHVALNQTRVVVNALIKE
YGKPSQIAIELSRDLKNNVEKKAEIARKQNQRAKENIAINDTISALYHTA
FPGKSFYPNRNDRMKYRLWSELGLGNKCIYCGKGISGAELFTKEIEIEHI
LPFSRTLLDAESNLTVAHSSCNAFKAERSPFEAFGTNPSGYSWQEIIQRA
NQLKNTSKKNKFSPNAMDSFEKDSSFIARQLSDNQYIAKAALRYLKCLVE
NPSDVWTTNGSMTKLLRDKWEMDSILCRKFTEKEVALLGLKPEQIGNYKK
NRFDHRHHAIDAVVIGLTDRSMVQKLATKNSHKGNRIEIPEFPILRSDLI

-continued

EKVKNIVVSFKPDHGAEGKLSKETLLGKIKLHGKETFVCRENIVSLSEKN
LDDIVDEIKSKVKDYVAKHKGQKIEAVLSDFSKENGIKKVRCVNRVQTPI
EITSGKISRYLSPEDYFAAVIWEIPGEKKTFKAQYIRRNEVEKNSKGLNV
VKPAVLENGKPHPAAKQVCLLHKDDYLEFSDKGKMYFCRIAGYAATNNKL
DIRPVYAVSYCADWINSTNETMLTGYWKPTPTQNWVSVNVLFDKQKARLV
TVSPIGRVFRK

SEQ ID NO: 373

MSSKAIDSLEQLDLFKPQEYTLGLDLGIKSIGWAILSGERIANAGVYLFE
TAEELNSTGNKLISKAAERGRKRRIRRMLDRKARRGRHIRYLLEREGLPT
DELEEVVVHQSNRTLWDVRAEAVERKLTKQELAAVLFHLVRHRGYFPNTK
KLPPDDESDSADEEQGKINRATSRLREELKASDCKTIGQFLAQNRDRQRN
REGDYSNLMARKLVFEEALQILAFQRKQGHELSKDFEKTYLDVLMGQRSG
RSPKLGNCSLIPSELRAPSSAPSTEWFKFLQNLGNLQISNAYREEWSIDA
PRRAQIIDACSQRSTSSYWQIRRDFQIPDEYRFNLVNYERRDPDVDLQEY
LQQQERKTLANFRNWKQLEKIIGTGHPIQTLDEAARLITLIKDDEKLSDQ
LADLLPEASDKAITQLCELDFTTAAKISLEAMYRILPHMNQGMGFFDACQ
QESLPEIGVPPAGDRVPPFDEMYNPVVNRVLSQSRKLINAVIDEYGMPAK
IRVELARDLGKGRELRERIKLDQLDKSKQNDQRAEDFRAEFQQAPRGDQS
LRYRLWKEQNCTCPYSGRMIPVNSVLSEDTQIDHILPISQSFDNSLSNKV
LCFTEENAQKSNRTPFEYLDAADFQRLEAISGNWPEAKRNKLLHKSFGKV
AEEWKSRALNDTRYLTSALADHLRHHLPDSKIQTVNGRITGYLRKQWGLE
KDRDKHTHHAVDAIVVACTTPAIVQQVTLYHQDIRRYKKLGEKRPTPWPE
TFRQDVLDVEEEIFITRQPKKVSGGIQTKDTLRKHRSKPDRQRVALTKVK
LADLERLVEKDASNRNLYEHLKQCLEESGDQPTKAFKAPFYMPSGPEAKQ
RPILSKVTLLREKPEPPKQLTELSGGRRYDSMAQGRLDIYRYKPGGKRKD
EYRVVLQRMIDLMRGEENVHVFQKGVPYDQGPEIEQNYTFLFSLYFDDLV
EFQRSADSEVIRGYYRTFNIANGQLKISTYLEGRQDFDFFGANRLAHFAK
VQVNLLGKVIK

SEQ ID NO: 374

MRSLRYRLALDLGSTSLGWALFRLDACNRPTAVIKAGVRIFSDGRNPKDG
SSLAVTRRAARAMRRRRDRLLKRKTRMQAKLVEHGFFPADAGKRKALEQL
NPYALRAKGLQEALLPGEFARALFHINQRRGFKSNRKTDKKDNDSGVLKK
AIGQLRQQMAEQGSRTVGEYLWTRLQQGQGVRARYREKPYTTEEGKKRID
KSYDLYIDRAMIEQEFDALWAAQAAFNPTLFHEAARADLKDTLLHQRPLR
PVKPGRCTLLPEEERAPLALPSTQRFRIHQEVNHLRLLDENLREVALTLA
QRDAVVTALETKAKLSFEQIRKLLKLSGSVQFNLEDAKRTELKGNATSAA
LARKELFGAAWSGFDEALQDEIVWQLVTEEGEGALIAWLQTHTGVDEARA
QAIVDVSLPEGYGNLSRKALARIVPALRAAVITYDKAVQAAGFDHHSQLG
FEYDASEVEDLVHPETGEIRSVFKQLPYYGKALQRHVAFGSGKPEDPDEK
RYGKIANPTVHIGLNQVRMVVNALIRRYGRPTEVVIELARDLKQSREQKV
EAQRRQADNQRRNARIRRSIAEVLGIGEERVRGSDIQKWICWEELSFDAA

-continued

DRRCPYSGVQISAAMLLSDEVEVEHILPFSKTLDDSLNNRTVAMRQANRI
KRNRTPWDARAEFEAQGWSYEDILQRAERMPLRKRYRFAPDGYERWLGDD
KDFLARALNDTRYLSRVAAEYLRLVCPGTRVIPGQLTALLRGKFGLNDVL
GLDGEKNRNDHRHHAVDACVIGVTDQGLMQRFATASAQARGDGLTRLVDG
MPMPWPTYRDHVERAVRHIWVSHRPDHGFEGAMMEETSYGIRKDGSIKQR
RKADGSAGREISNLIRIHEATQPLRHGVSADGQPLAYKGYVGGSNYCIEI
TVNDKGKWEGEVISTFRAYGVVRAGGMGRLRNPHEGQNGRKLIMRLVIGD
SVRLEVDGAERTMRIVKISGSNGQIFMAPIHEANVDARNTDKQDAFTYTS
KYAGSLQKAKTRRVTISPIGEVRDPGFKG

SEQ ID NO: 375

MARPAFRAPRREHVNGWTPDPHRISKPFFILVSWHLLSRVVIDSSSGCFP
GTSRDHTDKFAEWECAVQPYRLSFDLGTNSIGWGLLNLDRQGKPREIRAL
GSRIFSDGRDPQDKASLAVARRLARQMRRRRDRYLTRRTRLMGALVRFGL
MPADPAARKRLEVAVDPYLARERATRERLEPFEIGRALFHLNQRRGYKPV
RTATKPDEEAGKVKEAVERLEAAIAAAGAPTLGAWFAWRKTRGETLRARL
AGKGKEAAYPFYPARRMLEAEFDTLWAEQARHHPDLLTAEAREILRHRIF
HQRPLKPPPVGRCTLYPDDGRAPRALPSAQRLRLFQELASLRVIHLDLSE
RPLTPAERDRIVAFVQGRPPKAGRKPGKVQKSVPFEKLRGLLELPPGTGF
SLESDKRPELLGDETGARIAPAFGPGWTALPLEEQDALVELLLTEAEPER
AIAALTARWALDEATAAKLAGATLPDFHGRYGRRAVAELLPVLERETRGD
PDGRVRPIRLDEAVKLLRGGKDHSDFSREGALLDALPYYGAVLERHVAFG
TGNPADPEEKRVGRVANPTVHIALNQLRHLVNAILARHGRPEEIVIELAR
DLKRSAEDRRREDKRQADNQKRNEERKRLILSLGERPTPRNLLKLRLWEE
QGPVENRRCPYSGETISMRMLLSEQVDIDHILPFSVSLDDSAANKVVCLR
EANRIKRNRSPWEAFGHDSERWAGILARAEALPKNKRWRFAPDALEKLEG
EGGLRARHLNDTRHLSRLAVEYLRCVCPKVRVSPGRLTALLRRRWGIDAI
LAEADGPPPEVPAETLDPSPAEKNRADHRHHALDAVVIGCIDRSMVQRVQ
LAAASAEREAAAREDNIRRVLEGFKEEPWDGFRAELERRARTIVVSHRPE
HGIGGALHKETAYGPVDPPEEGFNLVVRKPIDGLSKDEINSVRDPRLRRA
LIDRLAIRRRDANDPATALAKAAEDLAAQPASRGIRRVRVLKKESNPIRV
EHGGNPSGPRSGGPFHKLLLAGEVHHVDVALRADGRRWVGHWVTLFEAHG
GRGADGAAAPPRLGDGERFLMRLHKGDCLKLEHKGRVRVMQVVKLEPSSN
SVVVVEPHQVKTDRSKHVKISCDQLRARGARRVTVDPLGRVRVHAPGARV
GIGGDAGRTAMEPAEDIS

SEQ ID NO: 376

MKRTSLRAYRLGVDLGANSLGWFVVWLDDHGQPEGLGPGGVRIFPDGRNP
QSKQSNAAGRRLARSARRRRDRYLQRRGKLMGLLVKHGLMPADEPARKRL
ECLDPYGLRAKALDEVLPLHHVGRALFHLNQRRGLFANRAIEQGDKDASA
IKAAAGRLQTSMQACGARTLGEFLNRRHQLRATVRARSPVGGDVQARYEF
YPTRAMVDAEFEAIWAAQAPHHPTMTAEAHDTIREAIFSQRAMKRPSIGK
CSLDPATSQDDVDGFRCAWSHPLAQRFRIWQDVRNLAVVETGPTSSRLGK
EDQDKVARALLQTDQLSFDEIRGLLGLPSDARFNLESDRRDHLKGDATGA

-continued

ILSARRHFGPAWHDRSLDRQIDIVALLESALDEAAIIASLGTTHSLDEAA
AQRALSALLPDGYCRLGLRAIKRVLPLMEAGRTYAEAASAAGYDHALLPG
GKLSPTGYLPYYGQWLQNDVVGSDDERDTNERRWGRLPNPTVHIGIGQLR
RVVNELIRWHGPPAEITVELTRDLKLSPRRLAELEREQAENQRKNDKRTS
LLRKLGLPASTHNLLKLRLWDEQGDVASECPYTGEAIGLERLVSDDVDID
HLIPFSISWDDSAANKVVCMRYANREKGNRTPFEAFGHRQGRPYDWADIA
ERAARLPRGKRWRFGPGARAQFEELGDFQARLLNETSWLARVAKQYLAAV
THPHRIHVLPGRLTALLRATWELNDLLPGSDDRAAKSRKDHRHHAIDALV
AALTDQALLRRMANAHDDTRRKIEVLLPWPTFRIDLETRLKAMLVSHKPD
HGLQARLHEDTAYGTVEHPETEDGANLVYRKTFVDISEKEIDRIRDRRLR
DLVRAHVAGERQQGKTLKAAVLSFAQRRDIAGHPNGIRHVRLTKSIKPDY
LVPIRDKAGRIYKSYNAGENAFVDILQAESGRWIARATTVFQANQANESH
DAPAAQPIMRVFKGDMLRIDHAGAEKFVKIVRLSPSNNLLYLVEHHQAGV
FQTRHDDPEDSFRWLFASFDKLREWNAELVRIDTLGQPWRRKRGLETGSE
DATRIGWTRPKKWP

SEQ ID NO: 377

MERIFGFDIGTTSIGFSVIDYSSTQSAGNIQRLGVRIFPEARDPDGTPLN
QQRRQKRMMRRQLRRRRIRRKALNETLHEAGFLPAYGSADWPVVMADEPY
ELRRRGLEEGLSAYEFGRAIYHLAQHRHFKGRELEESDTPDPDVDDEKEA
ANERAATLKALKNEQTTLGAWLARRPPSDRKRGIHAHRNVVAEEFERLWE
VQSKFHPALKSEEMRARISDTIFAQRPVFWRKNTLGECRFMPGEPLCPKG
SWLSQQRRMLEKLNNLAIAGGNARPLDAEERDAILSKLQQQASMSWPGVR
SALKALYKQRGEPGAEKSLKFNLELGGESKLLGNALEAKLADMFGPDWPA
HPRKQEIRHAVHERLWAADYGETPDKKRVIILSEKDRKAHREAAANSFVA
DFGITGEQAAQLQALKLPTGWEPYSIPALNLFLAELEKGERFGALVNGPD
WEGWRRTNFPHRNQPTGEILDKLPSPASKEERERISQLRNPTVVRTQNEL
RKVVNNLIGLYGKPDRIRIEVGRDVGKSKREREEIQSGIRRNEKQRKKAT
EDLIKNGIANPSRDDVEKWILWKEGQERCPYTGDQIGFNALFREGRYEVE
HIWPRSRSFDNSPRNKTLCRKDVNIEKGNRMPFEAFGHDEDRWSAIQIRL
QGMVSAKGGTGMSPGKVKRFLAKTMPEDFAARQLNDTRYAAKQILAQLKR
LWPDMGPEAPVKVEAVTGQVTAQLRKLWTLNNILADDGEKTRADHRHHAI
DALTVACTHPGMTNKLSRYWQLRDDPRAEKPALTPPWDTIRADAEKAVSE
IVVSHRVRKKVSGPLHKETTYGDTGTDIKTKSGTYRQFVTRKKIESLSKG
ELDEIRDPRIKEIVAAHVAGRGGDPKKAFPPYPCVSPGGPEIRKVRLTSK
QQLNLMAQTGNGYADLGSNHHIAIYRLPDGKADFEIVSLFDASRRLAQRN
PIVQRTRADGASFVMSLAAGEAIMIPEGSKKGIWIVQGVWASGQVVLERD
TDADHSTTTRPMPNPILKDDAKKVSIDPIGRVRPSND

SEQ ID NO: 378

MNKRILGLDTGTNSLGWAVVDWDEHAQSYELIKYGDVIFQEGVKIEKGIE
SSKAAERSGYKAIRKQYFRRRLRKIQVLKVLVKYHLCPYLSDDDLRQWHL
QKQYPKSDELMLWQRTSDEEGKNPYYDRHRCLHEKLDLTVEADRYTLGRA

-continued

LYHLTQRRGFLSNRLDTSADNKEDGVVKSGISQLSTEMEEAGCEYLGDYF
YKLYDAQGNKVRIRQRYTDRNKHYQHEFDAICEKQELSSELIEDLQRAIF
FQLPLKSQRHGVGRCTFERGKPRCADSHPDYEEFRMLCFVNNIQVKGPHD
LELRPLTYEEREKIEPLFFRKSKPNFDFEDIAKALAGKKNYAWIHDKEER
AYKFNYRMTQGVPGCPTIAQLKSIFGDDWKTGIAETYTLIQKKNGSKSLQ
EMVDDVWNVLYSFSSVEKLKEFAHHKLQLDEESAEKFAKIKLSHSFAALS
LKAIRKFLPFLRKGMYYTHASFFANIPTIVGKEIWNKEQNRKYIMENVGE
LVFNYQPKHREVQGTIEMLIKDFLANNFELPAGATDKLYHPSMIETYPNA
QRNEFGILQLGSPRTNAIRNPMAMRSLHILRRVVNQLLKESIIDENTEVH
VEYARELNDANKRRAIADRQKEQDKQHKKYGDEIRKLYKEETGKDIEPTQ
TDVLKFQLWEEQNHHCLYTGEQIGITDFIGSNPKFDIEHTIPQSVGGDST
QMNLTLCDNRFNREVKKAKLPTELANHEEILTRIEPWKNKYEQLVKERDK
QRTFAGMDKAVKDIRIQKRHKLQMEIDYWRGKYERFTMTEVPEGFSRRQG
TGIGLISRYAGLYLKSLFHQADSRNKSNVYVVKGVATAEFRKMWGLQSEY
EKKCRDNHSHHCMDAITIACIGKREYDLMAEYYRMEETFKQGRGSKPKFS
KPWATFTEDVLNIYKNLLVVHDTPNNMPKHTKKYVQTSIGKVLAQGDTAR
GSLHLDTYYGAIERDGEIRYVVRRPLSSFTKPEELENIVDETVKRTIKEA
IADKNFKQAIAEPIYMNEEKGILIKKVRCFAKSVKQPINIRQHRDLSKKE
YKQQYHVMNENNYLLAIYEGLVKNKVVREFEIVSYIEAAKYYKRSQDRNI
FSSIVPTHSTKYGLPLKTKLLMGQLVLMFEENPDEIQVDNTKDLVKRLYK
VVGIEKDGRIKFKYHQEARKEGLPIFSTPYKNNDDYAPIFRQSINNINIL
VDGIDFTIDILGKVTLKE

SEQ ID NO: 379

MNYKMGLDIGIASVGWAVINLDLKRIEDLGVRIFDKAEHPQNGESLALPR
RIARSARRRLRRRKHRLERIRRLLVSENVLTKEEMNLLFKQKKQIDVWQL
RVDALERKLNNDELARVLLHLAKRRGFKSNRKSERNSKESSEFLKNIEEN
QSILAQYRSVGEMIVKDSKFAYHKRNKLDSYSNMIARDDLEREIKLIFEK
QREFNNPVCTERLEEKYLNIWSSQRPFASKEDIEKKVGFCTFEPKEKRAP
KATYTFQSFIVWEHINKLRLVSPDETRALTEIERNLLYKQAFSKNKMTYY
DIRKLLNLSDDIHFKGLLYDPKSSLKQIENIRFLELDSYHKIRKCIENVY
GKDGIRMFNETDIDTFGYALTIFKDDEDIVAYLQNEYITKNGKRVSNLAN
KVYDKSLIDELLNLSFSKFAHLSMKAIRNILPYMEQGEIYSKACELAGYN
FTGPKKKEKALLLPVIPNIANPVVMRALTQSRKVVNAIIKKYGSPVSIHI
ELARDLSHSFDERKKIQKDQTENRKKNETAIKQLIEYELTKNPTGLDIVK
FKLWSEQQGRCMYSLKPIELERLLEPGYVEVDHILPYSRSLDDSYANKVL
VLTKENREKGNHTPVEYLGLGSERWKKFEKFVLANKQFSKKKKQNLLRLR
YEETEEKEFKERNLNDTRYISKFFANFIKEHLKFADGDGGQKVYTINGKI
TAHLRSRWDFNKNREESDLHHAVDAVIVACATQGMIKKITEFYKAREQNK
ESAKKKEPIFPQPWPHFADELKARLSKFPQESIEAFALGNYDRKKLESLR
PVFVSRMPKRSVTGAAHQETLRRCVGIDEQSGKIQTAVKTKLSDIKLDKD
GHFPMYQKESDPRTYEAIRQRLLEHNNDPKKAFQEPLYKPKKNGEPGPVI

-continued

RTVKIIDTKNKVVHLDGSKTVAYNSNIVRTDVFEKDGKYYCVPVYTMDIM
KGTLPNKAIEANKPYSEWKEMTEEYTFQFSLFPNDLVRIVLPREKTIKTS
TNEEIIIKDIFAYYKTIDSATGGLELISHDRNFSLRGVGSKTLKRFEKYQ
VDVLGNIHKVKGEKRVGLAAPTNQKKGKTVDSLQSVSD

SEQ ID NO: 380

MRRLGLDLGTNSIGWCLLDLGDDGEPVSIFRTGARIFSDGRDPKSLGSLK
ATRREARLTRRRRDRFIQRQKNLINALVKYGLMPADEIQRQALAYKDPYP
IRKKALDEAIDPYEMGRAIFHINQRRGFKSNRKSADNEAGVVKQSIADLE
MKLGEAGARTIGEFLADRQATNDTVRARRLSGTNALYEFYPDRYMLEQEF
DTLWAKQAAFNPSLYIEAARERLKEIVFFQRKLKPQEVGRCIFLSDEDRI
SKALPSFQRFRIYQELSNLAWIDHDGVAHRITASLALRDHLFDELEHKKK
LTFKAMRAILRKQGVVDYPVGFNLESDNRDHLIGNLTSCIMRDAKKMIGS
AWDRLDEEEQDSFILMLQDDQKGDDEVRSILTQQYGLSDDVAEDCLDVRL
PDGHGSLSKKAIDRILPVLRDQGLIYYDAVKEAGLGEANLYDPYAALSDK
LDYYGKALAGHVMGASGKFEDSDEKRYGTISNPTVHIALNQVRAVVNELI
RLHGKPDEVVIEIGRDLPMGADGKRELERFQKEGRAKNERARDELKKLGH
IDSRESRQKFQLWEQLAKEPVDRCCPFTGKMMSISDLFSDKVEIEHLLPF
SLTLDDSMANKTVCFRQANRDKGNRAPFDAFGNSPAGYDWQEILGRSQNL
PYAKRWRFLPDAMKRFEADGGFLERQLNDTRYISRYTTEYISTIIPKNKI
WVVTGRLTSLLRGFWGLNSILRGHNTDDGTPAKKSRDDHRHHAIDAIVVG
MTSRGLLQKVSKAARRSEDLDLTRLFEGRIDPWDGFRDEVKKHIDAIIVS
HRPRKKSQGALHNDTAYGIVEHAENGASTVVHRVPITSLGKQSDIEKVRD
PLIKSALLNETAGLSGKSFENAVQKWCADNSIKSLRIVETVSIIPITDKE
GVAYKGYKGDGNAYMDIYQDPTSSKWKGEIVSRFDANQKGFIPSWQSQFP
TARLIMRLRINDLLKLQDGEIEEIYRVQRLSGSKILMAPHTEANVDARDR
DKNDTFKLTSKSPGKLQSASARKVHISPTGLIREG

SEQ ID NO: 381

MKNILGLDLGLSSIGWSVIRENSEEQELVAMGSRVVSLTAAELSSFTQGN
GVSINSQRTQKRTQRKGYDRYQLRRTLLRNKLDTLGMLPDDSLSYLPKLQ
LWGLRAKAVTQRIELNELGRVLLHLNQKRGYKSIKSDFSGDKKITDYVKT
VKTRYDELKEMRLTIGELFFRRLTENAFFRCKEQVYPRQAYVEEFDCIMN
CQRKFYPDILTDETIRCIRDEIIYYQRPLKSCKYLVSRCEFEKRFYLNAA
GKKTEAGPKVSPRTSPLFQVCRLWESINNIVVKDRRNEIVFISAEQRAAL
FDFLNTHEKLKGSDLLKLLGLSKTYGYRLGEQFKTGIQGNKTRVEIERAL
GNYPDKKRLLQFNLQEESSSMVNTETGEIIPMISLSFEQEPLYRLWHVLY
SIDDREQLQSVLRQKFGIDDDEVLERLSAIDLVKAGFGNKSSKAIRRILP
FLQLGMNYAEACEAAGYNHSNNYTKAENEARALLDRLPAIKKNELRQPVV
EKILNQMVNVVNALMEKYGRFDEIRVELARELKQSKEERSNTYKSINKNQ
RENEQIAKRIVEYGVPTRSRIQKYKMWEESKHCCIYCGQPVDVGDFLRGF
DVEVEHIIPKSLYFDDSFANKVCSCRSCNKEKNNRTAYDYMKSKGEKALS
DYVERVNTMYTNNQISKTKWQNLLTPVDKISIDFIDRQLRESQYIARKAK
EILTSICYNVTATSGSVTSFLRHVWGWDTVLHDLNFDRYKKVGLTEVIEV

-continued

NHRGSVIRREQIKDWSKRFDHRHHAIDALTIACTKQAYIQRLNNLRAEEG
PDFNKMSLERYIQSQPHFSVAQVREAVDRILVSFRAGKRAVTPGKRYIRK
NRKRISVQSVLIPRGALSEESVYGVIHVWEKDEQGHVIQKQRAVMKYPIT
SINREMLDKEKVVDKRIHRILSGRLAQYNDNPKEAFAKPVYIDKECRIPI
RTVRCFAKPAINTLVPLKKDDKGNPVAWVNPGNNHHVAIYRDEDGKYKER
TVTFWEAVDRCRVGIPAIVTQPDTIWDNILQRNDISENVLESLPDVKWQF
VLSLQQNEMFILGMNEEDYRYAMDQQDYALLNKYLYRVQKLSKSDYSFRY
HTETSVEDKYDGKPNLKLSMQMGKLKRVSIKSLLGLNPHKVHISVLGEIK
EIS

SEQ ID NO: 382
MAEKQHRWGLDIGTNSIGWAVIALIEGRPAGLVATGSRIFSDGRNPK
DGSSLAVERRGPRQMRRRRDRYLRRRDRFMQALINVGLMPGDAAARKALV
TENPYVLRQRGLDQALTLPEFGRALFHLNQRRGFQSNRKTDRATAKESGK
VKNAIAAFRAGMGNARTVGEALARRLEDGRPVRARMVGQGKDEHYELYIA
REWIAQEFDALWASQQRFHAEVLADAARDRLRAILLFQRKLLPVPVGKCF
LEPNQPRVAAALPSAQRFRLMQELNHLRVMTLADKRERPLSFQERNDLLA
QLVARPKCGFDMLRKIVFGANKEAYRFTIESERRKELKGCDTAAKLAKVN
ALGTRWQALSLDEQDRLVCLLLDGENDAVLADALREHYGLTDAQIDTLLG
LSFEDGHMRLGRSALLRVLDALESGRDEQGLPLSYDKAVVAAGYPAHTAD
LENGERDALPYYGELLWRYTQDAPTAKNDAERKFGKIANPTVHIGLNQLR
KLVNALIQRYGKPAQIVVELARNLKAGLEEKERIKKQQTANLERNERIRQ
KLQDAGVPDNRENRLRMRLFEELGQGNGLGTPCIYSGRQISLQRLFSNDV
QVDHILPFSKTLDDSFANKVLAQHDANRYKGNRGPFEAFGANRDGYAWDD
IRARAAVLPRNKRNRFAETAMQDWLHNETDFLARQLTDTAYLSRVARQYL
TAICSKDDVYVSPGRLTAMLRAKWGLNRVLDGVMEEQGRPAVKNRDDHRH
HAIDAVVIGATDRAMLQQVATLAARAREQDAERLIGDMPTPWPNFLEDVR
AAVARCVVSHKPDHGPEGGLHNDTAYGIVAGPFEDGRYRVRHRVSLFDLK
PGDLSNVRCDAPLQAELEPIFEQDDARAREVALTALAERYRQRKVWLEEL
MSVLPIRPRGEDGKTLPDSAPYKAYKGDSNYCYELFINERGRWDGELIST
FRANQAAYRRFRNDPARFRRYTAGGRPLLMRLCINDYIAVGTAAERTIFR
VVKMSENKITLAEHFEGGTLKQRDADKDDPFKYLTKSPGALRDLGARRIF
VDLIGRVLDPGIKGD

SEQ ID NO: 383
MIERILGVDLGISSLGWAIVEYDKDDEAANRIIDCGVRLFTAAETPKKKE
SPNKARREARGIRRVLNRRRVRMNMIKKLFLRAGLIQDVDLDGEGGMFYS
KANRADVWELRHDGLYRLLKGDELARVLIHIAKHRGYKFIGDDEADEESG
KVKKAGVVLRQNFEAAGCRTVGEWLWRERGANGKKRNKHGDYEISIHRDL
LVEEVEAIFVAQQEMRSTIATDALKAAYREIAFFVRPMQRIEKMVGHCTY
FPEERRAPKSAPTAEKFIAISKFFSTVIIDNEGWEQKIIERKTLEELLDF
AVSREKVEFRHLRKFLDLSDNEIFKGLHYKGKPKTAKKREATLFDPNEPT
ELEFDKVEAEKKAWISLRGAAKLREALGNEFYGRFVALGKHADEATKILT

-continued

YYKDEGQKRRELTKLPLEAEMVERLVKIGFSDFLKLSLKAIRDILPAMES
GARYDEAVLMLGVPHKEKSAILPPLNKTDIDILNPTVIRAFAQFRKVANA
LVRKYGAFDRVHFELAREINTKGEIEDIKESQRKNEKERKEAADWIAETS
FQVPLTRKNILKKRLYIQQDGRCAYTGDVIELERLFDEGYCEIDHILPRS
RSADDSFANKVLCLARANQQKTDRTPYEWFGHDAARWNAFETRTSAPSNR
VRTGKGKIDRLLKKNFDENSEMAFKDRNLNDTRYMARAIKTYCEQYWVFK
NSHTKAPVQVRSGKLTSVLRYQWGLESKDRESHTHHAVDAIIIAFSTQGM
VQKLSEYYRFKETHREKERPKLAVPLANFRDAVEEATRIENTETVKEGVE
VKRLLISRPPRARVTGQAHEQTAKPYPRIKQVKNKKKWRLAPIDEEKFES
FKADRVASANQKNFYETSTIPRVDVYHKKGKFHLVPIYLHEMVLNELPNL
SLGTNPEAMDENFFKFSIFKDDLISIQTQGTPKKPAKIIMGYFKNMHGAN
MVLSSINNSPCEGFTCTPVSMDKKHKDKCKLCPEENRIAGRCLQGFLDYW
SQEGLRPPRKEFECDQGVKFALDVKKYQIDPLGYYYEVKQEKRLGTIPQM
RSAKKLVKK

SEQ ID NO: 384
MNNSIKSKPEVTIGLDLGVGSVGWAIVDNETNIIHHLGSRLFSQAKTAED
RRSFRGVRRLIRRRKYKLKRFVNLIWKYNSYFGFKNKEDILNNYQEQQKL
HNTVLNLKSEALNAKIDPKALSWILHDYLKNRGHFYEDNRDFNVYPTKEL
AKYFDKYGYYKGIIDSKEDNDNKLEEELTKYKFSNKHWLEEVKKVLSNQT
GLPEKFKEEYESLFSYVRNYSEGPGSINSVSPYGIYHLDEKEGKVVQKYN
NIWDKTIGKCNIFPDEYRAPKNSPIAMIFNEINELSTIRSYSIYLTGWFI
NQEFKKAYLNKLLDLLIKTNGEKPIDARQFKKLREETIAESIGKETLKDV
ENEEKLEKEDHKWKLKGLKLNTNGKIQYNDLSSLAKFVHKLKQHLKLDFL
LEDQYATLDKINFLQSLFVYLGKHLRYSNRVDSANLKEFSDSNKLFERIL
QKQKDGLFKLFEQTDKDDEKILAQTHSLSTKAMLLAITRMTNLDNDEDNQ
KNNDKGWNFEAIKNFDQKFIDITKKNNNLSLKQNKRYLDDRFINDAILSP
GVKRILREATKVFNAILKQFSEEYDVTKVVIELARELSEEKELENTKNYK
KLIKKNGDKISEGLKALGISEDEIKDILKSPTKSYKFLLWLQQDHIDPYS
LKEIAFDDIFTKTEKFEIDHIIPYSISFDDSSSNKLLVLAESNQAKSNQT
PYEFISSGNAGIKWEDYEAYCRKFKDGDSSLLDSTQRSKKFAKMMKTDTS
SKYDIGFLARNLNDTRYATIVFRDALEDYANNHLVEDKPMFKVVCINGSV
TSFLRKNFDDSSYAKKDRDKNIHHAVDASIISIFSNETKTLFNQLTQFAD
YKLFKNTDGSWKKIDPKTGVVTEVTDENWKQIRVRNQVSEIAKVIEKYIQ
DSNIERKARYSRKIENKTNISLFNDTVYSAKKVGYEDQIKRKNLKTLDIH
ESAKENKNSKVKRQFVYRKLVNVSLLNNDKLADLFAEKEDILMYRANPWV
INLAEQIFNEYTENKKIKSQNVFEKYMLDLTKEFPEKFSEFLVKSMLRNK
TAIIYDDKKNIVHRIKRLKMLSSELKENKLSNVIIRSKNQSGTKLSYQDT
INSLALMIMRSIDPTAKKQYIRVPLNTLNLHLGDHDFDLHNMDAYLKKPK
FVKYLKANEIGDEYKPWRVLTSGTLLIHKKDKKLMYISSFQNLNDVIEIK
NLIETEYKENDDSDSKKKKKANRFLMTLSTILNDYILLDAKDNFDILGLS
KNRIDEILNSKLGLDKIVK

-continued

SEQ ID NO: 385

```
MGGSEVGTVPVTWRLGVDVGERSIGLAAVSYEEDKPKEILAAVSWIHDGG
VGDERSGASRLALRGMARRARRLRRFRRARLRDLDMLLSELGWTPLPDKN
VSPVDAWLARKRLAEEYVVDETERRRLLGYAVSHMARHRGWRNPWTTIKD
LKNLPQPSDSWERTRESLEARYSVSLEPGTVGQWAGYLLQRAPGIRLNPT
QQSAGRRAELSNATAFETRLRQEDVLWELRCIADVQGLPEDVVSNVIDAV
FCQKRPSVPAERIGRDPLDPSQLRASRACLEFQEYRIVAAVANLRIRDGS
GSRPLSLEERNAVIEALLAQTERSLTWSDIALEILKLPNESDLTSVPEED
GPSSLAYSQFAPFDETSARIAEFIAKNRRKIPTFAQWWQEQDRTSRSDLV
AALADNSIAGEEEQELLVHLPDAELEALEGLALPSGRVAYSRLTLSGLTR
VMRDDGVDVHNARKTCFGVDDNWRPPLPALHEATGHPVVDRNLAILRKFL
SSATMRWGPPQSIVVELARGASESRERQAEEEAARRAHRKANDRIRAELR
ASGLSDPSPADLVRARLLELYDCHCMYCGAPISWENSELDHIVPRTDGGS
NRHENLAITCGACNKEKGRRPFASWAETSNRVQLRDVIDRVQKLKYSGNM
YWTRDEFSRYKKSVVARLKRRTSDPEVIQSIESTGYAAVALRDRLLSYGE
KNGVAQVAVFRGGVTAEARRWLDISIERLFSRVAIFAQSTSTKRLDRRHH
AVDAVVLTTLTPGVAKTLADARSRRVSAEFWRRPSDVNRHSTEEPQSPAY
RQWKESCSGLGDLLISTAARDSIAVAAPLRLRPTGALHEETLRAFSEHTV
GAAWKGAELRRIVEPEVYAAFLALTDPGGRFLKVSPSEDVLPADENRHIV
LSDRVLGPRDRVKLFPDDRGSIRVRGGAAYIASFHHARVFRWGSSHSPSF
ALLRVSLADLAVAGLLRDGVDVFTAELPPWTPAWRYASIALVKAVESGDA
KQVGWLVPGDELDFGPEGVTTAAGDLSMFLKYFPERHWVVTGFEDDKRIN
LKPAFLSAEQAEVLRTERSDRPDTLTEAGEILAQFFPRCWRATVAKVLCH
PGLTVIRRTALGQPRWRRGHLPYSWRPWSADPWSGGTP
```

SEQ ID NO: 386

```
MHNKKNITIGFDLGIASIGWAIIDSTTSKILDWGTRTFEERKTANERRAF
RSTRRNIRRKAYRNQRFINLILKYKDLFELKNISDIQRANKKDTENYEKI
ISFFTEIYKKCAAKHSNILEVKVKALDSKIEKLDLIWILHDYLENRGFFY
DLEEENVADKYEGIEHPSILLYDFFKKNGFFKSNSSIPKDLGGYSFSNLQ
WVNEIKKLFEVQEINPEFSEKFLNLFTSVRDYAKGPGSEHSASEYGIFQK
DEKGKVFKKYDNIWDKTIGKCSFFVEENRSPVNYPSYEIFNLLNQLINLS
TDLKTTNKKIWQLSSNDRNELLDELLKVKEKAKIISISLKKNEIKKIILK
DFGFEKSDIDDQDTIEGRKIIKEEPTTKLEVTKHLLATIYSHSSDSNWIN
INNILEFLPYLDAICIILDREKSRGQDEVLKKLTEKNIFEVLKIDREKQL
DFVKSIFSNTKFNFKKIGNFSLKAIREFLPKMFEQNKNSEYLKWKDEEIR
RKWEEQKSKLGKTDKKTKYLNPRIFQDEIISPGTKNTFEQAVLVLNQIIK
KYSKENIIDAIIIESPREKNDKKTIEEIKKRNKKGKGKTLEKLFQILNLE
NKGYKLSDLETKPAKLLDRLRFYHQQDGIDLYTLDKINIDQLINGSQKYE
IEHIIPYSMSYDNSQANKILTEKAENLKKGKLIASEYIKRNGDEFYNKYY
EKAKELFINKYKKNKKLDSYVDLDEDSAKNRFRFLTLQDYDEFQVEFLAR
NLNDTRYSTKLFYHALVEHFENNEFFTYIDENSSKHKVKISTIKGHVTKY
FRAKPVQKNNGPNENLNNNKPEKIEKNRENNEHHAVDAAIVAIIGNKNPQ
```

-continued

```
IANLLTLADNKTDKKFLLHDENYKENIETGELVKIPKFEVDKLAKVEDLK
KIIQEKYEEAKKHTAIKFSRKTRTILNGGLSDETLYGFKYDEKEDKYFKI
IKKKLVTSKNEELKKYFENPFGKKADGKSEYTVLMAQSHLSEFNKLKEIF
EKYNGFSNKTGNAFVEYMNDLALKEPTLKAEIESAKSVEKLLYYNFKPSD
QFTYHDNINNKSFKRFYKNIRIIEYKSIPIKFKILSKHDGGKSFKDTLFS
LYSLVYKVYENGKESYKSIPVTSQMRNFGIDEFDFLDENLYNKEKLDIYK
SDFAKPIPVNCKPVFVLKKGSILKKKSLDIDDFKETKETEEGNYYFISTI
SKRFNRDTAYGLKPLKLSVVKPVAEPSTNPIFKEYIPIHLDELGNEYPVK
IKEHTDDEKLMCTIK
```

Nucleic Acids Encoding Cas9 Molecules

Nucleic acids encoding the Cas9 molecules or Cas9 polypeptides, e.g., an eaCas9 molecule or eaCas9 polypeptide are provided herein.

Exemplary nucleic acids encoding Cas9 molecules are described in Cong et al., SCIENCE 2013, 399(6121):819-823; Wang et al., CELL 2013, 153(4):910-918; Mali et al., SCIENCE 2013, 399(6121):823-826; Jinek et al., SCIENCE 2012, 337 (6096):816-821. Another exemplary nucleic acid encoding a Cas9 molecule or Cas9 polypeptide is shown in black in FIG. 8.

In an embodiment, a nucleic acid encoding a Cas9 molecule or Cas9 polypeptide can be a synthetic nucleic acid sequence. For example, the synthetic nucleic acid molecule can be chemically modified, e.g., as described in Section VIII. In an embodiment, the Cas9 mRNA has one or more (e.g., all of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule or Cas9 polypeptide may comprise a nuclear localization sequence (NLS). Nuclear localization sequences are known in the art.

Provided below is an exemplary codon optimized nucleic acid sequence encoding a Cas9 molecule of *S. pyogenes*.

(SEQ ID NO: 22)

```
ATGGATAAAA AGTACAGCAT CGGGCTGGAC ATCGGTACAA
ACTCAGTGGG GTGGGCCGTG ATTACGGACG AGTACAAGGT
ACCCTCCAAA AAATTTAAAG TGCTGGGTAA CACGGACAGA
CACTCTATAA AGAAAAATCT TATTGGAGCC TTGCTGTTCG
ACTCAGGCGA GACAGCCGAA GCCACAAGGT TGAAGCGGAC
CGCCAGGAGG CGGTATACCA GGAGAAAGAA CCGCATATGC
TACCTGCAAG AAATCTTCAG TAACGAGATG GCAAAGGTTG
ACGATAGCTT TTTCCATCGC CTGGAAGAAT CCTTTCTTGT
TGAGGAAGAC AAGAAGCACG AACGGCACCC CATCTTTGGC
```

-continued

AATATTGTCG ACGAAGTGGC ATATCACGAA AAGTACCCGA
CTATCTACCA CCTCAGGAAG AAGCTGGTGG ACTCTACCGA
TAAGGCGGAC CTCAGACTTA TTTATTTGGC ACTCGCCCAC
ATGATTAAAT TTAGAGGACA TTTCTTGATC GAGGGCGACC
TGAACCCGGA CAACAGTGAC GTCGATAAGC TGTTCATCCA
ACTTGTGCAG ACCTACAATC AACTGTTCGA AGAAAACCCT
ATAAATGCTT CAGGAGTCGA CGCTAAAGCA ATCCTGTCCG
CGCGCCTCTC AAAATCTAGA AGACTTGAGA ATCTGATTGC
TCAGTTGCCC GGGGAAAAGA AAAATGGATT GTTTGGCAAC
CTGATCGCCC TCAGTCTCGG ACTGACCCCA AATTTCAAAA
GTAACTTCGA CCTGGCCGAA GACGCTAAGC TCCAGCTGTC
CAAGGACACA TACGATGACG ACCTCGACAA TCTGCTGGCC
CAGATTGGGG ATCAGTACGC CGATCTCTTT TTGGCAGCAA
AGAACCTGTC CGACGCCATC CTGTTGAGCG ATATCTTGAG
AGTGAACACC GAAATTACTA AAGCACCCCT TAGCGCATCT
ATGATCAAGC GGTACGACGA GCATCATCAG GATCTGACCC
TGCTGAAGGC TCTTGTGAGG CAACAGCTCC CCGAAAAATA
CAAGGAAATC TTCTTTGACC AGAGCAAAAA CGGCTACGCT
GGCTATATAG ATGGTGGGGC CAGTCAGGAG GAATTCTATA
AATTCATCAA GCCCATTCTC GAGAAAATGG ACGGCACAGA
GGAGTTGCTG GTCAAACTTA ACAGGGAGGA CCTGCTGCGG
AAGCAGCGGA CCTTTGACAA CGGGTCTATC CCCCACCAGA
TTCATCTGGG CGAACTGCAC GCAATCCTGA GGAGGCAGGA
GGATTTTTAT CCTTTTCTTA AAGATAACCG CGAGAAAATA
GAAAAGATTC TTACATTCAG GATCCCGTAC TACGTGGGAC
CTCTCGCCCG GGGCAATTCA CGGTTTGCCT GGATGACAAG
GAAGTCAGAG GAGACTATTA CACCTTGGAA CTTCGAAGAA
GTGGTGGACA AGGGTGCATC TGCCCAGTCT TTCATCGAGC
GGATGACAAA TTTTGACAAG AACCTCCCTA ATGAGAAGGT
GCTGCCCAAA CATTCTCTGC TCTACGAGTA CTTTACCGTC
TACAATGAAC TGACTAAAGT CAAGTACGTC ACCGAGGGAA
TGAGGAAGCC GGCATTCCTT AGTGGAGAAC AGAAGAAGGC
GATTGTAGAC CTGTTGTTCA AGACCAACAG GAAGGTGACT
GTGAAGCAAC TTAAAGAAGA CTACTTTAAG AAGATCGAAT
GTTTTGACAG TGTGGAAATT TCAGGGGTTG AAGACCGCTT
CAATGCGTCA TTGGGGACTT ACCATGATCT TCTCAAGATC
ATAAAGGACA AAGACTTCCT GGACAACGAA GAAAATGAGG
ATATTCTCGA AGACATCGTC CTCACCCTGA CCCTGTTCGA
AGACAGGGAA ATGATAGAAG AGCGCTTGAA AACCTATGCC
CACCTCTTCG ACGATAAAGT TATGAAGCAG CTGAAGCGCA
GGAGATACAC AGGATGGGGA AGATTGTCAA GGAAGCTGAT

-continued

CAATGGAATT AGGGATAAAC AGAGTGGCAA GACCATACTG
GATTTCCTCA AATCTGATGG CTTCGCCAAT AGGAACTTCA
TGCAACTGAT TCACGATGAC TCTCTTACCT TCAAGGAGGA
CATTCAAAAG GCTCAGGTGA GCGGGCAGGG AGACTCCCTT
CATGAACACA TCGCGAATTT GGCAGGTTCC CCCGCTATTA
AAAAGGGCAT CCTTCAAACT GTCAAGGTGG TGGATGAATT
GGTCAAGGTA ATGGGCAGAC ATAAGCCAGA AAATATTGTG
ATCGAGATGG CCCGCGAAAA CCAGACCACA CAGAAGGGCC
AGAAAAATAG TAGAGAGCGG ATGAAGAGGA TCGAGGAGGG
CATCAAAGAG CTGGGATCTC AGATTCTCAA AGAACACCCC
GTAGAAAACA CACAGCTGCA GAACGAAAAA TTGTACTTGT
ACTATCTGCA GAACGGCAGA GACATGTACG TCGACCAAGA
ACTTGATATT AATAGACTGT CCGACTATGA CGTAGACCAT
ATCGTGCCCC AGTCCTTCCT GAAGGACGAC TCCATTGATA
ACAAAGTCTT GACAAGAAGC GACAAGAACA GGGGTAAAAG
TGATAATGTG CCTAGCGAGG AGGTGGTGAA AAAAATGAAG
AACTACTGGC GACAGCTGCT TAATGCAAAG CTCATTACAC
AACGGAAGTT CGATAATCTG ACGAAAGCAG AGAGAGGTGG
CTTGTCTGAG TTGGACAAGG CAGGGTTTAT TAAGCGGCAG
CTGGTGGAAA CTAGGCAGAT CACAAAGCAC GTGGCGCAGA
TTTTGGACAG CCGGATGAAC ACAAAATACG ACGAAAATGA
TAAACTGATA CGAGAGGTCA AAGTTATCAC GCTGAAAAGC
AAGCTGGTGT CCGATTTTCG GAAAGACTTC CAGTTCTACA
AAGTTCGCGA GATTAATAAC TACCATCATG CTCACGATGC
GTACCTGAAC GCTGTTGTCG GGACCGCCTT GATAAAGAAG
TACCCAAAGC TGGAATCCGA GTTCGTATAC GGGGATTACA
AAGTGTACGA TGTGAGGAAA ATGATAGCCA AGTCCGAGCA
GGAGATTGGA AAGGCCACAG CTAAGTACTT CTTTTATTCT
AACATCATGA ATTTTTTTAA GACGGAAATT ACCCTGGCCA
ACGGAGAGAT CAGAAAGCGG CCCCTTATAG AGACAAATGG
TGAAACAGGT GAAATCGTCT GGGATAAGGG CAGGGATTTC
GCTACTGTGA GGAAGGTGCT GAGTATGCCA CAGGTAAATA
TCGTGAAAAA AACCGAAGTA CAGACCGGAG GATTTTCCAA
GGAAAGCATT TTGCCTAAAA GAAACTCAGA CAAGCTCATC
GCCCGCAAGA AAGATTGGGA CCCTAAGAAA TACGGGGGAT
TTGACTCACC CACCGTAGCC TATTCTGTGC TGGTGGTAGC
TAAGGTGGAA AAAGGAAAGT CTAAGAAGCT GAAGTCCGTG
AAGGAACTCT TGGGAATCAC TATCATGGAA AGATCATCCT
TTGAAAAGAA CCCTATCGAT TTCCTGGAGG CTAAGGGTTA
CAAGGAGGTC AAGAAAGACC TCATCATTAA ACTGCCAAAA

-continued

TACTCTCTCT TCGAGCTGGA AAATGGCAGG AAGAGAATGT

TGGCCAGCGC CGGAGAGCTG CAAAAGGGAA ACGAGCTTGC

TCTGCCCTCC AAATATGTTA ATTTTCTCTA TCTCGCTTCC

CACTATGAAA AGCTGAAAGG GTCTCCCGAA GATAACGAGC

AGAAGCAGCT GTTCGTCGAA CAGCACAAGC ACTATCTGGA

TGAAATAATC GAACAAATAA GCGAGTTCAG CAAAAGGGTT

ATCCTGGCGG ATGCTAATTT GGACAAAGTA CTGTCTGCTT

ATAACAAGCA CCGGGATAAG CCTATTAGGG AACAAGCCGA

GAATATAATT CACCTCTTTA CACTCACGAA TCTCGGAGCC

CCCGCCGCCT TCAAATACTT TGATACGACT ATCGACCGGA

AACGGTATAC CAGTACCAAA GAGGTCCTCG ATGCCACCCT

CATCCACCAG TCAATTACTG GCCTGTACGA AACACGGATC

GACCTCTCTC AACTGGGCGG CGACTAG

Provided below is the corresponding amino acid sequence of a *S. pyogenes* Cas9 molecule.

(SEQ ID NO: 23)

MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

IKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

-continued

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD*

Provided below is an exemplary codon optimized nucleic acid sequence encoding a Cas9 molecule of *N. meningitidis*.

(SEQ ID NO: 24)

ATGGCCGCCTTCAAGCCCAACCCCATCAACTACATCCTGGGCCTGGACAT

CGGCATCGCCAGCGTGGGCTGGGCCATGGTGGAGATCGACGAGGACGAGA

ACCCCATCTGCCTGATCGACCTGGGTGTGCGCGTGTTCGAGCGCGCTGAG

GTGCCCAAGACTGGTGACAGTCTGGCTATGGCTCGCCGGCTTGCTCGCTC

TGTTCGGCGCCTTACTCGCCGGCGCGCTCACCGCCTTCTGCGCGCTCGCC

GCCTGCTGAAGCGCGAGGGTGTGCTGCAGGCTGCCGACTTCGACGAGAAC

GGCCTGATCAAGAGCCTGCCCAACACTCCTTGGCAGCTGCGCGCTGCCGC

TCTGGACCGCAAGCTGACTCCTCTGGAGTGGAGCGCCGTGCTGCTGCACC

TGATCAAGCACCGCGGCTACCTGAGCCAGCGCAAGAACGAGGGCGAGACC

GCCGACAAGGAGCTGGGTGCTCTGCTGAAGGGCGTGGCCGACAACGCCCA

CGCCCTGCAGACTGGTGACTTCCGCACTCCTGCTGAGCTGGCCCTGAACA

AGTTCGAGAAGGAGAGCGGCCACATCCGCAACCAGCGCGGCGACTACAGC

CACACCTTCAGCCGCAAGGACCTGCAGGCCGAGCTGATCCTGCTGTTCGA

GAAGCAGAAGGAGTTCGGCAACCCCCACGTGAGCGGCGGCCTGAAGGAGG

GCATCGAGACCCTGCTGATGACCCAGCGCCCCGCCCTGAGCGGCGACGCC

GTGCAGAAGATGCTGGGCCACTGCACCTTCGAGCCAGCCGAGCCCAAGGC

CGCCAAGAACACCTACACCGCCGAGCGCTTCATCTGGCTGACCAAGCTGA

ACAACCTGCGCATCCTGGAGCAGGGCAGCGAGCGCCCCCTGACCGACACC

GAGCGCGCCACCCTGATGGACGAGCCCTACCGCAAGAGCAAGCTGACCTA

CGCCCAGGCCCGCAAGCTGCTGGGTCTGGAGGACACCGCCTTCTTCAAGG

GCCTGCGCTACGGCAAGGACAACGCCGAGGCCAGCACCCTGATGGAGATG

AAGGCCTACCACGCCATCAGCCGCGCCCTGGAGAAGGAGGGCCTGAAGGA

CAAGAAGAGTCCTCTGAACCTGAGCCCCGAGCTGCAGGACGAGATCGGCA

CCGCCTTCAGCCTGTTCAAGACCGACGAGGACATCACCGGCCGCCTGAAG

GACCGCATCCAGCCCGAGATCCTGGAGGCCCTGCTGAAGCACATCAGCTT

CGACAAGTTCGTGCAGATCAGCCTGAAGGCCCTGCGCCGCATCGTGCCCC

TGATGGAGCAGGGCAAGCGCTACGACGAGGCCTGCGCCGAGATCTACGGC

GACCACTACGGCAAGAAGAACACCGAGGAGAAGATCTACCTGCCTCCTAT

CCCCGCCGACGAGATCCGCAACCCCGTGGTGCTGCGCGCCCTGAGCCAGG

CCCGCAAGGTGATCAACGGCGTGGTGCGCCGCTACGGCAGCCCCGCCCGC

ATCCACATCGAGACCGCCCGCGAGGTGGGCAAGAGCTTCAAGGACCGCAA

GGAGATCGAGAAGCGCCAGGAGGAGAACCGCAAGGACCGCGAGAAGGCCG

CCGCCAAGTTCCGCGAGTACTTCCCCAACTTCGTGGGCGAGCCCAAGAGC

AAGGACATCCTGAAGCTGCGCCTGTACGAGCAGCAGCACGGCAAGTGCCT

-continued

GTACAGCGGCAAGGAGATCAACCTGGGCCGCCTGAACGAGAAGGGCTACG
TGGAGATCGACCACGCCCTGCCCTTCAGCCGCACCTGGGACGACAGCTTC
AACAACAAGGTGCTGGTGCTGGGCAGCGAGAACCAGAACAAGGGCAACCA
GACCCCCTACGAGTACTTCAACGGCAAGGACAACAGCCGCGAGTGGCAGG
AGTTCAAGGCCCGCGTGGAGACCAGCCGCTTCCCCCGCAGCAAGAAGCAG
CGCATCCTGCTGCAGAAGTTCGACGAGGACGGCTTCAAGGAGCGCAACCT
GAACGACACCCGCTACGTGAACCGCTTCCTGTGCCAGTTCGTGGCCGACC
GCATGCGCCTGACCGGCAAGGGCAAGAAGCGCGTGTTCGCCAGCAACGGC
CAGATCACCAACCTGCTGCGCGGCTTCTGGGGCCTGCGCAAGGTGCGCGC
CGAGAACGACCGCCACCACGCCCTGGACGCCGTGGTGGTGGCCTGCAGCA
CCGTGGCCATGCAGCAGAAGATCACCCGCTTCGTGCGCTACAAGGAGATG
AACGCCTTCGACGGTAAAACCATCGACAAGGAGACCGGCGAGGTGCTGCA
CCAGAAGACCCACTTCCCCCAGCCCTGGGAGTTCTTCGCCCAGGAGGTGA
TGATCCGCGTGTTCGGCAAGCCCGACGGCAAGCCCGAGTTCGAGGAGGCC
GACACCCCCGAGAAGCTGCGCACCCTGCTGGCCGAGAAGCTGAGCAGCCG
CCCTGAGGCCGTGCACGAGTACGTGACTCCTCTGTTCGTGAGCCGCGCCC
CCAACCGCAAGATGAGCGGTCAGGGTCACATGGAGACCGTGAAGAGCGCC
AAGCGCCTGGACGAGGGCGTGAGCGTGCTGCGCGTGCCCCTGACCCAGCT
GAAGCTGAAGGACCTGGAGAAGATGGTGAACCGCGAGCGCGAGCCCAAGC
TGTACGAGGCCCTGAAGGCCCGCCTGGAGGCCCACAAGGACGACCCCGCC
AAGGCCTTCGCCGAGCCCTTCTACAAGTACGACAAGGCCGGCAACCGCAC
CCAGCAGGTGAAGGCCGTGCGCGTGGAGCAGGTGCAGAAGACCGGCGTGT
GGGTGCGCAACCACAACGGCATCGCCGACAACGCCACCATGGTGCGCGTG
GACGTGTTCGAGAAGGGCGACAAGTACTACCTGGTGCCCATCTACAGCTG
GCAGGTGGCCAAGGGCATCCTGCCCGACCGCGCCGTGGTGCAGGGCAAGG
ACGAGGAGGACTGGCAGCTGATCGACGACAGCTTCAACTTCAAGTTCAGC
CTGCACCCCAACGACCTGGTGGAGGTGATCACCAAGAAGGCCCGCATGTT
CGGCTACTTCGCCAGCTGCCACCGCGGCACCGGCAACATCAACATCCGCA
TCCACGACCTGGACCACAAGATCGGCAAGAACGGCATCCTGGAGGGCATC
GGCGTGAAGACCGCCCTGAGCTTCCAGAAGTACCAGATCGACGAGCTGGG
CAAGGAGATCCGCCCCTGCCGCCTGAAGAAGCGCCCTCCTGTGCGCTAA

Provided below is the corresponding amino acid sequence of a *N. meningitidis* Cas9 molecule.

(SEQ ID NO: 25)

MAAFKPNPINYILGLDIGIASVGWAMVEIDEDENPICLIDLGVRVFERAE
VPKTGDSLAMARRLARSVRRLTRRRAHRLLRARRLLKREGVLQAADFDEN
GLIKSLPNTPWQLRAAALDRKLTPLEWSAVLLHLIKHRGYLSQRKNEGET
ADKELGALLKGVADNAHALQTGDFRTPAELALNKFEKESGHIRNQRGDYS
HTFSRKDLQAELILLFEKQKEFGNPHVSGGLKEGIETLLMTQRPALSGDA
VQKMLGHCTFEPAEPKAAKNTYTAERFIWLTKLNNLRILEQGSERPLTDT
ERATLMDEPYRKSKLTYAQARKLLGLEDTAFFKGLRYGKDNAEASTLMEM

-continued

KAYHAISRALEKEGLKDKKSPLNLSPELQDEIGTAFSLFKTDEDITGRLK
DRIQPEILEALLKHISFDKFVQISLKALRRIVPLMEQGKRYDEACAEIYG
DHYGKKNTEEKIYLPPIPADEIRNPVVLRALSQARKVINGVVRRYGSPAR
IHIETAREVGKSFKDRKEIEKRQEENRKDREKAAAKFREYFPNFVGEPKS
KDILKLRLYEQQHGKCLYSGKEINLGRLNEKGYVEIDHALPFSRTWDDSF
NNKVLVLGSENQNKGNQTPYEYFNGKDNSREWQEFKARVETSRFPRSKKQ
RILLQKFDEDGFKERNLNDTRYVNRFLCQFVADRMRLTGKGKKRVFASNG
QITNLLRGFWGLRKVRAENDRHHALDAVVVACSTVAMQQKITRFVRYKEM
NAFDGKTIDKETGEVLHQKTHFPQPWEFFAQEVMIRVFGKPDGKPEFEEA
DTPEKLRTLLAEKLSSRPEAVHEYVTPLFVSRAPNRKMSGQGHMETVKSA
KRLDEGVSVLRVPLTQLKLKDLEKMVNREREPKLYEALKARLEAHKDDPA
KAFAEPFYKYDKAGNRTQQVKAVRVEQVQKTGVWVRNHNGIADNATMVRV
DVFEKGDKYYLVPIYSWQVAKGILPDRAVVQGKDEEDWQLIDDSFNFKFS
LHPNDLVEVITKKARMFGYFASCHRGTGNINIRIHDLDHKIGKNGILEGI
GVKTALSFQKYQIDELGKEIRPCRLKKRPPVR*

Provided below is an amino acid sequence of a *S. aureus* Cas9 molecule.

(SEQ ID NO: 26)

MKRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLMGHCTYFPEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIIRTTGKENAKYLIEKIKLHDMQEGKCLYSLEAIPLEDLLNNP
FNYEVDHIIPRSVSFDNSFNNKVLVKQEENSKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIFKEWKKLDKAKKVMENQMFEEKQAESMPEIETEQEY
KEIFITPHQIKHIKDFKDYKYSHRVDKKPNRELINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
RNKVVKLSLKPYRFDVYLDNGVYKFVTVKNLDVIKKENYYEVNSKCYEEA
KKLKKISNQAEFIASFYNNDLIKINGELYRVIGVNNDLLNRIEVNMIDIT
YREYLENMNDKRPPRIIKTIASKTQSIKKYSTDILGNLYEVKSKKHPQII
KKG*

Provided below is an exemplary codon optimized nucleic acid sequence encoding a Cas9 molecule of *S. aureus* Cas9.

```
                                         (SEQ ID NO: 39)
ATGAAAAGGAACTACATTCTGGGGCTGGACATCGGGATTACAAGCGTGGG
GTATGGGATTATTGACTATGAAACAAGGGACGTGATCGACGCAGGCGTCA
GACTGTTCAAGGAGGCCAACGTGGAAAACAATGAGGGACGGAGAAGCAAG
AGGGGAGCCAGGCGCCTGAAACGACGGAGAAGGCACAGAATCCAGAGGGT
GAAGAAACTGCTGTTCGATTACAACCTGCTGACCGACCATTCTGAGCTGA
GTGGAATTAATCCTTATGAAGCCAGGGTGAAAGGCCTGAGTCAGAAGCTG
TCAGAGGAAGAGTTTTCCGCAGCTCTGCTGCACCTGGCTAAGCGCCGAGG
AGTGCATAACGTCAATGAGGTGGAAGAGGACACCGGCAACGAGCTGTCTA
CAAAGGAACAGATCTCACGCAATAGCAAAGCTCTGGAAGAGAAGTATGTC
GCAGAGCTGCAGCTGGAACGGCTGAAGAAAGATGGCGAGGTGAGAGGGTC
AATTAATAGGTTCAAGACAAGCGACTACGTCAAAGAAGCCAAGCAGCTGC
TGAAAGTGCAGAAGGCTTACCACCAGCTGGATCAGAGCTTCATCGATACT
TATATCGACCTGCTGGAGACTCGGAGAACCTACTATGAGGGACCAGGAGA
AGGGAGCCCCTTCGGATGGAAAGACATCAAGGAATGGTACGAGATGCTGA
TGGGACATTGCACCTATTTTCCAGAAGAGCTGAGAAGCGTCAAGTACGCT
TATAACGCAGATCTGTACAACGCCCTGAATGACCTGAACAACCTGGTCAT
CACCAGGGATGAAAACGAGAAACTGGAATACTATGAGAAGTTCCAGATCA
TCGAAAACGTGTTTAAGCAGAAGAAAAAGCCTACACTGAAACAGATTGCT
AAGGAGATCCTGGTCAACGAAGAGGACATCAAGGGCTACCGGGTGACAAG
CACTGGAAAACCAGAGTTCACCAATCTGAAAGTGTATCACGATATTAAGG
ACATCACAGCACGGAAAGAAATCATTGAGAACGCCGAACTGCTGGATCAG
ATTGCTAAGATCCTGACTATCTACCAGAGCTCCGAGGACATCCAGGAAGA
GCTGACTAACCTGAACAGCGAGCTGACCCAGGAAGAGATCGAACAGATTA
GTAATCTGAAGGGGTACACCGGAACACACAACCTGTCCCTGAAAGCTATC
AATCTGATTCTGGATGAGCTGTGGCATACAAACGACAATCAGATTGCAAT
CTTTAACCGGCTGAAGCTGGTCCCAAAAAAGGTGGACCTGAGTCAGCAGA
AAGAGATCCCAACCACACTGGTGGACGATTTCATTCTGTCACCCGTGGTC
AAGCGGAGCTTCATCCAGAGCATCAAAGTGATCAACGCCATCATCAAGAA
GTACGGCCTGCCCAATGATATCATTATCGAGCTGGCTAGGGAGAAGAACA
GCAAGGACGCACAGAAGATGATCAATGAGATGCAGAAACGAAACCGGCAG
ACCAATGAACGCATTGAAGAGATTATCCGAACTACCGGGAAAGAGAACGC
AAAGTACCTGATTGAAAAAATCAAGCTGCACGATATGCAGGAGGGAAAGT
GTCTGTATTCTCTGGAGGCCATCCCCCTGGAGGACCTGCTGAACAATCCA
TTCAACTACGAGGTCGATCATATTATCCCCAGAAGCGTGTCCTTCGACAA
TTCCTTTAACAACAAGGTGCTGGTCAAGCAGGAAGAGAACTCTAAAAAGG
GCAATAGGACTCCTTTCCAGTACCTGTCTAGTTCAGATTCCAAGATCTCT
TACGAAACCTTTAAAAAGCACATTCTGAATCTGGCCAAAGGAAAGGGCCG
CATCAGCAAGACCAAAAAGGAGTACCTGCTGGAAGAGCGGGACATCAACA
```

-continued

```
GATTCTCCGTCCAGAAGGATTTTATTAACCGGAATCTGGTGGACACAAGA
TACGCTACTCGCGGCCTGATGAATCTGCTGCGATCCTATTTCCGGGTGAA
CAATCTGGATGTGAAAGTCAAGTCCATCAACGGCGGGTTCACATCTTTTC
TGAGGCGCAAATGGAAGTTTAAAAAGGAGCGCAACAAAGGGTACAAGCAC
CATGCCGAAGATGCTCTGATTATCGCAAATGCCGACTTCATCTTTAAGGA
GTGGAAAAAGCTGGACAAAGCCAAGAAAGTGATGGAGAACCAGATGTTCG
AAGAGAAGCAGGCCGAATCTATGCCCGAAATCGAGACAGAACAGGAGTAC
AAGGAGATTTTCATCACTCCTCACCAGATCAAGCATATCAAGGATTTCAA
GGACTACAAGTACTCTCACCGGGTGGATAAAAAGCCCAACAGAGAGCTGA
TCAATGACACCCTGTATAGTACAAGAAAAGACGATAAGGGGAATACCCTG
ATTGTGAACAATCTGAACGGACTGTACGACAAAGATAATGACAAGCTGAA
AAAGCTGATCAACAAAAGTCCCGAGAAGCTGCTGATGTACCACCATGATC
CTCAGACATATCAGAAACTGAAGCTGATTATGGAGCAGTACGGCGACGAG
AAGAACCCACTGTATAAGTACTATGAAGAGACTGGGAACTACCTGACCAA
GTATAGCAAAAAGGATAATGGCCCCGTGATCAAGAAGATCAAGTACTATG
GGAACAAGCTGAATGCCCATCTGGACATCACAGACGATTACCCTAACAGT
CGCAACAAGGTGGTCAAGCTGTCACTGAAGCCATACAGATTCGATGTCTA
TCTGGACAACGGCGTGTATAAATTTGTGACTGTCAAGAATCTGGATGTCA
TCAAAAAGGAGAACTACTATGAAGTGAATAGCAAGTGCTACGAAGAGGCT
AAAAAGCTGAAAAAGATTAGCAACCAGGCAGAGTTCATCGCCTCCTTTTA
CAACAACGACCTGATTAAGATCAATGGCGAACTGTATAGGGTCATCGGGG
TGAACAATGATCTGCTGAACCGCATTGAAGTGAATATGATTGACATCACT
TACCGAGAGTATCTGGAAAACATGAATGATAAGCGCCCCCCTCGAATTAT
CAAAACAATTGCCTCTAAGACTCAGAGTATCAAAAAGTACTCAACCGACA
TTCTGGGAAACCTGTATGAGGTGAAGAGCAAAAAGCACCCTCAGATTATC
AAAAAGGGC
```

If any of the above Cas9 sequences (e.g., a eiCas9) are fused with a transcription repressor at the C-terminus, it is understood that the stop codon will be removed.

Other Cas Molecules and Cas9 Polypeptides

Various types of Cas molecules or Cas9 polypeptides can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al., PLoS Computational Biology 2005, 1(6): e60 and Makarova et al., Nature Review Microbiology 2011, 9:467-477, the contents of both references are incorporated herein by reference in their entirety. Exemplary Cas molecules (and Cas systems) are also shown in Table 30.

TABLE 30

| Cas Systems | | | | | |
|---|---|---|---|---|---|
| Gene name[‡] | System type or subtype | Name from Haft et al.[§] | Structure of encoded protein (PDB accessions)[¶] | Families (and superfamily) of encoded protein[#**] | Representatives |
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |
| cas3' | Type I[‡‡] | cas3 | NA | COG1203 | APE1232 and ygcB |
| cas3" | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A<br>Subtype III-B | cas6 and cmx6 | 3I4H | COG1583 and COG5551 (RAMP) | PF1131 and slr7014 |
| cas6e | Subtype I-E | cse3 | 1WJ9 | (RAMP) | ygcH |
| cas6f | Subtype I-F | csy4 | 2XLJ | (RAMP) | y1727 |
| cas7 | Subtype I-A<br>Subtype I-B<br>Subtype I-C<br>Subtype I-E | csa2, csd2, cse4, csh2, csp1 and cst2 | NA | COG1857 and COG3649 (RAMP) | devR and ygcJ |
| cas8a1 | Subtype I-A[‡‡] | cmx1, cst1, csx8, csx13 and CXXC-CXXC | NA | BH0338-like | LA3191[§§] and PG2018[§§] |
| cas8a2 | Subtype I-A[‡‡] | csa4 and csx9 | NA | PH0918 | AF0070, AF1873, MJ0385, PF0637, PH0918 and SSO1401 |
| cas8b | Subtype I-B[‡‡] | csh1 and TM1802 | NA | BH0338-like | MTH1090 and TM1802 |
| cas8c | Subtype I-C[‡‡] | csd1 and csp2 | NA | BH0338-like | BH0338 |
| cas9 | Type II[‡‡] | csn1 and csx12 | NA | COG3513 | FTN_0757 and SPy1046 |
| cas10 | Type III[‡‡] | cmr2, csm1 and csx11 | NA | COG1353 | MTH326, Rv2823c[§§] and TM1794[§§] |
| cas10d | Subtype I-D[‡‡] | csc3 | NA | COG1353 | slr7011 |
| csy1 | Subtype I-F[‡‡] | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E[‡‡] | cse1 | NA | YgcL-like | ygcL |
| cse2 | Subtype I-E | cse2 | 2ZCA | YgcK-like | ygcK |
| csc1 | Subtype I-D | csc1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn2 | NA | SPy1049-like | SPy1049 |
| csm2 | Subtype III-A[‡‡] | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |
| cmr1 | Subtype III-B | cmr1 | NA | COG1367 (RAMP) | PF1130 |
| cmr3 | Subtype III-B | cmr3 | NA | COG1769 (RAMP) | PF1128 |

TABLE 30-continued

| Cas Systems | | | | | |
|---|---|---|---|---|---|
| Gene name[‡] | System type or subtype | Name from Haft et al.[§] | Structure of encoded protein (PDB accessions)[¶] | Families (and superfamily) of encoded protein[#**] | Representatives |
| cmr4 | Subtype III-B | cmr4 | NA | COG1336 (RAMP) | PF1126 |
| cmr5 | Subtype III-B[‡‡] | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |
| csb2 | Subtype I-U[§§] | NA | NA | (RAMP) | Balac_1305 and GSU0054 |
| csb3 | Subtype I-U | NA | NA | (RAMP) | Balac_1303[§§] |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2I71 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

IV. Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule are described, e.g., in Jinek et al., Science 2012, 337(6096):816-821.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1×T4 polynucleotide kinase reaction buffer at 37° C. for 30 min, in a 50 μL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 μl. Reactions are initiated by the addition of 1 μl target DNA (10 nM) and incubated for 1 h at 37° C. Reactions are quenched by the addition of 20 μl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of Cas9 Molecule to Target DNA

Exemplary methods for evaluating the binding of Cas9 molecule to target DNA are described, e.g., in Jinek et al., Science 2012; 337(6096):816-821.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1× TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 μl. Cas9 protein molecule is programmed with equimolar amounts of pre-annealed gRNA molecule and titrated from 100 pM to 1 μM. Radiolabeled DNA is added to a final concentration of 20 pM. Samples are incubated for 1 h at 37° C. and resolved at 4° C. on an 8% native polyacrylamide gel containing 1×TBE and 5 mM $MgCl_2$. Gels are dried and DNA visualized by phosphorimaging.

Differential Scanning Fluorimetry (DSF)

The thermostability of Cas9-gRNA ribonucleoprotein (RNP) complexes can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10×SYPRO Orange® (Life Techonologies cat #S-6650) and dispensed into a 384 well plate. An equimolar amount of gRNA diluted in solutions with varied pH and salt is then added. After incubating at room temperature for 10' and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds. The second assay consists of mixing various concentrations of gRNA with 2 uM Cas9 in optimal buffer from assay 1 above and incubating at RT for 10' in a 384 well plate. An equal volume of optimal buffer +10×SYPRO Orange® (Life Techonologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

V. Genome Editing Approaches

Mutations in the MYOC gene may be corrected using one of the approaches or pathways described herein, e.g., using HDR and/or NHEJ. In an embodiment, a mutation or a mutational hotspot in the MYOC gene is corrected by homology directed repair (HDR) using a template nucleic acid (see Section V.1).

Also described herein are methods for targeted knockout of one or both alleles of the MYOC gene using NHEJ (see Section V.2). In another embodiment, methods are provided for targeted knockdown of the MYOC gene (see Section V.3).

V.1 HDR Repair and Template Nucleic Acids

As described herein, nuclease-induced homology directed repair (HDR) can be used to alter a target sequence and correct (e.g., repair or edit) a mutation in the genome. While not wishing to be bound by theory, it is believed that alteration of the target sequence occurs by homology-directed repair (HDR) with a donor template or template nucleic acid. For example, the donor template or the template nucleic acid provides for alteration of the target sequence. It is contemplated that a plasmid donor can be used as a template for homologous recombination. It is further contemplated that a single stranded donor template can be used as a template for alteration of the target sequence by alternate methods of homology directed repair (e.g., single strand annealing) between the target sequence and the donor template. Donor template-effected alteration of a target sequence depends on cleavage by a Cas9 molecule. Cleavage by Cas9 can comprise a double strand break or two single strand breaks.

Mutations that can be corrected by HDR using a template nucleic acid include point mutations, mutation hotspots or sequence insertions. In an embodiment, a point mutation or a mutation hotspot (e.g., a mutation hotspot of less than about 30 bp, e.g., less than 25, 20, 15, 10 or 5 bp) can be corrected by either a single double-strand break or two single strand breaks. In an embodiment, a mutation hotspot (e.g., a mutation hotspot greater than about 30 bp, e.g., more than 35, 40, 45, 50, 75, 100, 150, 200, 250, 300, 400 or 500 bp) or an insertion can be corrected by (1) a single double-strand break, (2) two single strand breaks, (3) two double stranded breaks with a break occurring on each side of the target sequence, or (4) four single stranded breaks with a pair of single stranded breaks occurring on each side of the target sequence.

Mutations in the MYOC gene that can be corrected (e.g., altered) by HDR with a template nucleic acid include point mutations at T377R, P370L, I477N and/or mutational hotspots at amino acids 423-437, amino acids 246-252, or amino acids 477-502.

Double Strand Break Mediated Correction

In an embodiment, double strand cleavage is effected by a Cas9 molecule having cleavage activity associated with an HNH-like domain and cleavage activity associated with anRuvC-like domain, e.g., an N-terminal RuvC-like domain, e.g., a wild type Cas9. Such embodiments require only a single gRNA.

Single Strand Break Mediated Correction

In other embodiments, two single strand breaks, or nicks, are effected by a Cas9 molecule having nickase activity, e.g., cleavage activity associated with an HNH-like domain or cleavage activity associated with an N-terminal RuvC-like domain. Such embodiments require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HNH activity and will cut on the strand to which the gRNA hybridizes (the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (the strand that has the NGG PAM and whose sequence is identical to the gRNA). In other embodiments, a Cas9 molecule having an N863, e.g., an N863A mutation, can be used as a nickase. N863A inactivates HNH therefore the Cas9 nickase has (only) RuvC activity and cuts on the non-complementary strand (the strand that has the NGG PAM and whose sequence is identical to the gRNA).

In an embodiment, in which a nickase and two gRNAs are used to position two single strand nicks, one nick is on the + strand and one nick is on the − strand of the target nucleic acid. The PAMs are outwardly facing. The gRNAs can be selected such that the gRNAs are separated by, from about 0-50, 0-100, or 0-200 nucleotides. In an embodiment, there is no overlap between the target sequence that is complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran et al., Cell 2013; 154(6): 1380-1389).

In an embodiment, a single nick can be used to induce HDR. It is contemplated herein that a single nick can be used to increase the ratio of HR to NHEJ at a given cleavage site.

Placement of Double Strand or Single Strand Breaks Relative to the Target Position The double strand break or single strand break in one of the strands should be sufficiently close to the target position such that correction occurs. In an embodiment, the distance is not more than 50, 100, 200, 300, 350 or 400 nucleotides. While not wishing to be bound by theory, it is believed that the break should be sufficiently close to the target sequence such that the break is within the region that is subject to exonuclease-mediated removal during end resection. If the distance between the target sequence and a break is too great, the mutation may not be included in the end resection and, therefore, may not be corrected, as donor sequence may only be used to correct sequence within the end resection region.

In an embodiment, in which a gRNA (unimolecular (or chimeric) or modular gRNA) and Cas9 nuclease induce a double strand break for the purpose of inducing HDR-mediated correction, the cleavage site is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In an embodiment, in which two gRNAs (independently, unimolecular (or chimeric) or modular gRNA) complexing with Cas9 nickases induce two single strand breaks for the purpose of inducing HDR-mediated correction, the closer nick is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position and the two nicks will ideally be within 25-55 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp) and no more than 100 bp away from each other (e.g., no more than 90, 80, 70, 60, 50, 40, 30, 20, 10 or 5 bp away from each other). In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a cas9 nuclease) and two single strand breaks or paired single stranded breaks (i.e., two gRNAs complex with Cas9 nickases) on either side of the target position. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of the target position. In an embodiment, the gRNAs are configured to place a single strand break on the same side (either 5' or 3') of the target position.

Regardless of whether a break is a double strand or a single strand break, the gRNA should be configured to avoid unwanted target chromosome elements, such as repeated elements, e.g., an Alu repeat, in the target domain. In addition, a break, whether a double strand or a single strand break, should be sufficiently distant from any sequence that should not be altered. For example, cleavage sites positioned within introns should be sufficiently distant from any intron/exon border, or naturally occurring splice signal, to avoid alteration of the exonic sequence or unwanted splicing events.

Length of the Homology Arms

The homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., Alu repeats, LINE repeats.

Exemplary homology arm lengths include a least 50, 100, 250, 500, 750 or 1000 nucleotides.

Target position, as used herein, refers to a site on a target nucleic acid (e.g., the chromosome) that is modified by a Cas9 molecule-dependent process. For example, the target position can be a modified Cas9 molecule cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a target sequence (e.g., the sequence to which the gRNA binds). In an embodiment, a target position is upstream or downstream of a target sequence (e.g., the sequence to which the gRNA binds).

A template nucleic acid, as that term is used herein, refers to a nucleic acid sequence which can be used in conjunction with a Cas9 molecule and a gRNA molecule to alter the structure of a target position. In an embodiment, the target nucleic acid is modified to have the some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA. In an embodiment, the template nucleic acid is encoded on the same vector backbone, e.g. AAV genome, plasmid DNA, as the Cas9 and gRNA. In an embodiment, the template nucleic acid is excised from a vector backbone in vivo, e.g., it is flanked by gRNA recognition sequences.

In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In another embodiment, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in the MYOC gene can be used to alter the structure of a target sequence. The template sequence can be used to alter an unwanted structure, e.g., an unwanted or mutant nucleotide.

A template nucleic acid comprises the following components:

[5' homology arm]-[replacement sequence]-[3' homology arm].

The homology arms provide for recombination into the chromosome, thus replacing the undesired element, e.g., a mutation or signature, with the replacement sequence. In an embodiment, the homology arms flank the most distal cleavage sites.

In an embodiment, the 3' end of the 5' homology arm is the position next to the 5' end of the replacement sequence. In an embodiment, the 5' homology arm can extend at least 10, 20, 30, 40, 50, 100, 200, 300, 400, 500, 600, 700, 800, 900, 1000, 1500, or 2000 nucleotides 5' from the 5' end of the replacement sequence.

In an embodiment, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, or 2000 nucleotides 3' from the 3' end of the replacement sequence.

Exemplary Template Nucleic Acids

Exemplary template nucleic acids (also referred to herein as donor constructs) to correction a mutation, e.g., P370L, in the MYOC gene, are provided.

Suitable sequence for the 5' homology arm for a template nucleic acid to correct a P370L mutation in the MYOC gene can include the following sequence or a portion thereof:

(SEQ ID NO: 8856)

TTGCACCACTGCACTCCAGCCTAGGTAACAGTGCAAGACCCTGTCTCAAA

AAATAATTATTTTCATGTTTATTATATTAAAATGATGTATGAAATATGTG

ACTCATCAGGGCTTGAAAAACTTTGTTGTATGGAGATTATTCTTATGAGT

TGATTTTTCTCTCTCCTACCTTATAGTAATGAAATAAACCAGGCATGAAA

GTCACAATAAGTAATACAATGAACACCCATGGGTCCCTGCCCAGCTTAAG

TAGAATATTACAAATGCAGTTGAAGCCCTCTGTGCAACTTTCATCCTTAC

AACTGATACTGAGTGAATTGTACTTTAAATATTTTATAGCTCCCACTCCC

ATGCATGCCCCTCAGTGATAGCAATAATTGTCAATAACATGAAACACAGA

TTGATCATATAGCATTTACCATATATTTACTCTATACCAAGCACTTAACA

TATATAATTACATTTAAAATTTACAACAGCCCTACTACCCAAAACACTAT

TAGTATCCCCTTTTACAAATGCGATAACTGAGGCGTAGAGAGCTAAGTAA

CTTACTGAAAGTCACACAGCCAGCGGGTGGTAGAGCCTAGCTTTAAACCC

AGACGATTTGTCTCCAGGGCTGTCACATCTACTGGCTCTGCCAAGCTTCC

GCATGATCATTGTCTGTGTTTGGAAAGATTATGGATTAAGTGGTGCTTCG

TTTTCTTTTCTGAATTTACCAGGATGTGGAGAACTAGTTTGGGTAGGAGA

GCCTCTCACGCTGAGAACAGCAGAAACAATTACTGGCAAGTATGGTGTGT

GGATGCGAGACCCCAAGCCCACCTACCCCTACACCCAGGAGACCACGTGG

AGAATCGACACAGTTGGCACGGATGTCCGCCAGGTTTTTGAGTATGACCT

CATCAGCCAGTTTATGCAGGGCTACCCTTCTAAGGTTCACATACTGCCTA

GGCCACTGGAAAGCACGGGTGCTGTGGTGTACTCGGGGAGCCTCTATTTC

CAGGGCGCTGAGTCCAGAACTGTCATAAGATATGAGCTGAATACCGAGAC

AGTGAAGGCTGAGAAGGAAATCCCTGGAGCTGGCTACCACGGACAGTTCC

Suitable sequence for the 3' homology arm for a template nucleic acid to correct P370L mutation in the MYOC gene can include the following sequence or a portion thereof:

(SEQ ID NO: 8857)

GTATTCTTGGGGTGGCTACACGGACATTGACTTGGCTGTGGATGAAGCAG

GCCTCTGGGTCATTTACAGCACCGATGAGGCCAAAGGTGCCATTGTCCTC

TCCAAACTGAACCCAGAGAATCTGGAACTCGAACAAACCTGGGAGACAAA

CATCCGTAAGCAGTCAGTCGCCAATGCCTTCATCATCTGTGGCACCTTGT

ACACCGTCAGCAGCTACACCTCAGCAGATGCTACCGTCAACTTTGCTTAT

GACACAGGCACAGGTATCAGCAAGACCCTGACCATCCCATTCAAGAACCG

CTATAAGTACAGCAGCATGATTGACTACAACCCCCTGGAGAAGAAGCTCT

TTGCCTGGGACAACTTGAACATGGTCACTTATGACATCAAGCTCTCCAAG

-continued

ATGTGAAAAGCCTCCAAGCTGTACAGGCAATGGCAGAAGGAGATGCTCAG

GGCTCCTGGGGGGAGCAGGCTGAAGGGAGAGCCAGCCAGCCAGGGCCCAG

-continued

GCAGCTTTGACTGCTTTCCAAGTTTTCATTAATCCAGAAGGATGAACATG

GTCACCATCTAACTATTCAGGAATTGTAGTCTGAGGGCGTAGACAATTTC

ATATAATAAATATCCTTTATCTTCTGTCAGCATTTATGGGATGTTTAATG

ACATAGTTCAAGTTTTCTTGTGATTTGGGGCAAAAGCTGTAAGGCATAAT

AGTTTCTTCCTGAAAACCATTGCTCTTGCATGTTACATGGTTACCACAAG

CCACAATAAAAAGCATAACTTCTAAAGGAAGCAGAATAGCTCCTCTGGCC

AGCATCGAATATAAGTAAGATGCATTTACTACAGTTGGCTTCTAATGCTT

CAGATAGAATACAGTTGGGTCTCACATAACCCTTTACATTGTGAAATAAA

ATTTTCTTACCCAACGTTCTCTTCCTTGAACTTTGTGGGAATCTTTGCTT

AAGAGAAGGATATAGATTCCAACCATCAGGTAATTCCTTCAGGTTGGGAG

ATGTGATTGCAGGATGTTAAAGGTGGTGTGTGTGTGTGTGTGTGTGTGTG

TAACTGAGAGGCTTGTGCCTGGTTTTGAGGTGCTGCCCAGGATGACGCCA

A

In an embodiment, the replacement sequence comprises or consists of a cytosine (C) residue.

In an embodiment, to correct P370L in the MYOC gene, the homology arms, e.g., the 5' and 3' homology arms, may each comprise about 1000 base pairs (bp) of sequence flanking the most distal gRNAs (e.g., 1100 bp of sequence on either side of the mutation). The 5' homology arm is shown as bold sequence, codon 370 is shown as underlined sequence, the inserted base to correct the P370L mutation is shown as boxed sequence, and the 3' homology arm is shown with no emphasis sequence.

(Template Construct 1; SEQ ID NO: 8858)

TTGCACCACTGCACTCCAGCCTAGGTAACAGTGCAAGACCCTGTCTCAAAAAATAATTATTT
TCATGTTTATTATATTAAAATGATGTATGAAATATGTGACTCATCAGGGCTTGAAAAACTTT
GTTGTATGGAGATTATTCTTATGAGTTGATTTTTCTCTCTCCTACCTTATAGTAATGAAATA
AACCAGGCATGAAAGTCACAATAAGTAATACAATGAACACCCATGGGTCCCTGCCCAGCTTA
AGTAGAATATTACAAATGCAGTTGAAGCCCTCTGTGCAACTTTCATCCTTACAACTGATACT
GAGTGAATTGTACTTTAAATATTTTATAGCTCCCACTCCCATGCATGCCCCTCAGTGATAGC
AATAATTGTCAATAACATGAAACACAGATTGATCATATAGCATTTACCATATATTTACTCTA
TACCAAGCACTTAACATATATAATTACATTTAAAATTTACAACAGCCCTACTACCCAAAACA
CTATTAGTATCCCCTTTTACAAATGCGATAACTGAGGCGTAGAGAGCTAAGTAACTTACTGA
AAGTCACACAGCCAGCGGGTGGTAGAGCCTAGCTTTAAACCCAGACGATTTGTCTCCAGGGC
TGTCACATCTACTGGCTCTGCCAAGCTTCCGCATGATCATTGTCTGTGTTTGGAAAGATTAT
GGATTAAGTGGTGCTTCGTTTTCTTTTCTGAATTTACCAGGATGTGGAGAACTAGTTTGGGT
AGGAGAGCCTCTCACGCTGAGAACAGCAGAAACAATTACTGGCAAGTATGGTGTGTGGATGC
GAGACCCCAAGCCCACCTACCCCTACACCCAGGAGACCACGTGGAGAATCGACACAGTTGGC
ACGGATGTCCGCCAGGTTTTTGAGTATGACCTCATCAGCCAGTTTATGCAGGGCTACCCTTC
TAAGGTTCACATACTGCCTAGGCCACTGGAAAGCACGGGTGCTGTGGTGTACTCGGGGAGCC
TCTATTTCCAGGGCGCTGAGTCCAGAACTGTCATAAGATATGAGCTGAATACCGAGACAGTG
AAGGCTGAGAAGGAAATCCCTGGAGCTGGCTACCACGGACAGTTCCCGTATTCTTGGGGTGG

CTACACGGACATTGACTTGGCTGTGGATGAAGCAGGCCTCTGGGTCATTTACAGCACCGATG
AGGCCAAAGGTGCCATTGTCCTCTCCAAACTGAACCCAGAGAATCTGGAACTCGAACAAACC
TGGGAGACAAACATCCGTAAGCAGTCAGTCGCCAATGCCTTCATCATCTGTGGCACCTTGTA
CACCGTCAGCAGCTACACCTCAGCAGATGCTACCGTCAACTTTGCTTATGACACAGGCACAG
GTATCAGCAAGACCCTGACCATCCCATTCAAGAACCGCTATAAGTACAGCAGCATGATTGAC
TACAACCCCCTGGAGAAGAAGCTCTTTGCCTGGGACAACTTGAACATGGTCACTTATGACAT
CAAGCTCTCCAAGATGTGAAAAGCCTCCAAGCTGTACAGGCAATGGCAGAAGGAGATGCTCA
GGGCTCCTGGGGGGAGCAGGCTGAAGGGAGAGCCAGCCAGCCAGGGCCCAGGCAGCTTTGAC
TGCTTTCCAAGTTTTCATTAATCCAGAAGGATGAACATGGTCACCATCTAACTATTCAGGAA
TTGTAGTCTGAGGGCGTAGACAATTTCATATAATAAATATCCTTTATCTTCTGTCAGCATTT
ATGGGATGTTTAATGACATAGTTCAAGTTTTCTTGTGATTTGGGGCAAAAGCTGTAAGGCAT
AATAGTTTCTTCCTGAAAACCATTGCTCTTGCATGTTACATGGTTACCACAAGCCACAATAA
AAAGCATAACTTCTAAAGGAAGCAGAATAGCTCCTCTGGCCAGCATCGAATATAAGTAAGAT
GCATTTACTACAGTTGGCTTCTAATGCTTCAGATAGAATACAGTTGGGTCTCACATAACCCT
TTACATTGTGAAATAAAATTTTCTTACCCAACGTTCTCTTCCTTGAACTTTGTGGGAATCTT
TGCTTAAGAGAAGGATATAGATTCCAACCATCAGGTAATTCCTTCAGGTTGGGAGATGTGAT
TGCAGGATGTTAAAGGTGGTGTGTGTGTGTGTGTGTGTGTGTGTAACTGAGAGGCTTGTGCC
TGGTTTTGAGGTGCTGCCCAGGATGACGCCAA

As described below in Table 24, shorter homology arms, e.g., 5' and/or 3' homology arms may be used.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In an embodiment, to correct P370L in the MYOC gene, the 5' homology arm may be shortened less than 600 nucleotides, e.g., approximately 550 nucleotides, e.g., 450 nucleotides, to avoid inclusion of a LINE repeat element in the 5' homology arm. An exemplary 5' homology arm is shown as bold sequence, codon 370 is shown as underlined sequence, the inserted base to correct the P370L mutation is shown as non-bold and boxed sequence, and an exemplary 3' homology arm is shown with no emphasis.

(Template Construct 2; SEQ ID NO: 8859)

AAGCTTCCGCATGATCATTGTCTGTGTTTGGAAAGATTATGGATTAAGTGGTGCTTCGTTTT
CTTTTCTGAATTTACCAGGATGTGGAGAACTAGTTTGGGTAGGAGAGCCTCTCACGCTGAGA
ACAGCAGAAACAATTACTGGCAAGTATGGTGTGTGGATGCGAGACCCCAAGCCCACCTACCC
CTACACCCAGGAGACCACGTGGAGAATCGACACAGTTGGCACGGATGTCCGCCAGGTTTTTG
AGTATGACCTCATCAGCCAGTTTATGCAGGGCTACCCTTCTAAGGTTCACATACTGCCTAGG
CCACTGGAAAGCACGGGTGCTGTGGTGTACTCGGGGAGCCTCTATTTCCAGGGCGCTGAGTC
CAGAACTGTCATAAGATATGAGCTGAATACCGAGACAGTGAAGGCTGAGAAGGAAATCCCTG
GAGCTGGCTACCACGGACAGTTCCCGTATTCTTGGGGTGGCTACACGGACATTGACTTGGCT

GTGGATGAAGCAGGCCTCTGGGTCATTTACAGCACCGATGAGGCCAAAGGTGCCATTGTCCT
CTCCAAACTGAACCCAGAGAATCTGGAACTCGAACAAACCTGGGAGACAAACATCCGTAAGC
AGTCAGTCGCCAATGCCTTCATCATCTGTGGCACCTTGTACACCGTCAGCAGCTACACCTCA
GCAGATGCTACCGTCAACTTTGCTTATGACACAGGCACAGGTATCAGCAAGACCCTGACCAT
CCCATTCAAGAACCGCTATAAGTACAGCAGCATGATTGACTACAACCCCCTGGAGAAGAAGC
TCTTTGCCTGGGACAACTTGAACATGGTCACTTATGACATCAAGCTCTCCAAGATGTGAAAA
GCCTCCAAGCTGTACAGGCAATGGCAGAAGGAGATGCTCAGGGCTCCTGGGGGGAGCAGGCT
GAAGGGAGAGCCAGCCAGCCAGGGCCCAGGCAGCTTTGACTGCTTTCCAAGTTTTCATTAAT
CCAGAAGGATGAACATGGTCACCATCTAACTATTCAGGAATTGTAGTCTGAGGGCGTAGACA
ATTTCATATAATAAATATCCTTTATCTTCTGTCAGCATTTATGGGATGTTTAATGACATAGT
TCAAGTTTTCTTGTGATTTGGGGCAAAAGCTGTAAGGCATAATAGTTTCTTCCTGAAAACCA
TTGCTCTTGCATGTTACATGGTTACCACAAGCCACAATAAAAAGCATAACTTCTAAAGGAAG
CAGAATAGCTCCTCTGGCCAGCATCGAATATAAGTAAGATGCATTTACTACAGTTGGCTTCT
AATGCTTCAGATAGAATACAGTTGGGTCTCACATAACCCTTTACATTGTGAAATAAAATTTT
CTTACCCAACGTTCTCTTCCTTGAACTTTGTGGGAATCTTTGCTTAAGAGAAGGATATAGAT
TCCAACCATCAGGTAATTCCTTCAGGTTGGGAGATGTGATTGCAGGATGTTAAAGGTGGTGT
GTGTGTGTGTGTGTGTGTGTGTAACTGAGAGGCTTGTGCCTGGTTTTGAGGTGCTGCCCAGG
ATGACGCCAA

It is contemplated herein that, in an embodiment, template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

Exemplary template nucleic acids to correct a mutation, e.g., I477N or mutations in the mutational hotspot 477-502 region, in theMYOC gene, are provided.

Suitable sequence for the 5' homology arm for a template nucleic acid to correct an I477N mutation or mutations in the mutational hotspot 477-502 region in the MYOC gene can include the following sequence or a portion thereof:

(SEQ ID NO: 8860)

GAACACCCATGGGTCCCTGCCCAGCTTAAGTAGAATATTACAAATGCAGT
TGAAGCCCTCTGTGCAACTTTCATCCTTACAACTGATACTGAGTGAATTG
TACTTTAAATATTTTATAGCTCCCACTCCCATGCATGCCCCTCAGTGATA
GCAATAATTGTCAATAACATGAAACACAGATTGATCATATAGCATTTACC
ATATATTTACTCTATACCAAGCACTTAACATATATAATTACATTTAAAAT
TTACAACAGCCCTACTACCCAAAACACTATTAGTATCCCCTTTTACAAAT
GCGATAACTGAGGCGTAGAGAGCTAAGTAACTTACTGAAAGTCACACAGC
CAGCGGGTGGTAGAGCCTAGCTTTAAACCCAGACGATTTGTCTCCAGGGC
TGTCACATCTACTGGCTCTGCCAAGCTTCCGCATGATCATTGTCTGTGTT
TGGAAAGATTATGGATTAAGTGGTGCTTCGTTTTCTTTTCTGAATTTACC
AGGATGTGGAGAACTAGTTTGGGTAGGAGAGCCTCTCACGCTGAGAACAG
CAGAAACAATTACTGGCAAGTATGGTGTGTGGATGCGAGACCCCAAGCCC
ACCTACCCCTACACCCAGGAGACCACGTGGAGAATCGACACAGTTGGCAC
GGATGTCCGCCAGGTTTTTGAGTATGACCTCATCAGCCAGTTTATGCAGG
GCTACCCTTCTAAGGTTCACATACTGCCTAGGCCACTGGAAAGCACGGGT

-continued

GCTGTGGTGTACTCGGGGAGCCTCTATTTCCAGGGCGCTGAGTCCAGAAC
TGTCATAAGATATGAGCTGAATACCGAGACAGTGAAGGCTGAGAAGGAAA
TCCCTGGAGCTGGCTACCACGGACAGTTCCCGTATTCTTGGGGTGGCTAC
ACGGACATTGACTTGGCTGTGGATGAAGCAGGCCTCTGGGTCATTTACAG
CACCGATGAGGCCAAAGGTGCCATTGTCCTCTCCAAACTGAACCCAGAGA
ATCTGGAACTCGAACAAACCTGGGAGACAAACATCCGTAAGCAGTCAGTC
GCCAATGCCTTCATCATCTGTGGCACCTTGTACACCGTCAGCAGCTACAC
CTCAGCAGATGCTACCGTCAACTTTGCTTATGACACAGGCACAGGTATCA
GCAAGACCCTGACCATCCCATTCAAGAACCGCTATAAGTACAGCAGCATG
A

Suitable sequence for the 3' homology arm for a template nucleic acid to correct an I477N mutation or mutations in the mutational hotspot 477-502 region in the MYOC gene can include the following sequence or a portion thereof:

(SEQ ID NO: 8861)

AAGATGTGAAAAGCCTCCAAGCTGTACAGGCAATGGCAGAAGGAGATGCT
CAGGGCTCCTGGGGGGAGCAGGCTGAAGGGAGAGCCAGCCAGCCAGGGCC
CAGGCAGCTTTGACTGCTTTCCAAGTTTTCATTAATCCAGAAGGATGAAC
ATGGTCACCATCTAACTATTCAGGAATTGTAGTCTGAGGGCGTAGACAAT
TTCATATAATAAATATCCTTTATCTTCTGTCAGCATTTATGGGATGTTTA
ATGACATAGTTCAAGTTTTCTTGTGATTTGGGGCAAAAGCTGTAAGGCAT
AATAGTTTCTTCCTGAAAACCATTGCTCTTGCATGTTACATGGTTACCAC
AAGCCACAATAAAAAGCATAACTTCTAAAGGAAGCAGAATAGCTCCTCTG
GCCAGCATCGAATATAAGTAAGATGCATTTACTACAGTTGGCTTCTAATG
CTTCAGATAGAATACAGTTGGGTCTCACATAACCCTTTACATTGTGAAAT
AAAATTTTCTTACCCAACGTTCTCTTCCTTGAACTTTGTGGGAATCTTTG

-continued

CTTAAGAGAAGGATATAGATTCCAACCATCAGGTAATTCCTTCAGGTTGG

GAGATGTGATTGCAGGATGTTAAAGGTGGTGTGTGTGTGTGTGTGTGTGT

GTGTAACTGAGAGGCTTGTGCCTGGTTTTGAGGTGCTGCCCAGGATGACG

CCAAGCAAATAGCAGCATCCACACTTTCCCACCTCCATCTCCTGGTGCTC

-continued

TCGGCACTACCGGAGCAATCTTTCCATCTCTCCCCTGAACCCACCCTCTA

TTCACCCTAACTCCACTTCAGTTTGCTTTTGATTTTTTTTTTTTTTTTTT

TTTTTTTTTGAGATGGAGTCTCGCTCTGTCACCCAGGCTGGAGTGCAGTG

GCACGATCTCGGCTCACTGCAAGTTCCGCCTCCCAGGTTCACACCATTCT

CCTGCCTCAGCCTCCCAAGTAGCTGGGACTACAGGCGCCTGCCACCACGC

CTGGCTAATTTTTTTTTTTTTCCAGTGAAGATGGGGTTTCACCATGTTAGC

CAGGATGGTCTCGATCTCCTGACCTTGTCATCCACCCACCTTGGCCTCCC

AAAGTGCTGGGATTACAGGCGTGAGCCACCACGCCCAGCCCCTCCACTTC

AGTTTTTATCTGTCATCAGGGGTATGAATTTTATAAGCCACAACCTCAGG

In an embodiment, when correcting the I477N mutation, the replacement sequence comprises or consists of a thymine (T) residue.

In an embodiment, to correct I477N in the MYOC gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, codon 477 is shown as underlined sequence, the inserted base to correct the I477N mutation is shown as boxed sequence, and the 3' homology arm is shown as no emphasis sequence.

(Template Construct 3; SEQ ID NO: 8862)

GAACACCCATGGGTCCCTGCCCAGCTTAAGTAGAATATTACAAATGCAGTTGAAGCCCTCTG
TGCAACTTTCATCCTTACAACTGATACTGAGTGAATTGTACTTTAAATATTTTATAGCTCCC
ACTCCCATGCATGCCCCTCAGTGATAGCAATAATTGTCAATAACATGAAACACAGATTGATC
ATATAGCATTTACCATATATTTACTCTATACCAAGCACTTAACATATATAATTACATTTAAA
ATTTACAACAGCCCTACTACCCAAAACACTATTAGTATCCCCTTTTACAAATGCGATAACTG
AGGCGTAGAGAGCTAAGTAACTTACTGAAAGTCACACAGCCAGCGGGTGGTAGAGCCTAGCT
TTAAACCCAGACGATTTGTCTCCAGGGCTGTCACATCTACTGGCTCTGCCAAGCTTCCGCAT
GATCATTGTCTGTGTTTGGAAAGATTATGGATTAAGTGGTGCTTCGTTTTCTTTTCTGAATT
TACCAGGATGTGGAGAACTAGTTTGGGTAGGAGAGCCTCTCACGCTGAGAACAGCAGAAACA
ATTACTGGCAAGTATGGTGTGTGGATGCGAGACCCCAAGCCCACCTACCCCTACACCCAGGA
GACCACGTGGAGAATCGACACAGTTGGCACGGATGTCCGCCAGGTTTTTGAGTATGACCTCA
TCAGCCAGTTTATGCAGGGCTACCCTTCTAAGGTTCACATACTGCCTAGGCCACTGGAAAGC
ACGGGTGCTGTGGTGTACTCGGGGAGCCTCTATTTCCAGGGCGCTGAGTCCAGAACTGTCAT
AAGATATGAGCTGAATACCGAGACAGTGAAGGCTGAGAAGGAAATCCCTGGAGCTGGCTACC
ACGGACAGTTCCCGTATTCTTGGGGTGGCTACACGGACATTGACTTGGCTGTGGATGAAGCA
GGCCTCTGGGTCATTTACAGCACCGATGAGGCCAAAGGTGCCATTGTCCTCTCCAAACTGAA
CCCAGAGAATCTGGAACTCGAACAAACCTGGGAGACAAACATCCGTAAGCAGTCAGTCGCCA
ATGCCTTCATCATCTGTGGCACCTTGTACACCGTCAGCAGCTACACCTCAGCAGATGCTACC
GTCAACTTTGCTTATGACACAGGCACAGGTATCAGCAAGACCCTGACCATCCCATTCAAGAA
CCGCTATAAGTACAGCAGCATGAATTATTGACTACAACCCCCTGGAGAAGAAGCTCTTTGCCT

GGGACAACTTGAACATGGTCACTTATGACATCAAGCTCTCCAAGATGTGAAAAGCCTCCAAG
CTGTACAGGCAATGGCAGAAGGAGATGCTCAGGGCTCCTGGGGGGAGCAGGCTGAAGGGAGA
GCCAGCCAGCCAGGGCCCAGGCAGCTTTGACTGCTTTCCAAGTTTTCATTAATCCAGAAGGA
TGAACATGGTCACCATCTAACTATTCAGGAATTGTAGTCTGAGGGCGTAGACAATTTCATAT
AATAAATATCCTTTATCTTCTGTCAGCATTTATGGGATGTTTAATGACATAGTTCAAGTTTT
CTTGTGATTTGGGGCAAAAGCTGTAAGGCATAATAGTTTCTTCCTGAAAACCATTGCTCTTG
CATGTTACATGGTTACCACAAGCCACAATAAAAAGCATAACTTCTAAAGGAAGCAGAATAGC
TCCTCTGGCCAGCATCGAATATAAGTAAGATGCATTTACTACAGTTGGCTTCTAATGCTTCA
GATAGAATACAGTTGGGTCTCACATAACCCTTTACATTGTGAAATAAAATTTTCTTACCCAA
CGTTCTCTTCCTTGAACTTTGTGGGAATCTTTGCTTAAGAGAAGGATATAGATTCCAACCAT
CAGGTAATTCCTTCAGGTTGGGAGATGTGATTGCAGGATGTTAAAGGTGGTGTGTGTGTGTG
TGTGTGTGTGTGTAACTGAGAGGCTTGTGCCTGGTTTTGAGGTGCTGCCCAGGATGACGCCA
AGCAAATAGCAGCATCCACACTTTCCCACCTCCATCTCCTGGTGCTCTCGGCACTACCGGAG
CAATCTTTCCATCTCTCCCCTGAACCCACCCTCTATTCACCCTAACTCCACTTCAGTTTGCT
TTTGATTTTTTTTTTTTTTTTTTTTTTTTTGAGATGGAGTCTCGCTCTGTCACCCAGGCT
GGAGTGCAGTGGCACGATCTCGGCTCACTGCAAGTTCCGCCTCCCAGGTTCACACCATTCTC
CTGCCTCAGCCTCCCAAGTAGCTGGGACTACAGGCGCCTGCCACCACGCCTGGCTAATTTTT
TTTTTTTCCAGTGAAGATGGGGTTTCACCATGTTAGCCAGGATGGTCTCGATCTCCTGACCT
TGTCATCCACCCACCTTGGCCTCCCAAAGTGCTGGGATTACAGGCGTGAGCCACCACGCCCA
GCCCCTCCACTTCAGTTTTTATCTGTCATCAGGGGTATGAATTTTATAAGCCACAACCTCAG
G

In an embodiment, when correcting the mutational hot-spot 477-502 region, the replacement sequence comprises or consists of:

(SEQ ID NO: 8863)

TTATTGACTACAACCCCCTGGAGAAGAAGCTCTTTGCCTGGGACAACTTG

AACATGGTCACTTATGACATCAAGCTCTCC.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that, in an embodiment, template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

Exemplary template nucleic acids to correct a mutational hotspot 477-502 region, in the MYOC gene, are provided.

In an embodiment, to correct the mutational hotspot 477-502 region in the MYOC gene, the homology arms, e.g., the 5' and 3' homology arms, may each comprise about 1000 base pairs (bp) of sequence flanking the most distal gRNAs (e.g., 1200 bp of sequence on either side of the mutation). The 5' homology arm is shown as bold sequence, the inserted nucleotides to correct the mutational hotspot 477-502 region is shown as boxed sequence, and the 3' homology arm is shown as no emphasis sequence.

(Template Construct 3; SEQ ID NO: 8864)

GAACACCCATGGGTCCCTGCCCAGCTTAAGTAGAATATTACAAATGCAGTTGAAGCCCTCTG
TGCAACTTTCATCCTTACAACTGATACTGAGTGAATTGTACTTTAAATATTTTATAGCTCCC
ACTCCCATGCATGCCCCTCAGTGATAGCAATAATTGTCAATAACATGAAACACAGATTGATC
ATATAGCATTTACCATATATTTACTCTATACCAAGCACTTAACATATATAATTACATTTAAA
ATTTACAACAGCCCTACTACCCAAAACACTATTAGTATCCCCTTTTACAAATGCGATAACTG
AGGCGTAGAGAGCTAAGTAACTTACTGAAAGTCACACAGCCAGCGGGTGGTAGAGCCTAGCT
TTAAACCCAGACGATTTGTCTCCAGGGCTGTCACATCTACTGGCTCTGCCAAGCTTCCGCAT
GATCATTGTCTGTGTTTGGAAAGATTATGGATTAAGTGGTGCTTCGTTTTCTTTTCTGAATT
TACCAGGATGTGGAGAACTAGTTTGGGTAGGAGAGCCTCTCACGCTGAGAACAGCAGAAACA
ATTACTGGCAAGTATGGTGTGTGGATGCGAGACCCCAAGCCCACCTACCCCTACACCCAGGA
GACCACGTGGAGAATCGACACAGTTGGCACGGATGTCCGCCAGGTTTTTGAGTATGACCTCA
TCAGCCAGTTTATGCAGGGCTACCCTTCTAAGGTTCACATACTGCCTAGGCCACTGGAAAGC
ACGGGTGCTGTGGTGTACTCGGGGAGCCTCTATTTCCAGGGCGCTGAGTCCAGAACTGTCAT
AAGATATGAGCTGAATACCGAGACAGTGAAGGCTGAGAAGGAAATCCCTGGAGCTGGCTACC
ACGGACAGTTCCCGTATTCTTGGGGTGGCTACACGGACATTGACTTGGCTGTGGATGAAGCA
GGCCTCTGGGTCATTTACAGCACCGATGAGGCCAAAGGTGCCATTGTCCTCTCCAAACTGAA
CCCAGAGAATCTGGAACTCGAACAAACCTGGGAGACAAACATCCGTAAGCAGTCAGTCGCCA
ATGCCTTCATCATCTGTGGCACCTTGTACACCGTCAGCAGCTACACCTCAGCAGATGCTACC
GTCAACTTTGCTTATGACACAGGCACAGGTATCAGCAAGACCCTGACCATCCCATTCAAGAA
CCGCTATAAGTACAGCAGCATGATTATTGACTACAACCCCCTGGAGAAGAAGCTCTTTGCCT
GGGACAACTTGAACATGGTCACTTATGACATCAAGCTCTCCAAGATGTGAAAAGCCTCCAAG
CTGTACAGGCAATGGCAGAAGGAGATGCTCAGGGCTCCTGGGGGGAGCAGGCTGAAGGGAGA
GCCAGCCAGCCAGGGCCCAGGCAGCTTTGACTGCTTTCCAAGTTTTCATTAATCCAGAAGGA
TGAACATGGTCACCATCTAACTATTCAGGAATTGTAGTCTGAGGGCGTAGACAATTTCATAT
AATAAATATCCTTTATCTTCTGTCAGCATTTATGGGATGTTTAATGACATAGTTCAAGTTTT
CTTGTGATTTGGGGCAAAAGCTGTAAGGCATAATAGTTTCTTCCTGAAAACCATTGCTCTTG
CATGTTACATGGTTACCACAAGCCACAATAAAAAGCATAACTTCTAAAGGAAGCAGAATAGC
TCCTCTGGCCAGCATCGAATATAAGTAAGATGCATTTACTACAGTTGGCTTCTAATGCTTCA
GATAGAATACAGTTGGGTCTCACATAACCCTTTACATTGTGAAATAAAATTTTCTTACCCAA
CGTTCTCTTCCTTGAACTTTGTGGGAATCTTTGCTTAAGAGAAGGATATAGATTCCAACCAT
CAGGTAATTCCTTCAGGTTGGGAGATGTGATTGCAGGATGTTAAAGGTGGTGTGTGTGTGTG
TGTGTGTGTGTGTAACTGAGAGGCTTGTGCCTGGTTTTGAGGTGCTGCCCAGGATGACGCCA
AGCAAATAGCAGCATCCACACTTTCCCACCTCCATCTCCTGGTGCTCTCGGCACTACCGGAG
CAATCTTTCCATCTCTCCCCTGAACCCACCCTCTATTCACCCTAACTCCACTTCAGTTTGCT
TTTGATTTTTTTTTTTTTTTTTTTTTTTTTTTGAGATGGAGTCTCGCTCTGTCACCCAGGCT
GGAGTGCAGTGGCACGATCTCGGCTCACTGCAAGTTCCGCCTCCCAGGTTCACACCATTCTC
CTGCCTCAGCCTCCCAAGTAGCTGGGACTACAGGCGCCTGCCACCACGCCTGGCTAATTTTT
TTTTTTTCCAGTGAAGATGGGGTTTCACCATGTTAGCCAGGATGGTCTCGATCTCCTGACCT
TGTCATCCACCCACCTTGGCCTCCCAAAGTGCTGGGATTACAGGCGTGAGCCACCACGCCCA
GCCCCTCCACTTCAGTTTTTATCTGTCATCAGGGGTATGAATTTTATAAGCCACAACCTCAG
G

Table 24 below provides exemplary template nucleic acids. In an embodiment, the template nucleic acid includes the 5' homology arm and the 3' homology arm of a row from Table 24. In other embodiments, a 5' homology arm from the first column can be combined with a 3' homology arm from Table 24. In each embodiment, a combination of the 5' and 3' homology arms include a replacement sequence, which may be selected from cytosine (C), thymine (T) and (SEQ ID NO: 8865)

TTATTGACTACAACCCCCTGGAGAAGAAGCTCTTTGCCTGGGACAACTTG
AACATGGTCACTTATGACATCAAGCTCTCCAA.

TABLE 24

| 5' homology arm (the number of nucleotides from SEQ ID NO: 5'H, beginning at the 3' end of SEQ ID NO: 5'H) | Replacement Sequence: C or T | 3' homology arm (the number of nucleotides from SEQ ID NO: 3'H, beginning at the 5' end of SEQ ID NO: 3'H) |
|---|---|---|
| 10 or more | | 10 or more |
| 20 or more | | 20 or more |
| 50 or more | | 50 or more |
| 100 or more | | 100 or more |
| 150 or more | | 150 or more |
| 200 or more | | 200 or more |
| 250 or more | | 250 or more |

TABLE 24-continued

| 5' homology arm (the number of nucleotides from SEQ ID NO: 5'H, beginning at the 3' end of SEQ ID NO: 5'H) | Replacement Sequence: C or T | 3' homology arm (the number of nucleotides from SEQ ID NO: 3'H, beginning at the 5' end of SEQ ID NO: 3'H) |
|---|---|---|
| 300 or more | | 300 or more |
| 350 or more | | 350 or more |
| 400 or more | | 400 or more |
| 450 or more | | 450 or more |
| 500 or more | | 500 or more |
| 550 or more | | 550 or more |
| 600 or more | | 600 or more |
| 650 or more | | 650 or more |
| 700 or more | | 700 or more |
| 750 or more | | 750 or more |
| 800 or more | | 800 or more |
| 850 or more | | 850 or more |
| 900 or more | | 900 or more |
| 1000 or more | | 1000 or more |
| 1100 or more | | 1100 or more |
| 1200 or more | | 1200 or more |
| 1300 or more | | 1300 or more |
| 1400 or more | | 1400 or more |
| 1500 or more | | 1500 or more |
| 1600 or more | | 1600 or more |
| 1700 or more | | 1700 or more |
| 1800 or more | | 1800 or more |
| 1900 or more | | 1900 or more |
| 1200 or more | | 1200 or more |
| At least 50 but not long enough to include a repeated element. | | At least 50 but not long enough to include a repeated element. |
| At least 100 but not long enough to include a repeated element. | | At least 100 but not long enough to include a repeated element. |
| At least 150 but not long enough to include a repeated element. | | At least 150 but not long enough to include a repeated element. |
| 5 to 100 nucleotides | | 5 to 100 nucleotides |
| 10 to 150 nucleotides | | 10 to 150 nucleotides |
| 20 to 150 nucleotides | | 20 to 150 nucleotides |
| | Template Construct No. 1 | |
| | Template Construct No. 2 | |
| | Template Construct No. 3 | |

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that, in an embodiment, template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made. It is contemplated herein that, in an embodiment, Cas9 could potentially cleave donor constructs either prior to or following homology directed repair (e.g., homologous recombination), resulting in a possible non-homologous-end-joining event and further DNA sequence mutation at the chromosomal locus of interest. Therefore, to avoid cleavage of the donor sequence before and/or after Cas9-mediated homology directed repair, alternate versions of the donor sequence may be used where silent mutations are introduced. These silent mutations may disrupt Cas9 binding and cleavage, but not disrupt the amino acid sequence of the repaired gene.

In an embodiment, a single or dual nickase eaCas9 is used to cleave the target DNA near the site of the mutation, or signature, to be modified, e.g., replaced. While not wishing to be bound by theory, in an embodiment, it is believed that the Cas9 mediated break induces HDR with the template nucleic acid to replace the target DNA sequence with the template sequence.

V.2 NHEJ Approaches for Gene Targeting

As described herein, nuclease-induced non-homologous end-joining (NHEJ) can be used to target gene-specific knockouts. Nuclease-induced NHEJ can also be used to remove (e.g., delete) sequence insertions in a gene of interest.

While not wishing to be bound by theory, it is believed that, in an embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Both double strand cleaving eaCas9 molecules and single strand, or nickase, eaCas9 molecules can be used in the methods and compositions described herein to generate NHEJ-mediated indels. NHEJ-mediated indels targeted to the gene, e.g., a coding region, e.g., an early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

Placement of Double Strand or Single Strand Breaks Relative to the Target Position In an embodiment, in which a gRNA and Cas9 nuclease generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In an embodiment, the cleavage site is between 0-30 bp away from the target position (e.g., less than 30, 25, 20, 15, 10, 9, 8, 7, 6, 5, 4, 3, 2 or 1 bp from the target position).

In an embodiment, in which two gRNAs complexing with Cas9 nickases induce two single strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In an embodiment, the gRNAs are configured to position cuts at the same position, or within a few nucleotides of one another, on different strands, essentially mimicking a double strand break. In an embodiment, the closer nick is between 0-30 bp away from the target position (e.g., less than 30, 25, 20, 15, 10, 9, 8, 7, 6, 5, 4, 3, 2 or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of a nucleotide of the target position.

Both double strand cleaving eaCas9 molecules and single strand, or nickase, eaCas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks in deleted). In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a cas9 nuclease) and two single strand breaks or paired single stranded breaks (i.e., two gRNAs complex with Cas9 nickases) on either side of the target position. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

V.3 Targeted Knockdown

Unlike CRISPR/Cas-mediated gene knockout, which permanently eliminates expression by mutating the gene at the DNA level, CRISPR/Cas knockdown allows for temporary reduction of gene expression through the use of artificial transcription factors. Mutating key residues in both DNA cleavage domains of the Cas9 protein (e.g. the D10A and H840A mutations) results in the generation of a catalytically inactive Cas9 (eiCas9 which is also known as dead Cas9 or dCas9) molecule. A catalytically inactive Cas9 complexes with a gRNA and localizes to the DNA sequence specified by that gRNA's targeting domain, however, it does not cleave the target DNA. Fusion of the dCas9 to an effector domain, e.g., a transcription repression domain, enables recruitment of the effector to any DNA site specified by the gRNA. Although an enzymatically inactive (eiCas9) Cas9 molecule itself can block transcription when recruited to early regions in the coding sequence, more robust repression can be achieved by fusing a transcriptional repression domain (for example KRAB, SID or ERD) to the Cas9 molecule and recruiting it to the promoter region of a gene. It is likely that targeting DNAseI hypersensitive regions of the promoter may yield more efficient gene repression or activation because these regions are more likely to be accessible to the Cas9 protein and are also more likely to harbor sites for endogenous transcription factors. Especially for gene repression, it is contemplated herein that blocking the binding site of an endogenous transcription factor would aid in downregulating gene expression. In an embodiment, one or more eiCas9 molecules may be used to block binding of one or more endogenous transcription factors. In another embodiment, an eiCas9 molecule can be fused to a chromatin modifying protein. Altering chromatin status can result in decreased expression of the target gene. In an embodiment, one or more eiCas9 molecules may be used to block binding of one or more endogenous transcription factors. In another embodiment, an eiCas9 molecule can be fused to a chromatin modifying protein. Altering chromatin status can result in decreased expression of the target gene. One or more eiCas9 molecules fused to one or more chromatin modifying proteins may be used to alter chromatin status.

In an embodiment, a gRNA molecule can be targeted to a known transcription response elements (e.g., promoters, enhancers, etc.), a known upstream activating sequences (UAS), and/or sequences of unknown or known function that are suspected of being able to control expression of the target DNA.

CRISPR/Cas-mediated gene knockdown can be used to reduce expression of an unwanted allele or transcript. Contemplated herein are scenarios wherein permanent destruction of the gene is not ideal. In these scenarios, site-specific repression may be used to temporarily reduce or eliminate expression. It is also contemplated herein that the off-target effects of a Cas-repressor may be less severe than those of a Cas-nuclease as a nuclease can cleave any DNA sequence and cause mutations whereas a Cas-repressor may only have an effect if it targets the promoter region of an actively transcribed gene. However, while nuclease-mediated knockout is permanent, repression may only persist as long as the Cas-repressor is present in the cells. Once the repressor is no longer present, it is likely that endogenous transcription factors and gene regulatory elements would restore expression to its natural state.

V.4 Single-Strand Annealing

Single strand annealing (SSA) is another DNA repair process that repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to and each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

In contrast to HDR pathways, SSA does not require a template nucleic acid to alter or correct a target nucleic acid sequence. Instead, the complementary repeat sequence is utilized.

V.5 Other DNA Repair Pathways

SSBR (Single Strand Break Repair)

Single-stranded breaks (SSB) in the genome are repaired by the SSBR pathway, which is a distinct mechanism from the DSB repair mechanisms discussed above. The SSBR pathway has four major stages: SSB detection, DNA end processing, DNA gap filling, and DNA ligation. A more detailed explanation is given in Caldecott, Nature Reviews Genetics 9, 619-631 (August 2008), and a summary is given here.

In the first stage, when a SSB forms, PARP1 and/or PARP2 recognize the break and recruit repair machinery. The binding and activity of PARP1 at DNA breaks is transient and it seems to accelerate SSBr by promoting the focal accumulation or stability of SSBr protein complexes at the lesion. Arguably the most important of these SSBr proteins is XRCC1, which functions as a molecular scaffold that interacts with, stabilizes, and stimulates multiple enzymatic components of the SSBr process including the protein responsible for cleaning the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF exhibits endonuclease and 3' to 5' exonuclease activities. APTX has endonuclease and 3' to 5' exonuclease activity.

This end processing is an important stage of SSBR since the 3'- and/or 5'-termini of most, if not all, SSBs are ‘damaged’. End processing generally involves restoring a damaged 3'-end to a hydroxylated state and and/or a damaged 5' end to a phosphate moiety, so that the ends become ligation-competent. Enzymes that can process damaged 3' termini include PNKP, APE1, and TDP1. Enzymes that can process damaged 5' termini include PNKP, DNA polymerase beta, and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonuclease 1), DNA polymerase delta/epsilon, PCNA, and LIG1. There are two ways of gap filling, the short patch repair and the long patch repair. Short patch repair involves the insertion of a single nucleotide that is missing. At some SSBs, “gap filling” might continue displacing two or more nucleotides (displacement of up to 12 bases have been reported). FEN1 is an endonuclease that removes the displaced 5'-residues. Multiple DNA polymerases, including Pol β, are involved in the repair of SSBs, with the choice of DNA polymerase influenced by the source and type of SSB.

In the fourth stage, a DNA ligase such as LIG1 (Ligase I) or LIG3 (Ligase III) catalyzes joining of the ends. Short patch repair uses Ligase III and long patch repair uses Ligase I.

Sometimes, SSBR is replication-coupled. This pathway can involve one or more of CtIP, MRN, ERCC1, and FEN1. Additional factors that may promote SSBR include: aPARP, PARP1, PARP2, PARG, XRCC1, DNA polymerase b, DNA polymerase d, DNA polymerase e, PCNA, LIG1, PNK, PNKP, APE1, APTX, APLF, TDP1, LIG3, FEN1, CtIP, MRN, and ERCC1.

MMR (Mismatch Repair)

Cells contain three excision repair pathways: MMR, BER, and NER. The excision repair pathways have a common feature in that they typically recognize a lesion on one strand of the DNA, then exo/endonucleases remove the lesion and leave a 1-30 nucleotide gap that is sub-sequentially filled in by DNA polymerase and finally sealed with ligase. A more complete picture is given in Li, Cell Research (2008) 18:85-98, and a summary is provided here.

Mismatch Repair (MMR) Operates on Mispaired DNA Bases.

The MSH2/6 or MSH2/3 complexes both have ATPases activity that plays an important role in mismatch recognition and the initiation of repair. MSH2/6 preferentially recognizes base-base mismatches and identifies mispairs of 1 or 2 nucleotides, while MSH2/3 preferentially recognizes larger ID mispairs.

hMLH1 heterodimerizes with hPMS2 to form hMutL α which possesses an ATPase activity and is important for multiple steps of MMR. It possesses a PCNA/replication factor C (RFC)-dependent endonuclease activity which plays an important role in 3' nick-directed MMR involving EXO1. (EXO1 is a participant in both HR and MMR.) It regulates termination of mismatch-provoked excision. Ligase I is the relevant ligase for this pathway. Additional factors that may promote MMR include: EXO1, MSH2, MSH3, MSH6, MLH1, PMS2, MLH3, DNA Pol d, RPA, HMGB1, RFC, and DNA ligase I.

Base Excision Repair (BER)

The base excision repair (BER) pathway is active throughout the cell cycle; it is responsible primarily for removing small, non-helix-distorting base lesions from the genome. In contrast, the related Nucleotide Excision Repair pathway (discussed in the next section) repairs bulky helix-distorting lesions. A more detailed explanation is given in Caldecott, Nature Reviews Genetics 9, 619-631 (August 2008), and a summary is given here.

Upon DNA base damage, base excision repair (BER) is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incised the phosphodiester backbone to create a DNA single strand break (SSB). The third step of BER involves cleaning-up of the DNA ends. The fourth step in BER is conducted by Pol β that adds a new complementary nucleotide into the repair gap and in the final step XRCC1/Ligase III seals the remaining nick in the DNA backbone. This completes the short-patch BER pathway in which the majority (~80%) of damaged DNA bases are repaired. However, if the 5'-ends in step 3 are resistant to end processing activity, following one nucleotide insertion by Pol β there is then a polymerase switch to the replicative DNA polymerases, Pol δ/ε, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors that may promote the BER pathway include: DNA glycosylase, APE1, Polb, Pold, Pole, XRCC1, Ligase III, FEN-1, PCNA, RECQL4, WRN, MYH, PNKP, and APTX.

Nucleotide Excision Repair (NER)

Nucleotide excision repair (NER) is an important excision mechanism that removes bulky helix-distorting lesions from DNA. Additional details about NER are given in Marteijn et al., Nature Reviews Molecular Cell Biology 15, 465-481 (2014), and a summary is given here. NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA, RFC, DNA Pol δ, DNA Pol ε or DNA Pol κ, and DNA ligase I or XRCC1/Ligase III. Replicating cells tend to use DNA pol ε and DNA ligase I, while non-replicating cells tend to use DNA Pol δ, DNA Pol κ, and the XRCC1/Ligase III complex to perform the ligation step.

NER can involve the following factors: XPA-G, POLH, XPF, ERCC1, XPA-G, and LIG1. Transcription-coupled NER (TC-NER) can involve the following factors: CSA, CSB, XPB, XPD, XPG, ERCC1, and TTDA. Additional factors that may promote the NER repair pathway include XPA-G, POLH, XPF, ERCC1, XPA-G, LIG1, CSA, CSB, XPA, XPB, XPC, XPD, XPF, XPG, TTDA, UVSSA, USP7, CETN2, RAD23B, UV-DDB, CAK subcomplex, RPA, and PCNA.

Interstrand Crosslink (ICL)

A dedicated pathway called the ICL repair pathway repairs interstrand crosslinks. Interstrand crosslinks, or covalent crosslinks between bases in different DNA strand, can occur during replication or transcription. ICL repair involves the coordination of multiple repair processes, in particular, nucleolytic activity, translesion synthesis (TLS), and HDR. Nucleases are recruited to excise the ICL on either side of the crosslinked bases, while TLS and HDR are coordinated to repair the cut strands. ICL repair can involve the following factors: endonucleases, e.g., XPF and RAD51C, endonucleases such as RAD51, translesion polymerases, e.g., DNA polymerase zeta and Rev1), and the Fanconi anemia (FA) proteins, e.g., FancJ.

Other Pathways

Several other DNA repair pathways exist in mammals.

Translesion synthesis (TLS) is a pathway for repairing a single stranded break left after a defective replication event and involves translesion polymerases, e.g., DNA pol□ and Rev1.

Error-free postreplication repair (PRR) is another pathway for repairing a single stranded break left after a defective replication event.

V.6 Examples of gRNAs in Genome Editing Methods gRNA molecules as described herein can be used with Cas9 molecules that generate a double strand break or a single strand break to alter the sequence of a target nucleic acid, e.g., a target position or target genetic signature. gRNA molecules useful in these methods are described below.

In an embodiment, the gRNA, e.g., a chimeric gRNA, is configured such that it comprises one or more of the following properties;

a) it can position, e.g., when targeting a Cas9 molecule that makes double strand breaks, a double strand break (i) within 50, 100, 150, 200, 250, 300, 350, 400, 450, or 500 nucleotides of a target position, or (ii) sufficiently close that the target position is within the region of end resection;

b) it has a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and c)

(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5; 6, 7, 8, 9 or 10 nucleotides therefrom;

(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;

(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;

(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain, or a sequence that differs by no more than 1, 2, 3, 4, 5; 6, 7, 8, 9 or 10 nucleotides therefrom; or (v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain.

In an embodiment, the gRNA is configured such that it comprises properties: a and b(i).

In an embodiment, the gRNA is configured such that it comprises properties: a and b(ii).

In an embodiment, the gRNA is configured such that it comprises properties: a and b(iii).

In an embodiment, the gRNA is configured such that it comprises properties: a and b(iv).

In an embodiment, the gRNA is configured such that it comprises properties: a and b(v).

In an embodiment, the gRNA is configured such that it comprises properties: a and b(vi).

In an embodiment, the gRNA is configured such that it comprises properties: a and b(vii).

In an embodiment, the gRNA is configured such that it comprises properties: a and b(viii).

In an embodiment, the gRNA is configured such that it comprises properties: a and b(ix).

In an embodiment, the gRNA is configured such that it comprises properties: a and b(x).

In an embodiment, the gRNA is configured such that it comprises properties: a and b(xi).

In an embodiment, the gRNA is configured such that it comprises properties: a and c.

In an embodiment, the gRNA is configured such that in comprises properties: a, b, and c.

In an embodiment, the gRNA is configured such that in comprises properties: a(i), b(i), and c(i).

In an embodiment, the gRNA is configured such that in comprises properties: a(i), b(i), and c(ii).

In an embodiment, the gRNA is configured such that in comprises properties: a(i), b(ii), and c(i).

In an embodiment, the gRNA is configured such that in comprises properties: a(i), b(ii), and c(ii).

In an embodiment, the gRNA is configured such that in comprises properties: a(i), b(iii), and c(i).

In an embodiment, the gRNA is configured such that in comprises properties: a(i), b(iii), and c(ii).

In an embodiment, the gRNA is configured such that in comprises properties: a(i), b(iv), and c(i).

In an embodiment, the gRNA is configured such that in comprises properties: a(i), b(iv), and c(ii).

In an embodiment, the gRNA is configured such that in comprises properties: a(i), b(v), and c(i).

In an embodiment, the gRNA is configured such that in comprises properties: a(i), b(v), and c(ii).

In an embodiment, the gRNA is configured such that in comprises properties: a(i), b(vi), and c(i).

In an embodiment, the gRNA is configured such that in comprises properties: a(i), b(vi), and c(ii).

In an embodiment, the gRNA is configured such that in comprises properties: a(i), b(vii), and c(i).

In an embodiment, the gRNA is configured such that in comprises properties: a(i), b(vii), and c(ii).

In an embodiment, the gRNA is configured such that in comprises properties: a(i), b(viii), and c(i).

In an embodiment, the gRNA is configured such that in comprises properties: a(i), b(viii), and c(ii).

In an embodiment, the gRNA is configured such that in comprises properties: a(i), b(ix), and c(i).

In an embodiment, the gRNA is configured such that in comprises properties: a(i), b(ix), and c(ii).

In an embodiment, the gRNA is configured such that in comprises properties: a(i), b(x), and c(i).

In an embodiment, the gRNA is configured such that in comprises properties: a(i), b(x), and c(ii).

In an embodiment, the gRNA is configured such that in comprises properties: a(i), b(xi), and c(i).

In an embodiment, the gRNA is configured such that in comprises properties: a(i), b(xi), and c(ii).

In an embodiment, the gRNA, e.g., a chimeric gRNA, is configured such that it comprises one or more of the following properties;

a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;

b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides; and c)

(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5; 6, 7, 8, 9 or 10 nucleotides therefrom;

(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;

(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;

(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain, or a sequence that differs by no more than 1, 2, 3, 4, 5; 6, 7, 8, 9 or 10 nucleotides therefrom; or (v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain.

In an embodiment, the gRNA is configured such that it comprises properties: a and b(i).

In an embodiment, the gRNA is configured such that it comprises properties: a and b(ii).

In an embodiment, the gRNA is configured such that it comprises properties: a and b(iii).

In an embodiment, the gRNA is configured such that it comprises properties: a and b(iv).

In an embodiment, the gRNA is configured such that it comprises properties: a and b(v).

In an embodiment, the gRNA is configured such that it comprises properties: a and b(vi).

In an embodiment, the gRNA is configured such that it comprises properties: a and b(vii).

In an embodiment, the gRNA is configured such that it comprises properties: a and b(viii).

In an embodiment, the gRNA is configured such that it comprises properties: a and b(ix).

In an embodiment, the gRNA is configured such that it comprises properties: a and b(x).

In an embodiment, the gRNA is configured such that it comprises properties: a and b(xi).

In an embodiment, the gRNA is configured such that it comprises properties: a and c.

In an embodiment, the gRNA is configured such that in comprises properties: a, b, and c.

In an embodiment, the gRNA is configured such that in comprises properties: a(i), b(i), and c(i).

In an embodiment, the gRNA is configured such that in comprises properties: a(i), b(i), and c(ii).

In an embodiment, the gRNA is configured such that in comprises properties: a(i), b(ii), and c(i).

In an embodiment, the gRNA is configured such that in comprises properties: a(i), b(ii), and c(ii).

In an embodiment, the gRNA is configured such that in comprises properties: a(i), b(iii), and c(i).

In an embodiment, the gRNA is configured such that in comprises properties: a(i), b(iii), and c(ii).

In an embodiment, the gRNA is configured such that in comprises properties: a(i), b(iv), and c(i).

In an embodiment, the gRNA is configured such that in comprises properties: a(i), b(iv), and c(ii).

In an embodiment, the gRNA is configured such that in comprises properties: a(i), b(v), and c(i).

In an embodiment, the gRNA is configured such that in comprises properties: a(i), b(v), and c(ii).

In an embodiment, the gRNA is configured such that in comprises properties: a(i), b(vi), and c(i).

In an embodiment, the gRNA is configured such that in comprises properties: a(i), b(vi), and c(ii).

In an embodiment, the gRNA is configured such that in comprises properties: a(i), b(vii), and c(i).

In an embodiment, the gRNA is configured such that in comprises properties: a(i), b(vii), and c(ii).

In an embodiment, the gRNA is configured such that in comprises properties: a(i), b(viii), and c(i).

In an embodiment, the gRNA is configured such that in comprises properties: a(i), b(viii), and c(ii).

In an embodiment, the gRNA is configured such that in comprises properties: a(i), b(ix), and c(i).

In an embodiment, the gRNA is configured such that in comprises properties: a(i), b(ix), and c(ii).

In an embodiment, the gRNA is configured such that in comprises properties: a(i), b(x), and c(i).

In an embodiment, the gRNA is configured such that in comprises properties: a(i), b(x), and c(ii).

In an embodiment, the gRNA is configured such that in comprises properties: a(i), b(xi), and c(i).

In an embodiment, the gRNA is configured such that in comprises properties: a(i), b(xi), and c(ii).

In an embodiment, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at 840, e.g., the H840A.

In an embodiment, the gRNAs are used with a Cas9 nickase molecule having RuvC activity, e.g., a Cas9 molecule having the HNH activity inactivated, e.g., a Cas9 molecule having a mutation at N863, e.g., the N863A mutation.

In an embodiment, a pair of gRNAs, e.g., a pair of chimeric gRNAs, comprising a first and a second gRNA, is configured such that they comprises one or more of the following properties;

a) one or both of the gRNAs can position, e.g., when targeting a Cas9 molecule that makes single strand breaks, a single strand break within (i) 50, 100, 150, 200, 250, 300, 350, 400, 450, or 500 nucleotides of a target position, or (ii) sufficiently close that the target position is within the region of end resection;

b) one or both have a targeting domain of at least 16 nucleotides, e.g., a targeting domain of (i) 16, (ii), 17, (iii) 18, (iv) 19, (v) 20, (vi) 21, (vii) 22, (viii) 23, (ix) 24, (x) 25, or (xi) 26 nucleotides;

c) for one or both:

(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. pyogenes, S. thermophilus, S. aureus*, or *N. meningitidis* tail and proximal domain, or a sequence that differs by no more than 1, 2, 3, 4, 5; 6, 7, 8, 9 or 10 nucleotides therefrom;

(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;

(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. pyogenes, S. thermophilus, S. aureus*, or *N. meningitidis* gRNA, or a sequence that differs by no more than 1, 2, 3, 4, 5; 6, 7, 8, 9 or 10 nucleotides therefrom;

(iv) the tail domain is at least 10, 15, 20, 25, 30, 35 or 40 nucleotides in length, e.g., it comprises at least 10, 15, 20, 25, 30, 35 or 40 nucleotides from a naturally occurring *S. pyogenes, S. thermophilus, S. aureus*, or *N. meningitidis* tail domain; or, or a sequence that differs by no more than 1, 2, 3, 4, 5; 6, 7, 8, 9 or 10 nucleotides therefrom; or (v) the tail domain comprises 15, 20, 25, 30, 35, 40 nucleotides or all of the corresponding portions of a naturally occurring tail domain, e.g., a naturally occurring *S. pyogenes, S. thermophilus, S. aureus*, or *N. meningitidis* tail domain;

d) the gRNAs are configured such that, when hybridized to target nucleic acid, they are separated by 0-50, 0-100, 0-200, at least 10, at least 20, at least 30 or at least 50 nucleotides;

e) the breaks made by the first gRNA and second gRNA are on different strands; and f) the PAMs are facing outwards.

In an embodiment, one or both of the gRNAs is configured such that it comprises properties: a and b(i).

In an embodiment, one or both of the gRNAs is configured such that it comprises properties: a and b(ii).

In an embodiment, one or both of the gRNAs is configured such that it comprises properties: a and b(iii).

In an embodiment, one or both of the gRNAs is configured such that it comprises properties: a and b(iv).

In an embodiment, one or both of the gRNAs is configured such that it comprises properties: a and b(v).

In an embodiment, one or both of the gRNAs is configured such that it comprises properties: a and b(vi).

In an embodiment, one or both of the gRNAs is configured such that it comprises properties: a and b(vii).

In an embodiment, one or both of the gRNAs is configured such that it comprises properties: a and b(viii).

In an embodiment, one or both of the gRNAs is configured such that it comprises properties: a and b(ix).

In an embodiment, one or both of the gRNAs is configured such that it comprises properties: a and b(x).

In an embodiment, one or both of the gRNAs is configured such that it comprises properties: a and b(xi).

In an embodiment, one or both of the gRNAs configured such that it comprises properties: a and c.

In an embodiment, one or both of the gRNAs is configured such that it comprises properties: a, b, and c.

In an embodiment, one or both of the gRNAs is configured such that it comprises properties: a(i), b(i), and c(i).

In an embodiment, one or both of the gRNAs is configured such that it comprises properties: a(i), b(i), and c(ii).

In an embodiment, one or both of the gRNAs is configured such that it comprises properties: a(i), b(i), c, and d.

In an embodiment, one or both of the gRNAs is configured such that it comprises properties: a(i), b(i), c, and e.

In an embodiment, one or both of the gRNAs is configured such that it comprises properties: a(i), b(i), c, d, and e.

In an embodiment, one or both of the gRNAs is configured such that it comprises properties: a(i), b(ii), and c(i).

In an embodiment, one or both of the gRNAs is configured such that it comprises properties: a(i), b(ii), and c(ii).

In an embodiment, one or both of the gRNAs is configured such that it comprises properties: a(i), b(ii), c, and d.

In an embodiment, one or both of the gRNAs is configured such that it comprises properties: a(i), b(ii), c, and e.

In an embodiment, one or both of the gRNAs is configured such that it comprises properties: a(i), b(ii), c, d, and e.

In an embodiment, one or both of the gRNAs is configured such that it comprises properties: a(i), b(iii), and c(i).

In an embodiment, one or both of the gRNAs is configured such that it comprises properties: a(i), b(iii), and c(ii).

In an embodiment, one or both of the gRNAs is configured such that it comprises properties: a(i), b(iii), c, and d.

In an embodiment, one or both of the gRNAs is configured such that it comprises properties: a(i), b(iii), c, and e.

In an embodiment, one or both of the gRNAs is configured such that it comprises properties: a(i), b(iii), c, d, and e.

In an embodiment, one or both of the gRNAs is configured such that it comprises properties: a(i), b(iv), and c(i).

In an embodiment, one or both of the gRNAs is configured such that it comprises properties: a(i), b(iv), and c(ii).

In an embodiment, one or both of the gRNAs is configured such that it comprises properties: a(i), b(iv), c, and d.

In an embodiment, one or both of the gRNAs is configured such that it comprises properties: a(i), b(iv), c, and e.

In an embodiment, one or both of the gRNAs is configured such that it comprises properties: a(i), b(iv), c, d, and e.

In an embodiment, one or both of the gRNAs is configured such that it comprises properties: a(i), b(v), and c(i).

In an embodiment, one or both of the gRNAs is configured such that it comprises properties: a(i), b(v), and c(ii).

In an embodiment, one or both of the gRNAs is configured such that it comprises properties: a(i), b(v), c, and d.

In an embodiment, one or both of the gRNAs is configured such that it comprises properties: a(i), b(v), c, and e.

In an embodiment, one or both of the gRNAs is configured such that it comprises properties: a(i), b(v), c, d, and e.

In an embodiment, one or both of the gRNAs is configured such that it comprises properties: a(i), b(vi), and c(i).

In an embodiment, one or both of the gRNAs is configured such that it comprises properties: a(i), b(vi), and c(ii).

In an embodiment, one or both of the gRNAs is configured such that it comprises properties: a(i), b(vi), c, and d.

In an embodiment, one or both of the gRNAs is configured such that it comprises properties: a(i), b(vi), c, and e.

In an embodiment, one or both of the gRNAs is configured such that it comprises properties: a(i), b(vi), c, d, and e.

In an embodiment, one or both of the gRNAs is configured such that it comprises properties: a(i), b(vii), and c(i).

In an embodiment, one or both of the gRNAs is configured such that it comprises properties: a(i), b(vii), and c(ii).

In an embodiment, one or both of the gRNAs is configured such that it comprises properties: a(i), b(vii), c, and d.

In an embodiment, one or both of the gRNAs is configured such that it comprises properties: a(i), b(vii), c, and e.

In an embodiment, one or both of the gRNAs is configured such that it comprises properties: a(i), b(vii), c, d, and e.

In an embodiment, one or both of the gRNAs is configured such that it comprises properties: a(i), b(viii), and c(i).

In an embodiment, one or both of the gRNAs is configured such that it comprises properties: a(i), b(viii), and c(ii).

In an embodiment, one or both of the gRNAs is configured such that it comprises properties: a(i), b(viii), c, and d.

In an embodiment, one or both of the gRNAs is configured such that it comprises properties: a(i), b(viii), c, and e.

In an embodiment, one or both of the gRNAs is configured such that it comprises properties: a(i), b(viii), c, d, and e.

In an embodiment, one or both of the gRNAs is configured such that it comprises properties: a(i), b(ix), and c(i).

In an embodiment, one or both of the gRNAs is configured such that it comprises properties: a(i), b(ix), and c(ii).

In an embodiment, one or both of the gRNAs is configured such that it comprises properties: a(i), b(ix), c, and d.

In an embodiment, one or both of the gRNAs is configured such that it comprises properties: a(i), b(ix), c, and e.

In an embodiment, one or both of the gRNAs is configured such that it comprises properties: a(i), b(ix), c, d, and e.

In an embodiment, one or both of the gRNAs is configured such that it comprises properties: a(i), b(x), and c(i).

In an embodiment, one or both of the gRNAs is configured such that it comprises properties: a(i), b(x), and c(ii).

In an embodiment, one or both of the gRNAs is configured such that it comprises properties: a(i), b(x), c, and d.

In an embodiment, one or both of the gRNAs is configured such that it comprises properties: a(i), b(x), c, and e.

In an embodiment, one or both of the gRNAs is configured such that it comprises properties: a(i), b(x), c, d, and e.

In an embodiment, one or both of the gRNAs is configured such that it comprises properties: a(i), b(xi), and c(i).

In an embodiment, one or both of the gRNAs is configured such that it comprises properties: a(i), b(xi), and c(ii).

In an embodiment, one or both of the gRNAs is configured such that it comprises properties: a(i), b(xi), c, and d.

In an embodiment, one or both of the gRNAs is configured such that it comprises properties: a(i), b(xi), c, and e.

In an embodiment, one or both of the gRNAs is configured such that it comprises properties: a(i), b(xi), c, d, and e.

In an embodiment, the gRNAs are used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNAs are used with a Cas9 nickase molecule having RuvC activity, e.g., a Cas9 molecule having the HNH activity inactivated, e.g., a Cas9 molecule having a mutation at H840, e.g., the H840A mutation.

In an embodiment, the gRNAs are used with a Cas9 nickase molecule having RuvC activity, e.g., a Cas9 molecule having the HNH activity inactivated, e.g., a Cas9 molecule having a mutation at N863, e.g., the N863A mutation.

VI. Target Cells

Cas9 molecules, gRNA molecules (e.g., a Cas9 molecule/gRNA molecule complex), and donor nucleic acids can be used to manipulate a cell, e.g., to edit a target nucleic acid, in a wide variety of cells.

In an embodiment, a cell is manipulated by editing (e.g., correcting) the MYOC target gene, e.g., as described herein. In an embodiment, the expression of the MYOC target gene is modulated, e.g., in vivo. In another embodiment, the expression of the MYOC target gene is modulated, e.g., ex vivo.

The Cas9 and gRNA molecules described herein can be delivered to a target cell. In an embodiment, the target cell is a cell from the eye, e.g., a trabecular meshwork cell, retinal pigment epithelial cell, a retinal cell, an iris cell, a ciliary body cell and/or the optic nerve. In an embodiment, the target cell is a trabecular meshwork cell. In an embodiment, the target cell is a retinal cell, e.g., a cell of the retinal pigment epithelium or a photoreceptor cell. In an embodiment, the target cell is a cone photoreceptor cell or cone cell, a rod photoreceptor cell or rod cell, or a macular cone photoreceptor cell. In an embodiment, cone photoreceptors in the macular are targeted, i.e., cone photoreceptors in the macular are the target cells.

In an embodiment, the target cell is removed from the subject, the mutation corrected ex vivo, and the cell returned to the subject. In an embodiment, a photoreceptor cell is removed from the subject, the mutation corrected ex vivo, and the photoreceptor cell is returned to the subject. In an embodiment, a cone photoreceptor cell is removed from the subject, the mutation corrected ex vivo, and the cone photoreceptor cell is returned to the subject. In an embodiment, a trabecular meshwork cell is removed from the subject, the mutation corrected ex vivo, and the trabecular meshwork cell is returned to the subject.

In an embodiment, the cells are induced pluripotent stem cells (iPS) cells or cells derived from iPS cells, e.g., iPS cells from the subject, modified to alter the gene and differentiated into trabecular meshwork cells, retinal progenitor cells or retinal cells, e.g., retinal photoreceptors, and injected into the eye of the subject, e.g., into the trabecular meshwork, or, e.g., subretinally, e.g., in the submacular region of the retina.

In an embodiment, the cells are targeted in vivo, e.g., by delivery of the components, e.g., a Cas9 molecule and gRNA molecules, to the target cells. In an embodiment, the target cells are trabecular meshwork cells, retinal pigment epithelium or photoreceptor cells. In an embodiment, AAV is used to transduce the target cells.

VII. Delivery, Formulations and Routes of Administration

The components, e.g., a Cas9 molecule, gRNA molecule or template molecule, or all three, can be delivered, formulated or administered in a variety of forms, see, e.g., Tables 31-32. In an embodiment, one Cas9 molecule and two or more (e.g., 2, 3, 4, or more) different gRNA molecules are delivered, e.g., by an AAV vector. In an embodiment, the sequence encoding the Cas9 molecule and the sequence(s) encoding the two or more (e.g., 2, 3, 4, or more) different gRNA molecules are present on the same nucleic acid molecule, e.g., an AAV vector. When a Cas9 or gRNA component is encoded as DNA for delivery, the DNA will typically, but not necessarily, include a control region, e.g., comprising a promoter, to effect expression. Useful promoters for Cas9 molecule sequences include CMV, EFS, EF-1a, MSCV, PGK, CAG control promoters. In an embodiment, the promoter is a constitutive promoter. In another embodiment, the promoter is a tissue specific promoter. Useful promoters for gRNAs include H1, 7SK, tRNA and U6 promoters. Promoters with similar or dissimilar strengths can be selected to tune the expression of components. Sequences encoding a Cas9 molecule can comprise a nuclear localization signal (NLS), e.g., an 5V40 NLS. In an embodiment, the sequence encoding a Cas9 molecule comprises at least two nuclear localization signals. In an embodiment a promoter for a Cas9 molecule or a gRNA molecule can be, independently, inducible, tissue specific, or cell specific.

Table 31 provides examples of how the components can be formulated, delivered, or administered.

TABLE 31

| Elements | | | |
|---|---|---|---|
| Cas9 Molecule(s) | gRNA Molecule(s) | Donor Template Nucleic Acid | Comments |
| DNA | DNA | DNA | In this embodiment, a Cas9 molecule, typically an eaCas9 molecule, and a gRNA are transcribed from DNA. In this embodiment, they are encoded on separate |

TABLE 31-continued

| Elements | | | |
|---|---|---|---|
| Cas9 Molecule(s) | gRNA Molecule(s) | Donor Template Nucleic Acid | Comments |
| | | | molecules. In this embodiment, the donor template is provided as a separate DNA molecule. |
| DNA | DNA | | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the gRNA. |
| DNA | | DNA | In this embodiment, a Cas9 molecule, typically an eaCas9 molecule, and a gRNA are transcribed from DNA, here from a single molecule. In this embodiment, the donor template is provided as a separate DNA molecule. |
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the Cas9. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided as a separate DNA molecule. |
| DNA | RNA | DNA | In this embodiment, a Cas9 molecule, typically an eaCas9 molecule, is transcribed from DNA, and a gRNA is provided as in vitro transcribed or synthesized RNA. In this embodiment, the donor template is provided on the same DNA molecule that encodes the Cas9. |
| mRNA | RNA | DNA | In this embodiment, a Cas9 molecule, typically an eaCas9 molecule, is translated from in vitro transcribed mRNA, and a gRNA is provided as in vitro transcribed or synthesized RNA. In this embodiment, the donor template is provided as a DNA molecule. |
| mRNA | DNA | DNA | In this embodiment, a Cas9 molecule, typically an eaCas9 molecule, is translated from in vitro transcribed mRNA, and a gRNA is transcribed from DNA. In this embodiment, the donor template is provided as a separate DNA molecule. |
| mRNA | DNA | | In this embodiment, a Cas9 molecule, typically an eaCas9 molecule, is translated from in vitro transcribed mRNA, and a gRNA is transcribed from DNA. In this embodiment, the donor template is provided on the same DNA molecule that encodes the gRNA. |
| Protein | DNA | DNA | In this embodiment, a Cas9 molecule, typically an eaCas9 molecule, is provided as a protein, and a gRNA is transcribed from DNA. In this embodiment, the donor template is provided as a separate DNA molecule. |
| Protein | DNA | | In this embodiment, a Cas9 molecule, typically an eaCas9 molecule, is provided as a protein, and a gRNA is transcribed from DNA. In this embodiment, the donor template is provided on the same DNA molecule that encodes the gRNA. |
| Protein | RNA | DNA | In this embodiment, an eaCas9 molecule is provided as a protein, and a gRNA is provided as transcribed or synthesized RNA. In this embodiment, the donor template is provided as a DNA molecule. |

Table 32 summarizes various delivery methods for the components of a Cas system, e.g., the Cas9 molecule component and the gRNA molecule component, as described herein.

TABLE 32

| Delivery Vector/Mode | | Delivery into Non-Dividing Cells | Duration of Expression | Genome Integration | Type of Molecule Delivered |
|---|---|---|---|---|---|
| Physical (eg, electroporation, particle gun, Calcium Phosphate transfection, cell compression or squeezing) | | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nano-particles | YES | Transient | Depends on what is delivered | Nucleic Acids and Proteins |
| Biological Non-Viral Delively Vehicles | Attenuated Bacteria | YES | Transient | NO | Nucleic Acids |
| | Engineered Bacterio-phages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

DNA-Based Delivery of a Cas9 Molecule and/or One or More gRNA Molecule

Nucleic acids encoding Cas9 molecules (e.g., eaCas9 molecules), gRNA molecules, a donor template nucleic acid, or any combination (e.g., two or all) thereof, can be administered to subjects or delivered into cells by art-known methods or as described herein. For example, Cas9-encoding and/or gRNA-encoding DNA can be delivered, e.g., by vectors (e.g., viral or non-viral vectors), non-vector based methods (e.g., using naked DNA or DNA complexes), or a combination thereof.

Nucleic acids encoding Cas9 molecules (e.g., eaCas9 molecules) and/or gRNA molecules can be conjugated to molecules promoting uptake by the target cells (e.g., the target cells described herein). Donor template molecules can be conjugated to molecules promoting uptake by the target cells (e.g., the target cells described herein).

In some embodiments, the Cas9- and/or gRNA-encoding DNA is delivered by a vector (e.g., viral vector/virus or plasmid).

A vector can comprise a sequence that encodes a Cas9 molecule and/or a gRNA molecule. A vector can also comprise a sequence encoding a signal peptide (e.g., for nuclear localization, nucleolar localization, mitochondrial localization), fused, e.g., to a Cas9 molecule sequence. For example, ae vector can comprise a nuclear localization sequence (e.g., from SV40) fused to the sequence encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In some embodiments, the promoter is a viral promoter. In other embodiments, the promoter is a non-viral promoter.

In some embodiments, the vector or delivery vehicle is a viral vector (e.g., for generation of recombinant viruses). In some embodiments, the virus is a DNA virus (e.g., dsDNA or ssDNA virus). In another embodiment, the virus is an RNA virus (e.g., an ssRNA virus). In some embodiments, the virus infects dividing cells. In other embodiments, the virus infects non-dividing cells. Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects dividing cells. In other embodiments, the virus infects non-dividing cells. In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In another embodiment, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In an embodiment, the viral vector recognizes a specific cell type or tissue. For example, the viral vector can be pseudotyped with a different/alternative viral envelope glycoprotein; engineered with a cell type-specific receptor (e.g., genetic modification(s) of one or more viral envelope glycoproteins to incorporate a targeting ligand such as a peptide ligand, a single chain antibody, or a growth factor); and/or engineered to have a molecular bridge with dual specificities with one end recognizing a viral glycoprotein and the other end recognizing a moiety of the target cell surface (e.g., a ligand-receptor, monoclonal antibody, avidin-biotin and chemical conjugation).

Exemplary viral vectors/viruses include, e.g., retroviruses, lentiviruses, adenovirus, adeno-associated virus (AAV), vaccinia viruses, poxviruses, and herpes simplex viruses.

In some embodiments, the Cas9- and/or gRNA-encoding DNA is delivered by a recombinant retrovirus. In some embodiments, the retrovirus (e.g., Moloney murine leukemia virus) comprises a reverse transcriptase, e.g., that allows integration into the host genome. In some embodiments, the retrovirus is replication-competent. In other embodiments, the retrovirus is replication-defective, e.g., having one of more coding regions for the genes necessary for additional rounds of virion replication and packaging replaced with other genes, or deleted.

In some embodiments, the Cas9- and/or gRNA-encoding DNA is delivered by a recombinant lentivirus. For example, the lentivirus is replication-defective, e.g., does not comprise one or more genes required for viral replication.

In some embodiments, the Cas9- and/or gRNA-encoding DNA is delivered by a recombinant adenovirus. In some embodiments, the adenovirus is engineered to have reduced immunity in human.

In some embodiments, the Cas9- and/or gRNA-encoding DNA is delivered by a recombinant AAV. In some embodiments, the AAV does not incorporate its genome into that of a host cell, e.g., a target cell as describe herein. In some embodiments, the AAV can incorporate at least part of its genome into that of a host cell, e.g., a target cell as described herein. In some embodiments, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh 10, and pseudotyped AAV, such as AAV2/8, AAV2/5 and AAV2/6 can also be used in the disclosed methods. In an embodiment, an AAV capsid that can be used in the methods described herein is a capsid sequence from serotype AAV1, AAV2, AAV3, AAV4, AAV5, AAV6, AAV7, AAV8, AAV9, AAV.rh8, AAV.rh10, AAV.rh32/33, AAV.rh43, AAV.rh64R1, or AAV7m8.

In an embodiment, the Cas9- and/or gRNA-encoding DNA is delivered in a re-engineered AAV capsid, e.g., with 50% or greater, e.g., 60% or greater, 70% or greater, 80% or greater, 90% or greater, or 95% or greater, sequence homology with a capsid sequence from serotypes AAV1, AAV2, AAV3, AAV4, AAV5, AAV6, AAV7, AAV8, AAV9, AAV.rh8, AAV.rh10, AAV.rh32/33, AAV.rh43, or AAV.rh64R1.

In an embodiment, the Cas9- and/or gRNA-encoding DNA is delivered by a chimeric AAV capsid. Exemplary chimeric AAV capsids include, but are not limited to, AAV9i1, AAV2i8, AAV-DJ, AAV2G9, AAV2i8G9, or AAV8G9.

In an embodiment, the AAV is a self-complementary adeno-associated virus (scAAV), e.g., a scAAV that packages both strands which anneal together to form double stranded DNA.

In some embodiments, the Cas9- and/or gRNA-encoding DNA is delivered by a hybrid virus, e.g., a hybrid of one or more of the viruses described herein. In an embodiment, the hybrid virus is hybrid of an AAV (e.g., of any AAV serotype), with a Bocavirus, B19 virus, porcine AAV, goose AAV, feline AAV, canine AAV, or MVM.

A Packaging cell is used to form a virus particle that is capable of infecting a host or target cell. Such a cell includes a 293 cell, which can package adenovirus, and a ψ2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed. For example, an AAV vector used in gene therapy typically only possesses inverted terminal repeat (ITR) sequences from the AAV genome which are required for packaging and gene expression in the host or target cell. The missing viral functions can be supplied in trans by the packaging cell line and/or plasmid containing E2A, E4, and VA genes from adenovirus, and plasmid encoding Rep and Cap genes from AAV, as described in "Triple Transfection Protocol." Henceforth, the viral DNA is packaged in a cell line, which contains a helper plasmid encoding the other AAV genes, namely rep and cap, but lacking ITR sequences. In embodiment, the viral DNA is packaged in a producer cell line, which contains E1A and/or E1B genes from adenovirus. The cell line is also infected with adenovirus as a helper. The helper virus (e.g., adenovirus or HSV) or helper plasmid promotes replication of the AAV vector and expression of AAV genes from the helper plasmid with ITRs. The helper plasmid is not packaged in significant amounts due to a lack of ITR sequences. Contamination with adenovirus can be reduced by, e.g., heat treatment to which adenovirus is more sensitive than AAV.

In an embodiment, the viral vector has the ability of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibody, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas 9 and gRNA) in only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutinin (HA) can be incorporated to increase viral uptake into cells. In an embodiment, the viral vector has the ability of nuclear localization. For example, a virus that requires the breakdown of the nuclear envelope (during cell division) and therefore will not infect a non-diving cell can be altered to incorporate a nuclear localization peptide in the matrix protein of the virus thereby enabling the transduction of non-proliferating cells.

In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, transient cell compression or squeezing (e.g., as described in Lee, et al., Nano Lett 12: 6322-27), gene gun, sonoporation, magnetofection, lipid-mediated transfection, dendrimers, inorganic nanoparticles, calcium phosphates, or a combination thereof.

In an embodiment, delivery via electroporation comprises mixing the cells with the Cas9- and/or gRNA-encoding DNA in a cartridge, chamber or cuvette and applying one or more electrical impulses of defined duration and amplitude. In an embodiment, delivery via electroporation is performed using a system in which cells are mixed with the Cas9- and/or gRNA-encoding DNA in a vessel connected to a device (eg, a pump) which feeds the mixture into a cartridge, chamber or cuvette wherein one or more electrical impulses of defined duration and amplitude are applied, after which the cells are delivered to a second vessel.

In some embodiments, the Cas9- and/or gRNA-encoding DNA is delivered by a combination of a vector and a non-vector based method. In an embodiment, the donor template nucleic acid is delivered by a combination of a vector and a non-vector based method For example, a virosome comprises a liposome combined with an inactivated virus (e.g., HIV or influenza virus), which can result in more efficient gene transfer, e.g., in a respiratory epithelial cell than either a viral or a liposomal method alone.

In an embodiment, the delivery vehicle is a non-viral vector. In an embodiment, the non-viral vector is an inorganic nanoparticle (e.g., attached to the payload to the surface of the nanoparticle). Exemplary inorganic nanoparticles include, e.g., magnetic nanoparticles (e.g., $Fe_3MnO_2$), or silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 33.

TABLE 33

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |

TABLE 33-continued

Lipids Used for Gene Transfer

| Lipid | Abbreviation | Feature |
|---|---|---|
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 34.

TABLE 34

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine) biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amido ethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovescicle (30-100 nm) of endocytic origin (e.g., can be produced from various cell types and can therefore be taken up by cells without the need of for targeting ligands).

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein.

Delivery of RNA Encoding a Cas9 Molecule

RNA encoding Cas9 molecules (e.g., eaCas9 molecules, eiCas9 molecules or eiCas9 fusion proteins) and/or gRNA molecules, can be delivered into cells, e.g., target cells described herein, by art-known methods or as described herein. For example, Cas9-encoding and/or gRNA-encoding RNA can be delivered, e.g., by microinjection, electroporation, transient cell compression or squeezing (e.g., as described in Lee, et al., Nano Lett 12: 6322-27), lipid-mediated transfection, peptide-mediated delivery, or a combination thereof. Cas9-encoding and/or gRNA-encoding RNA can be conjugated to molecules promoting uptake by the target cells (e.g., target cells described herein).

In an embodiment, delivery via electroporation comprises mixing the cells with the RNA encoding Cas9 molecules (e.g., eaCas9 molecules, eiCas9 molecules or eiCas9 fusion proteins) and/or gRNA molecules, with or without donor template nucleic acid molecules, in a cartridge, chamber or cuvette and applying one or more electrical impulses of defined duration and amplitude. In an embodiment, delivery via electroporation is performed using a system in which cells are mixed with the RNA encoding Cas9 molecules (e.g., eaCas9 molecules, eiCas9 molecules or eiCas9 fusion proteins) and/or gRNA molecules, with or without donor template nucleic acid molecules in a vessel connected to a device (eg, a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the target cells (e.g., target cells described herein).

Delivery Cas9 Molecule Protein

Cas9 molecules (e.g., eaCas9 molecules, eiCas9 molecules or eiCas9 fusion proteins) can be delivered into cells by art-known methods or as described herein. For example, Cas9 protein molecules can be delivered, e.g., by microinjection, electroporation, transient cell compression or squeezing (e.g., as described in Lee, et al., Nano Lett 12: 6322-27), lipid-mediated transfection, peptide-mediated delivery, or a combination thereof. Delivery can be accompanied by DNA encoding a gRNA or by a gRNA. Cas9 protein can be conjugated to molecules promoting uptake by the target cells (e.g., target cells described herein).

In an embodiment, delivery via electroporation comprises mixing the cells with the Cas9 molecules (e.g., eaCas9 molecules, eiCas9 molecules or eiCas9 fusion proteins) and/or gRNA molecules, with or without donor nucleic acid, in a cartridge, chamber or cuvette and applying one or more electrical impulses of defined duration and amplitude. In an embodiment, delivery via electroporation is performed using a system in which cells are mixed with the Cas9 molecules (e.g., eaCas9 molecules, eiCas9 molecules or eiCas9 fusion proteins) and/or gRNA molecules, with or without donor nucleic acid in a vessel connected to a device (eg, a pump) which feeds the mixture into a cartridge, chamber or cuvette wherein one or more electrical impulses of defined duration and amplitude are applied, after which the cells are delivered to a second vessel. Cas9-encoding and/or gRNA-encoding RNA can be conjugated to molecules to promote uptake by the target cells (e.g., target cells described herein).

Route of Administration

Systemic modes of administration include oral and parenteral routes. Parenteral routes include, by way of example, intravenous, intrarterial, intraosseous, intramuscular, intradermal, subcutaneous, intranasal and intraperitoneal routes. Components administered systemically may be modified or formulated to target the components to the eye.

Local modes of administration include, by way of example, intraocular, intraorbital, subconjuctival, intravitreal, subretinal or transscleral routes, as well as delivery directly into the trabecular meshwork. In an embodiment, significantly smaller amounts of the components (compared with systemic approaches) may exert an effect when administered locally (for example, intravitreally) compared to when administered systemically (for example, intravenously). Local modes of administration can reduce or eliminate the incidence of potentially toxic side effects that may occur when therapeutically effective amounts of a component are administered systemically.

In an embodiment, components described herein are delivered subretinally, e.g., by subretinal injection. Subretinal injections may be made directly into the macular, e.g., submacular injection.

In an embodiment, components described herein are delivered by intravitreal injection. Intravitreal injection has a relatively low risk of retinal detachment risk. In an embodiment, nanoparticle or viral, e.g., AAV vector, e.g., an AAV2 vector, e.g., a modified AAV2 vector, is delivered intravitreally.

Methods for administration of agents to the eye are known in the medical arts and can be used to administer components described herein. Exemplary methods include intraocular injection (e.g., retrobulbar, subretinal, submacular, intravitreal and intrachoridal), iontophoresis, eye drops, and intraocular implantation (e.g., intravitreal, sub-Tenons and sub-conjunctival).

Administration may be provided as a periodic bolus (for example, subretinally, intravenously or intravitreally) or as continuous infusion from an internal reservoir (for example, from an implant disposed at an intra- or extra-ocular location (see, U.S. Pat. Nos. 5,443,505 and 5,766,242)) or from an external reservoir (for example, from an intravenous bag). Components may be administered locally, for example, by continuous release from a sustained release drug delivery device immobilized to an inner wall of the eye or via targeted transscleral controlled release into the choroid (see, for example, PCT/US00/00207, PCT/US02/14279, Ambati et al. (2000) INVEST. OPHTHALMOL. VIS. SCI. 41:1181-1185, and Ambati et al. (2000) INVEST. OPHTHALMOL. VIS. SCI. 41:1186-1191). A variety of devices suitable for administering components locally to the inside of the eye are known in the art. See, for example, U.S. Pat. Nos. 6,251,090, 6,299,895, 6,416,777, 6,413,540, and PCT/US00/28187.

In addition, components may be formulated to permit release over a prolonged period of time. A release system can include a matrix of a biodegradable material or a material which releases the incorporated components by diffusion. The components can be homogeneously or heterogeneously distributed within the release system. A variety of release systems may be useful, however, the choice of the appropriate system will depend upon rate of release required by a particular application. Both non-degradable and degradable release systems can be used. Suitable release systems include polymers and polymeric matrices, non-polymeric matrices, or inorganic and organic excipients and diluents such as, but not limited to, calcium carbonate and sugar (for example, trehalose). Release systems may be natural or synthetic. However, synthetic release systems are preferred because generally they are more reliable, more reproducible and produce more defined release profiles. The release system material can be selected so that components having different molecular weights are released by diffusion through or degradation of the material.

Representative synthetic, biodegradable polymers include, for example: polyamides such as poly(amino acids) and poly(peptides); polyesters such as poly(lactic acid), poly(glycolic acid), poly(lactic-co-glycolic acid), and poly (caprolactone); poly(anhydrides); polyorthoesters; polycarbonates; and chemical derivatives thereof (substitutions, additions of chemical groups, for example, alkyl, alkylene, hydroxylations, oxidations, and other modifications routinely made by those skilled in the art), copolymers and mixtures thereof. Representative synthetic, non-degradable polymers include, for example: polyethers such as poly (ethylene oxide), poly(ethylene glycol), and poly(tetramethylene oxide); vinyl polymers-polyacrylates and polymethacrylates such as methyl, ethyl, other alkyl, hydroxyethyl methacrylate, acrylic and methacrylic acids, and others such as poly(vinyl alcohol), poly(vinyl pyrolidone), and poly (vinyl acetate); poly(urethanes); cellulose and its derivatives such as alkyl, hydroxyalkyl, ethers, esters, nitrocellulose, and various cellulose acetates; polysiloxanes; and any chemical derivatives thereof (substitutions, additions of chemical groups, for example, alkyl, alkylene, hydroxylations, oxidations, and other modifications routinely made by those skilled in the art), copolymers and mixtures thereof.

Poly(lactide-co-glycolide) microsphere can also be used for intraocular injection. Typically the microspheres are composed of a polymer of lactic acid and glycolic acid, which are structured to form hollow spheres. The spheres can be approximately 15-30 microns in diameter and can be loaded with components described herein.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety.

In an embodiment, the Cas9 molecule and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, gRNA molecule, or template nucleic acid. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno-associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In an embodiment, a gRNA molecule can be delivered by such modes. The Cas9 molecule component can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmcokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. E.g., the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment, the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

Ex Vivo Delivery

In some embodiments, components described in Table 31 are introduced into cells which are then introduced into the subject e.g., cells are removed from a subject, manipulated ex vivo and then introduced into the subject. Methods of introducing the components can include, e.g., any of the delivery methods described herein, e.g., any of the delivery methods described in Table 32.

VIII. Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein, "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose sugar, e.g., of the 2' hydroxyl on the ribose sugar;

(iii) wholesale replacement of the phosphate moiety with "dephospho" linkers;

(iv) modification or replacement of a naturally occurring nucleobase;

(v) replacement or modification of the ribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA is modified, e.g., all bases have a modified phosphate group, e.g., all are phosphorothioate groups. In an embodiment, all, or substantially all, of the phosphate groups of a unimolecular or modular gRNA molecule are replaced with phosphorothioate groups.

In an embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications

The Phosphate Group

In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), ($OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine ($ho^5U$), 5-aminoallyl-uridine, 5-halo-uridine (e.g., 5-iodo-uridine or 5-bromo-uridine), 3-methyl-uridine ($m^3U$), 5-methoxy-uridine ($mo^5U$), uridine 5-oxyacetic acid ($cmo^5U$), uridine 5-oxyacetic acid methyl ester ($mcmo^5U$), 5-carboxymethyl-uridine ($cm^5U$), 1-carboxymethyl-pseudouridine, 5-carboxyhydroxymethyl-uridine ($chm^5U$), 5-carboxyhydroxymethyl-uridine methyl ester ($mchm^5U$), 5-methoxycarbonylmethyl-uridine ($mcm^5U$), 5-methoxycarbonylmethyl-2-thio-uridine ($mcm^5s2U$), 5-aminomethyl-2-thio-uridine ($nm^5s2U$), 5-methylaminomethyl-uridine ($mnm^5U$), 5-methylaminomethyl-2-thio-uridine ($mnm^5s2U$), 5-methylaminomethyl-2-seleno-uridine ($mnm^5se^2U$), 5-carbamoylmethyl-uridine ($ncm^5U$), 5-carboxymethylaminomethyl-uridine ($cmnm^5U$), 5-carboxymethylaminomethyl-2-thio-uridine ($cmnm^5s2U$), 5-propynyl-uridine, 1-propynyl-pseudouridine, 5-taurinomethyl-uridine ($Tcm^5U$), 1-taurinomethyl-pseudouridine, 5-taurinomethyl-2-thio-uridine($\tau m^5s2U$), 1-taurinomethyl-4-thio-pseudouridine, 5-methyl-uridine ($m^5U$, i.e., having the nucleobase deoxythymine), 1-methyl-pseudouridine ($m^1\psi$), 5-methyl-2-thio-uridine ($m^5s2U$), 1-methyl-4-thio-pseudouridine ($m^1s^4\psi$), 4-thio-1-methyl-pseudouridine, 3-methyl-pseudouridine ($m^3\psi$), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine ($m^5D$), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl) uridine ($acp^3U$), 1-methyl-3-(3-amino-3-carboxypropyl) pseudouridine ($acp^3\psi$), 5-(isopentenylaminomethyl)uridine ($inm^5U$), 5-(isopentenylaminomethyl)-2-thio-uridine (inm$^5$s2U), α-thio-uridine, 2'-O-methyl-uridine (Um), 5,2'-O-dimethyl-uridine (m$^5$Um), 2'-O-methyl-pseudouridine (ψm), 2-thio-2'-O-methyl-uridine (s2Um), 5-methoxycarbonylmethyl-2'-O-methyl-uridine (mcm$^5$Um), 5-carbamoylmethyl-2'-O-methyl-uridine (ncm$^5$Um), 5-carboxymethylaminomethyl-2'-O-methyl-uridine (cmnm$^5$Um), 3,2'-O-dimethyl-uridine (m$^3$Um), 5-(isopentenylaminomethyl)-2'-O-methyl-uridine (inm$^5$Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m$^3$C), N4-acetyl-cytidine (act), 5-formyl-cytidine (f$^5$C), N4-methyl-cytidine (m$^4$C), 5-methyl-cytidine (m$^5$C), 5-halo-cytidine (e.g., 5-iodo-cytidine), 5-hydroxymethyl-cytidine (hm$^5$C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k$^2$C), α-thio-cytidine, 2'-O-methyl-cytidine (Cm), 5,2'-O-dimethyl-cytidine (m$^5$Cm), N4-acetyl-2'-O-methyl-cytidine (ac$^4$Cm), N4,2'-O-dimethyl-cytidine (m$^4$Cm), 5-formyl-2'-O-methyl-cytidine (f$^5$Cm), N4,N4,2'-O-trimethyl-cytidine (m$^4_2$Cm), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenosine, 7-deaza-8-aza-adenosine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m$^1$A), 2-methyl-adenosine (m$^2$A), N6-methyl-adenosine (m$^6$A), 2-methylthio-N6-methyl-adenosine (ms$^2$m$^6$A), N6-isopentenyl-adenosine (i$^6$A), 2-methylthio-N6-isopentenyl-adenosine (ms$^2$i$^6$A), N6-(cis-hydroxyisopentenyl)adenosine (io$^6$A), 2-methylthio-N6-(cis-hydroxyisopentenyl)adenosine (ms2i$^6$A), N6-glycinylcarbamoyl-adenosine (g$^6$A), N6-threonylcarbamoyl-adenosine (t$^6$A), N6-methyl-N6-threonylcarbamoyl-adenosine (m$^6$t$^6$A), 2-methylthio-N6-threonylcarbamoyl-adenosine (ms$^2$g$^6$A), N6,N6-dimethyl-adenosine (m$^6_2$A), N6-hydroxynorvalylcarbamoyl-adenosine (hn$^6$A), 2-methylthio-N6-hydroxynorvalylcarbamoyl-adenosine (ms2hn$^6$A), N6-acetyl-adenosine (ac$^6$A), 7-methyl-adenosine, 2-methylthio-adenosine, 2-methoxy-adenosine, α-thio-adenosine, 2'-O-methyl-adenosine (Am), N$^6$,2'-O-dimethyl-adenosine (m$^6$Am), N$^6$-Methyl-2'-deoxyadenosine, N6,N6,2'-O-trimethyl-adenosine (m$^6_2$Am), 1,2'-O-dimethyl-adenosine (m$^1$Am), 2'-O-ribosyladenosine (phosphate) (Ar (p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine (m$^1$I), wyosine (imG), methylwyosine (mimG), 4-demethyl-wyosine (imG-14), isowyosine (imG2), wybutosine (yW), peroxywybutosine (o$_2$yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ$_0$), 7-aminomethyl-7-deaza-guanosine (PreQ$_1$), archaeosine (G$^+$), 7-deaza-8-aza-guanosine, 6-thio-guanosine, 6-thio-7-deaza-guanosine, 6-thio-7-deaza-8-aza-guanosine, 7-methyl-guanosine (m$^7$G), 6-thio-7-methyl-guanosine, 7-methyl-inosine, 6-methoxy-guanosine, 1-methyl-guanosine (m'G), N2-methyl-guanosine (m$^2$G), N2,N2-dimethyl-guanosine (m$^2_2$G), N2,7-dimethyl-guanosine (m$^2$,7G), N2, N2,7-dimethyl-guanosine (m$^2$,2,7G), 8-oxo-guanosine, 7-methyl-8-oxo-guanosine, 1-methyl-6-thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m$^2$Gm), N2,N2-dimethyl-2'-O-methyl-guanosine (m$^2_2$Gm), 1-methyl-2'-O-methyl-guanosine (m$^2$Gm), N2,7-dimethyl-2'-O-methyl-guanosine (m$^2$,7Gm), 2'-O-methyl-inosine (Im), 1,2'-O-dimethyl-inosine (m'Im), O$^6$-phenyl-2'-deoxyinosine, 2'-O-ribosylguanosine (phosphate) (Gr(p)), 1-thio-guanosine, O$^6$-methyl-guanosine, O$^6$-Methyl-2'-deoxyguanosine, 2'-F-ara-guanosine, and 2'-F-guanosine.

Exemplary Modified gRNAs

In some embodiments, the modified nucleic acids can be modified gRNAs. It is to be understood that any of the gRNAs described herein can be modified in accordance with this section, including any gRNA that comprises a targeting domain from Tables 1A-1E, 2A-2E, 3A-3E, 4A-4E, 5A-5F, 6A-6E, 7A-7G, 8A-8E, 9A-9E, 10A-10G, 11A-11E, 12A-12D, 13A-13E, 14A-14C, 15A-15D, 16A-16E, 17A-17B, 18A-18D, 19A-19E, 20A-20D, 21A-21D, 22A-22E, or 23A-23B.

As discussed above, transiently expressed or delivered nucleic acids can be prone to degradation by, e.g., cellular nucleases. Accordingly, in one aspect the modified gRNAs described herein can contain one or more modified nucleosides or nucleotides which introduce stability toward nucleases. While not wishing to be bound by theory it is also believed that certain modified gRNAs described herein can exhibit a reduced innate immune response when introduced into a population of cells, particularly the cells of the present invention. As noted above, the term "innate immune response" includes a cellular response to exogenous nucleic acids, including single stranded nucleic acids, generally of viral or bacterial origin, which involves the induction of cytokine expression and release, particularly the interferons, and cell death.

While some of the exemplary modification discussed in this section may be included at any position within the gRNA sequence, in some embodiments, a gRNA comprises a modification at or near its 5' end (e.g., within 1-10, 1-5, or 1-2 nucleotides of its 5' end). In some embodiments, a gRNA comprises a modification at or near its 3' end (e.g., within 1-10, 1-5, or 1-2 nucleotides of its 3' end). In some embodiments, a gRNA comprises both a modification at or near its 5' end and a modification at or near its 3' end.

In an embodiment, the 5' end of a gRNA is modified by the inclusion of a eukaryotic mRNA cap structure or cap analog (e.g., a G(5)ppp(5)G cap analog, a m7G(5)ppp(5)G cap analog, or a 3'-O-Me-m7G(5)ppp(5)G anti reverse cap analog (ARCA)). The cap or cap analog can be included during either chemical synthesis or in vitro transcription of the gRNA.

In an embodiment, an in vitro transcribed gRNA is modified by treatment with a phosphatase (e.g., calf intestinal alkaline phosphatase) to remove the 5' triphosphate group.

In an embodiment, the 3' end of a gRNA is modified by the addition of one or more (e.g., 25-200) adenine (A) residues. The polyA tract can be contained in the nucleic acid (e.g., plasmid, PCR product, viral genome) encoding the gRNA, or can be added to the gRNA during chemical synthesis, or following in vitro transcription using a polyadenosine polymerase (e.g., *E. coli* Poly(A)Polymerase).

In an embodiment, in vitro transcribed gRNA contains both a 5' cap structure or cap analog and a 3' polyA tract. In an embodiment, an in vitro transcribed gRNA is modified by treatment with a phosphatase (e.g., calf intestinal alkaline phosphatase) to remove the 5' triphosphate group and comprises a 3' polyA tract.

In some embodiments, gRNAs can be modified at a 3' terminal U ribose. For example, the two terminal hydroxyl groups of the U ribose can be oxidized to aldehyde groups and a concomitant opening of the ribose ring to afford a modified nucleoside as shown below:

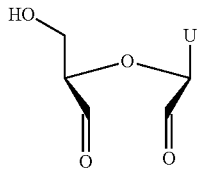

wherein "U" can be an unmodified or modified uridine.

In another embodiment, the 3' terminal U can be modified with a 2'3' cyclic phosphate as shown below:

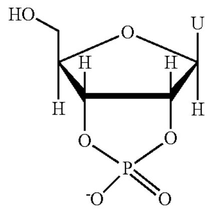

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein.

In some embodiments, sugar-modified ribonucleotides can be incorporated into the gRNA, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., $NH_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, one or more of the nucleotides of the gRNA can each independently be a modified or unmodified nucleotide including, but not limited to 2'-sugar modified, such as, 2'-O-methyl, 2'-O-methoxyethyl, or 2'-Fluoro modified including, e.g., 2'-F or 2'-O-methyl, adenosine (A), 2'-F or 2'-O-methyl, cytidine (C), 2'-F or 2'-O-methyl, uridine (U), 2'-F or 2'-O-methyl, thymidine (T), 2'-F or 2'-O-methyl, guanosine (G), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In some embodiments, a gRNA can include "locked" nucleic acids (LNA) in which the 2' OH-group can be connected, e.g., by a C1-6 alkylene or C1-6 heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy or $O(CH_2)_n$-amino (wherein amino can be, e.g., $NH_2$; alkylamino, dialkylamino, heterocyclyl, arylamino, diarylamino, heteroarylamino, or diheteroarylamino, ethylenediamine, or polyamino).

In some embodiments, a gRNA can include a modified nucleotide which is multicyclic (e.g., tricyclo; and "unlocked" forms, such as glycol nucleic acid (GNA) (e.g., R-GNA or S-GNA, where ribose is replaced by glycol units attached to phosphodiester bonds), or threose nucleic acid (TNA, where ribose is replaced with α-L-threofuranosyl-(3'→2')).

Generally, gRNA molecules include the sugar group ribose, which is a 5-membered ring having an oxygen. Exemplary modified gRNAs can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). Although the majority of sugar analog alterations are localized to the 2' position, other sites are amenable to modification, including the 4' position. In an embodiment, a gRNA comprises a 4'-S, 4'-Se or a 4'-C-aminomethyl-2'-O-Me modification.

In some embodiments, deaza nucleotides, e.g., 7-deaza-adenosine, can be incorporated into the gRNA. In some embodiments, O- and N-alkylated nucleotides, e.g., N6-methyl adenosine, can be incorporated into the gRNA. In some embodiments, one or more or all of the nucleotides in a gRNA molecule are deoxynucleotides.

miRNA Binding Sites microRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory it is believed that the down regulation is either by reducing nucleic acid molecule stability or by inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

EXAMPLES

The following Examples are merely illustrative and are not intended to limit the scope or content of the invention in any way.

Example 1: Evaluation of Candidate Guide RNAs (gRNAs)

The suitability of candidate gRNAs can be evaluated as described in this example. Although described for a chimeric gRNA, the approach can also be used to evaluate modular gRNAs.

Cloning gRNAs into Vectors

For each gRNA, a pair of overlapping oligonucleotides is designed and obtained. Oligonucleotides are annealed and ligated into a digested vector backbone containing an upstream U6 promoter and the remaining sequence of a long chimeric gRNA. Plasmid is sequence-verified and prepped to generate sufficient amounts of transfection-quality DNA. Alternate promoters may be used to drive in vivo transcription (e.g. H1 promoter) or for in vitro transcription (e.g., a T7 promoter).

Cloning gRNAs in Linear dsDNA Molecule (STITCHR)

For each gRNA, a single oligonucleotide is designed and obtained. The U6 promoter and the gRNA scaffold (e.g. including everything except the targeting domain, e.g., including sequences derived from the crRNA and tracrRNA, e.g., including a first complementarity domain; a linking domain; a second complementarity domain; a proximal domain; and a tail domain) are separately PCR amplified and purified as dsDNA molecules. The gRNA-specific oligonucleotide is used in a PCR reaction to stitch together the U6 and the gRNA scaffold, linked by the targeting domain specified in the oligonucleotide. Resulting dsDNA molecule (STITCHR product) is purified for transfection. Alternate promoters may be used to drive in vivo transcription (e.g., H1 promoter) or for in vitro transcription (e.g., T7 promoter). Any gRNA scaffold may be used to create gRNAs compatible with Cas9s from any bacterial species.

Initial gRNA Screen

Each gRNA to be tested is transfected, along with a plasmid expressing Cas9 and a small amount of a GFP-expressing plasmid into human cells. In preliminary experiments, these cells can be immortalized human cell lines such as 293T, K562 or U2OS. Alternatively, primary human cells may be used. In this case, cells may be relevant to the eventual therapeutic cell target (for example, photoreceptor cells). The use of primary cells similar to the potential therapeutic target cell population may provide important information on gene targeting rates in the context of endogenous chromatin and gene expression.

Transfection may be performed using lipid transfection (such as Lipofectamine or Fugene) or by electroporation (such as Lonza Nucleofection). Following transfection, GFP expression can be determined either by fluorescence microscopy or by flow cytometry to confirm consistent and high levels of transfection. These preliminary transfections can comprise different gRNAs and different targeting approaches (17-mers, 20-mers, nuclease, dual-nickase, etc.) to determine which gRNAs/combinations of gRNAs give the greatest activity.

Efficiency of cleavage with each gRNA may be assessed by measuring NHEJ-induced indel formation at the target locus by a T7E1-type assay or by sequencing. Alternatively, other mismatch-sensitive enzymes, such as Cell/Surveyor nuclease, may also be used.

For the T7E1 assay, PCR amplicons are approximately 500-700 bp with the intended cut site placed asymmetrically in the amplicon. Following amplification, purification and size-verification of PCR products, DNA is denatured and re-hybridized by heating to 95° C. and then slowly cooling. Hybridized PCR products are then digested with T7 Endonuclease I (or other mismatch-sensitive enzyme) which recognizes and cleaves non-perfectly matched DNA. If indels are present in the original template DNA, when the amplicons are denatured and re-annealed, this results in the hybridization of DNA strands harboring different indels and therefore lead to double-stranded DNA that is not perfectly matched. Digestion products may be visualized by gel electrophoresis or by capillary electrophoresis. The fraction of DNA that is cleaved (density of cleavage products divided by the density of cleaved and uncleaved) may be used to estimate a percent NHEJ using the following equation: % NHEJ=$(1-(1-\text{fraction cleaved})^{1/2})$. The T7E1 assay is sensitive down to about 2-5% NHEJ.

Sequencing may be used instead of, or in addition to, the T7E1 assay. For Sanger sequencing, purified PCR amplicons are cloned into a plasmid backbone, transformed, miniprepped and sequenced with a single primer. Sanger sequencing may be used for determining the exact nature of indels after determining the NHEJ rate by T7E1.

Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low NHEJ rates.

Example 2: Assessment of Gene Targeting by NHEJ

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency to generate the desired mutations (either knockout of a target gene or removal of a target sequence motif) may be determined by sequencing. For Sanger sequencing, PCR amplicons may be 500-700 bp long. For next generation sequencing, PCR amplicons may be 300-500 bp long. If the goal is to knockout gene function, sequencing may be used to assess what percent of alleles have undergone NHEJ-induced indels that result in a frameshift or large deletion or insertion that would be expected to destroy gene function. If the goal is to remove a specific sequence motif, sequencing may be used to assess what percent of alleles have undergone NHEJ-induced deletions that span this sequence.

Example 3: Assessment of Gene Targeting by HDR

The gRNAs that induce the greatest levels of NHEJ in initial tests can be selected for further evaluation of gene targeting efficiency. In this case, cells are derived from disease subjects and, therefore, harbor the relevant mutation.

Following transfection (usually 2-3 days post-transfection) genomic DNA may be isolated from a bulk population of transfected cells and PCR may be used to amplify the target region. Following PCR, gene targeting efficiency can be determined by several methods.

Determination of gene targeting frequency involves measuring the percentage of alleles that have undergone homologous directed repair (HDR) with the donor template and which therefore have incorporated desired correction. If the desired HDR event creates or destroys a restriction enzyme site, the frequency of gene targeting may be determined by a RFLP assay. If no restriction site is created or destroyed, sequencing may be used to determine gene targeting frequency. If a RFLP assay is used, sequencing may still be used to verify the desired HDR event and ensure that no other mutations are present. At least one of the primers is placed in the endogenous gene sequence outside of the region included in the homology arms, which prevents amplification of donor template still present in the cells. Therefore, the length of the homology arms present in the donor template may affect the length of the PCR amplicon. PCR amplicons can either span the entire donor region (both primers placed outside the homology arms) or they can span only part of the donor region and a single junction between donor and endogenous DNA (one internal and one external primer). If the amplicons span less than entire donor region, two different PCRs should be used to amplify and sequence both the 5' and the 3' junction.

If the PCR amplicon is short (less than 600 bp) it is possible to use next generation sequencing. Following PCR, next generation sequencing adapters and barcodes (for example Illumina multiplex adapters and indexes) may be added to the ends of the amplicon, e.g., for use in high throughput sequencing (for example on an Illumina MiSeq). This method allows for detection of very low gene targeting rates.

If the PCR amplicon is too long for next generation sequencing, Sanger sequencing can be performed. For Sanger sequencing, purified PCR amplicons will be cloned into a plasmid backbone (for example, TOPO cloned using the LifeTech Zero Blunt® TOPO® cloning kit), transformed, miniprepped and sequenced.

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (8865 sequences)

SEQ ID NO: 1 - protein, 1344 aa, Streptococcus mutans
KKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 2 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 3 - protein, 1387 aa, Streptococcus thermophilus
TKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 4 - protein, 1333 aa, Listeria innocua
KKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 5 - RNA, 96 nt, Artificial Sequence
  Synthetic oligonucleotide
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugc

SEQ ID NO: 6 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 7 - protein, 1368 aa, Streptococcus pyogenes [sequence omitted]

SEQ ID NO: 8 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (6)..(6): Xaa is Ser or Tyr or Asn or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXXXGXXXX

SEQ ID NO: 9 - protein, 12 aa, Artificial Sequence
  Synthetic peptide
  VARIANT (2)..(2): Xaa is Ile or Val or Met or Leu or Thr
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (7)..(7): Xaa is Val or Ile or Leu or Cys or Thr or Phe
  VARIANT (9)..(9): Xaa is Trp or Phe or Val or Tyr or Ser or Leu
  VARIANT (10)..(10): Xaa is Ala or Ser or Cys or Val or Gly
  VARIANT (11)..(11): Xaa is Val or Ile or Leu or Ala or Met or His
  VARIANT (12)..(12): Any amino acid or absent
DXGXXSXGXXXX

SEQ ID NO: 10 - protein, 12 aa, Artificial Sequence
  Synthetic peptide
  VARIANT (4)..(4): Xaa is Thr or Ile or Val or Ser or Asn or Tyr or Glu or Leu
  VARIANT (5)..(5): Xaa is Asn or Ser or Gly or Ala or Asp or Thr or Arg or Met or Phe
  VARIANT (11)..(11): Xaa is Val or Ile or Leu or Ala or Met or His
  VARIANT (12)..(12): Any amino acid or absent
DIGXXSVGWAXX

SEQ ID NO: 11 - protein, 12 aa, Artificial Sequence
  Synthetic peptide
  MOD_RES (12)..(12): Any non-polar alkyl amino acid or a hydroxyl amino acid
DIGTNSVGWAVX

SEQ ID NO: 12 - protein, 8 aa, Artificial Sequence
  Synthetic peptide
  VARIANT (2)..(2): Xaa is Val or His
  VARIANT (3)..(3): Xaa is Ile or Leu or Val
  VARIANT (5)..(5): Xaa is Met or Thr
IXXEXARE

SEQ ID NO: 13 - protein, 8 aa, Artificial Sequence
  Synthetic peptide
  VARIANT (3)..(3): Xaa is Ile or Leu or Val
IVXEMARE

SEQ ID NO: 14 - protein, 8 aa, Artificial Sequence
  Synthetic peptide
  VARIANT (4)..(4): Xaa is His or Leu
  VARIANT (7)..(7): Xaa is Arg or Val
  VARIANT (8)..(8): Xaa is Glu or Val
HHAXDAXX

SEQ ID NO: 15 - protein, 8 aa, Artificial Sequence
  Synthetic peptide
HHAHDAYL

SEQ ID NO: 16 - protein, 30 aa, Artificial Sequence
  Synthetic polypeptide
  VARIANT (2)..(2): Xaa is Lys or Pro
  VARIANT (4)..(4): Xaa is Val or Leu or Ile or Phe
  VARIANT (5)..(5): Xaa is Gly or Ala or Ser
  VARIANT (6)..(6): Xaa is Leu or Ile or Val or Phe
  MOD_RES (7)..(26): Any amino acid and this region may encompass 5-20 residues wherein some positions may be absent
  VARIANT (29)..(29): Xaa is Asp or Glu or Asn or Gln
KXYXXXXXXXXXXXXXXXXXXXXXXXTDXY

SEQ ID NO: 17 - protein, 27 aa, Artificial Sequence
  Synthetic peptide
  VARIANT (1)..(1): Xaa is Asp or Glu or Gln or Asn
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (9)..(9): Xaa is Ser or Ala or Asp or Thr or Lys
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (13)..(13): Xaa is Asp or Ser or Asn or Arg or Leu or Thr
  VARIANT (14)..(14): Xaa is Asp or Asn or Ser
  VARIANT (15)..(15): Xaa is Ser or Ala or Thr or Gly or Arg
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (19)..(19): Xaa is Lys or Leu or Arg or Met or Thr or Phe
  VARIANT (20)..(20): Xaa is Val or Leu or Ile or Ala or Thr
  VARIANT (21)..(21): Xaa is Leu or Ile or Val or Ala
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XXXHXXPXXXXXXXXXXNXXXXXXXXN

SEQ ID NO: 18 - protein, 27 aa, Artificial Sequence
  Synthetic peptide
  VARIANT (1)..(1): Xaa is Asp or Glu
  VARIANT (2)..(2): Xaa is Leu or Ile or Arg or Gln or Val or Met or Lys
  VARIANT (3)..(3): Xaa is Asp or Glu
  VARIANT (5)..(5): Xaa is Ile or Val or Thr or Ala or Leu
  VARIANT (6)..(6): Xaa is Val or Tyr or Ile or Leu or Phe or Trp
  VARIANT (8)..(8): Xaa is Gln or His or Arg or Lys or Tyr or Ile or Leu or Phe or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (22)..(22): Xaa is Thr or Val or Cys or Glu or Ser or Ala
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys Met or Asp or Phe
XXXHXXPXSXXXDDSXXNKVLXXXXXN

SEQ ID NO: 19 - protein, 27 aa, Artificial Sequence
  Synthetic peptide
  VARIANT (1)..(1): Xaa is Asp or Glu
  VARIANT (3)..(3): Xaa is Asp or Glu
  VARIANT (8)..(8): Xaa is Gln or His or Arg or Lys or Tyr or Ile or Leu or Trp
  VARIANT (10)..(10): Xaa is Phe or Leu or Val or Lys or Tyr or Met or Ile or Arg or Ala or Glu or Asp or Gln
  VARIANT (11)..(11): Xaa is Leu or Arg or Thr or Ile or Val or Ser or Cys or Tyr or Lys or Phe or Gly
  VARIANT (12)..(12): Xaa is Lys or Gln or Tyr or Thr or Phe or Leu or Trp or Met or Ala or Glu or Gly or Ser
  VARIANT (16)..(16): Xaa is Ile or Leu or Phe or Ser or Arg or Tyr or Gln or Trp or Asp or Lys or His
  VARIANT (17)..(17): Xaa is Asp or Ser or Ile or Asn or Glu or Ala or His or Phe or Leu or Gln or Met or Gly or Tyr or Val
  VARIANT (23)..(23): Xaa is Arg or Phe or Thr or Trp or Glu or Leu or Asn or Cys or Lys or Val or Ser or Gln or Ile or Tyr or His or Ala
  VARIANT (24)..(24): Xaa is Ser or Pro or Arg or Lys or Asn or Ala or His or Gln or Gly or Leu
  VARIANT (25)..(25): Xaa is Asp or Gly or Thr or Asn or Ser or Lys or Ala or Ile or Glu or Leu or Gln or Arg or Tyr
  VARIANT (26)..(26): Xaa is Lys or Val or Ala or Glu or Tyr or Ile or Cys or Leu or Ser or Thr or Gly or Lys or Met or Asp or Phe
XVXHIVPXSXXXDDSXXNKVLTXXXXN

SEQ ID NO: 20 - protein, 27 aa, Artificial Sequence
  Synthetic peptide
  VARIANT (2)..(2): Xaa is Ile or Val
  VARIANT (6)..(6): Xaa is Ile or Val
  VARIANT (9)..(9): Xaa is Ala or Ser
  VARIANT (11)..(11): Xaa is Ile or Leu
  VARIANT (12)..(12): Xaa is Lys or Thr
  VARIANT (14)..(14): Xaa is Asp or Asn
  VARIANT (19)..(19): Xaa is Arg or Lys or Leu
  VARIANT (22)..(22): Xaa is Thr or Val
  VARIANT (23)..(23): Xaa is Ser or Arg
  VARIANT (25)..(25): Xaa is Lys or Asp or Ala
  VARIANT (26)..(26): Xaa is Glu or Lys or Gly or Asn
DXDHIXPQXFXXDXSIDNXVLXXSXXN

SEQ ID NO: 21 - protein, 73 aa, Artificial Sequence
  Synthetic polypeptide
  VARIANT (8)..(8): Xaa is Lys or Arg
  VARIANT (12)..(12): Xaa is Val or Thr
  VARIANT (13)..(13): Xaa is Gly or Asp
  VARIANT (14)..(14): Xaa is Glu or Gln or Asp
  VARIANT (15)..(15): Xaa is Glu or Asp
  VARIANT (19)..(19): Xaa is Asp or Asn or His
  VARIANT (20)..(20): Xaa is Tyr or Arg or Asn
  VARIANT (23)..(23): Xaa is Gln or Asp or Asn
  MOD_RES (25)..(64): Any amino acid and this region may encompass 15-40 residues wherein some positions may be absent
  VARIANT (67)..(67): Xaa is Gly or Glu
  VARIANT (69)..(69): Xaa is Ser or Gly
  VARIANT (71)..(71): Xaa is Asp or Asn
LYYLQNGXDMYXXXXLDIXXLSXYXXXXXXXXXXXXXXXXXXXXXXXXXXXXXXXXXXXXXXXXNRXKXDXVP

SEQ ID NO: 22 - DNA, 4107 bp, Artificial Sequence
  Synthetic polynucleotide
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 23 - protein, 1368 aa, Streptococcus pyogenes [sequence omitted]

SEQ ID NO: 24 - DNA, 3249 bp, Artificial Sequence
  Synthetic polynucleotide
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 25 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 26 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 27 - RNA, 104 nt, Artificial Sequence
  Synthetic polynucleotide
  misc_feature (1)..(20): a, c, u, g, unknown or other
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 28 - RNA, 106 nt, Artificial Sequence
  Synthetic polynucleotide
  misc_feature (1)..(20): a, c, u, g, unknown or other
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 29 - RNA, 116 nt, Artificial Sequence
  Synthetic polynucleotide
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 30 - RNA, 96 nt, Artificial Sequence
  Synthetic oligonucleotide
  misc_feature (1)..(20): a, c, u, g, unknown or other
nnnnnnnnnnnnnnnnnnnnguauuagagcuagaaauagcaaguuaauauaaggcuaguccguuaucaacuugaaaaaguggcaccgagucggugc

SEQ ID NO: 31 - RNA, 96 nt, Artificial Sequence
  Synthetic oligonucleotide
  misc_feature (1)..(20): a, c, u, g, unknown or other
nnnnnnnnnnnnnnnnnnnnguuuaagagcuagaaauagcaaguuuaaauaaggcuaguccguuaucaacuugaaaaaguggcaccgagucggugc

SEQ ID NO: 32 - RNA, 116 nt, Artificial Sequence
  Synthetic polynucleotide
  misc_feature (1)..(20): a, c, u, g, unknown or other
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 33 - RNA, 47 nt, Artificial Sequence
  Synthetic oligonucleotide
aaggcuaguccguuaucaacuugaaaaaguggcaccgagucggugcu

SEQ ID NO: 34 - RNA, 49 nt, Artificial Sequence
  Synthetic oligonucleotide
aaggcuaguccguuaucaacuugaaaaaguggcaccgagucgguggugc

SEQ ID NO: 35 - RNA, 51 nt, Artificial Sequence
  Synthetic oligonucleotide
aaggcuaguccguuaucaacuugaaaaaguggcaccgagucggugcggauc

SEQ ID NO: 36 - RNA, 31 nt, Artificial Sequence
  Synthetic oligonucleotide
aaggcuaguccguuaucaacuugaaaaagug

SEQ ID NO: 37 - RNA, 18 nt, Artificial Sequence
  Synthetic oligonucleotide
aaggcuaguccguuauca

SEQ ID NO: 38 - RNA, 12 nt, Artificial Sequence
  Synthetic oligonucleotide
aaggcuaguccg

SEQ ID NO: 39 - DNA, 3159 bp, Artificial Sequence
  Synthetic polynucleotide
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 40 - RNA, 102 nt, Artificial Sequence
  Synthetic oligonucleotide
  misc_feature (1)..(20): n is a, c, g, or u
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 41 - skipped

SEQ ID NO: 42 - RNA, 42 nt, Streptococcus pyogenes
  misc_feature (1)..(20): a, c, u, g, unknown or other
nnnnnnnnnnnnnnnnnnnnguuuuagagcuaugcuguuuug

SEQ ID NO: 43 - RNA, 85 nt, Streptococcus pyogenes
ggaaccauucaaaacagcauagcaaguuaaaauaaggcuaguccguuaucaacuugaaaaaguggcaccgagucggugcuuuuuu

SEQ ID NO: 44 - RNA, 62 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccg

SEQ ID NO: 45 - RNA, 102 nt, Streptococcus pyogenes
  misc_feature (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 46 - RNA, 75 nt, Streptococcus pyogenes
  misc_feature (1)..(20): a, c, u, g, unknown or other
nnnnnnnnnnnnnnnnnnnnguuuuagagcuaugcugaaaagcauagcaaguuaaaauaaggcuaguccguuauc

SEQ ID NO: 47 - RNA, 87 nt, Streptococcus pyogenes
  misc_feature (1)..(20): a, c, u, g, unknown or other
nnnnnnnnnnnnnnnnnnnnguuuuagagcuaugcuguuuuggaaacaaaacagcauagcaaguuaaaauaaggcuaguccguuauc

SEQ ID NO: 48 - RNA, 42 nt, Streptococcus thermophilus
  misc_feature (1)..(20): a, c, u, g, unknown or other
nnnnnnnnnnnnnnnnnnnnguuuuagagcuguguuguuucg

SEQ ID NO: 49 - RNA, 78 nt, Streptococcus thermophilus
gggcgaaacaacacagcgaguuaaaauaaggcuuaguccguacucaacuugaaaagguggcaccgauucgguguuuuu

SEQ ID NO: 50 - RNA, 42 nt, Streptococcus pyogenes; identical to SEQ ID NO: 42
  misc_feature (1)..(20): a, c, u, g, unknown or other

SEQ ID NO: 51 - RNA, 42 nt, Streptococcus thermophilus; identical to SEQ ID NO: 48
  misc_feature (1)..(20): a, c, u, g, unknown or other

SEQ ID NO: 52 - RNA, 85 nt, Streptococcus pyogenes
gaaccauucaaaacagcauagcaaguuaaaauaaggcuaguccguuaucaacuugaaaaaguggcaccgagucggugcuuuuuuu

SEQ ID NO: 53 - RNA, 78 nt, Streptococcus thermophilus; identical to SEQ ID NO: 49

SEQ ID NO: 54 - protein, 12 aa, Artificial Sequence
  Synthetic peptide
DIGTNSVGWAVT

SEQ ID NO: 55 - protein, 12 aa, Artificial Sequence
  Synthetic peptide
DIGTNSVGWAVT

SEQ ID NO: 56 - protein, 12 aa, Artificial Sequence
  Synthetic peptide
DVGTNSVGWAVT

SEQ ID NO: 57 - protein, 12 aa, Artificial Sequence
  Synthetic peptide
DVGTNSVGWAVT

SEQ ID NO: 58 - protein, 12 aa, Artificial Sequence
  Synthetic peptide
DMGTNSVGWAVT

SEQ ID NO: 59 - protein, 12 aa, Artificial Sequence
  Synthetic peptide
DVGTSSVGWAVT

SEQ ID NO: 60 - protein, 12 aa, Artificial Sequence
  Synthetic peptide
DIGTASVGWAVT

SEQ ID NO: 61 - protein, 12 aa, Artificial Sequence
  Synthetic peptide
DVGTGSVGWAVT

SEQ ID NO: 62 - protein, 12 aa, Artificial Sequence
  Synthetic peptide
DIGTNSVGWAVV

SEQ ID NO: 63 - protein, 12 aa, Artificial Sequence
  Synthetic peptide
DIGTNSVGWAVI

SEQ ID NO: 64 - protein, 12 aa, Artificial Sequence
  Synthetic peptide
DIGTNSVGWAVL

SEQ ID NO: 65 - protein, 12 aa, Artificial Sequence
  Synthetic peptide
DLGTNSIGWAVV

SEQ ID NO: 66 - protein, 11 aa, Artificial Sequence
  Synthetic peptide
DLGTNSIGWAI

SEQ ID NO: 67 - protein, 12 aa, Artificial Sequence
  Synthetic peptide
DLGTNSIGWALV

SEQ ID NO: 68 - protein, 12 aa, Artificial Sequence
  Synthetic peptide
DIGTNSVGWCVT

SEQ ID NO: 69 - protein, 12 aa, Artificial Sequence
  Synthetic peptide
DIGTNSVGYAVT

SEQ ID NO: 70 - protein, 12 aa, Artificial Sequence
  Synthetic peptide
DMGTGSLGWAVT

SEQ ID NO: 71 - protein, 12 aa, Artificial Sequence
  Synthetic peptide
DIGTSSVGWAAI

SEQ ID NO: 72 - protein, 12 aa, Artificial Sequence
  Synthetic peptide
DLGTGSVGWAVV

SEQ ID NO: 73 - protein, 12 aa, Artificial Sequence
  Synthetic peptide
DLGVGSVGWAIV

SEQ ID NO: 74 - protein, 12 aa, Artificial Sequence
  Synthetic peptide
DLGIASIGWAII

SEQ ID NO: 75 - protein, 12 aa, Artificial Sequence
  Synthetic peptide
DLGIASVGWAIV

SEQ ID NO: 76 - protein, 12 aa, Artificial Sequence
  Synthetic peptide
DLGVASVGWSIV

SEQ ID NO: 77 - protein, 12 aa, Artificial Sequence
  Synthetic peptide
DIGIASVGWAIL

SEQ ID NO: 78 - protein, 12 aa, Artificial Sequence
  Synthetic peptide
DLGISSVGWSVI

SEQ ID NO: 79 - protein, 12 aa, Artificial Sequence
  Synthetic peptide
DIGIASVGWSVI

SEQ ID NO: 80 - protein, 12 aa, Artificial Sequence
  Synthetic peptide
DVGIGSIGWAVI

SEQ ID NO: 81 - protein, 12 aa, Artificial Sequence
  Synthetic peptide
DLGVGSIGFAIV

SEQ ID NO: 82 - protein, 12 aa, Artificial Sequence
  Synthetic peptide
DIGYASIGWAVI

SEQ ID NO: 83 - protein, 12 aa, Artificial Sequence
  Synthetic peptide
DTGTNSLGWAIV

SEQ ID NO: 84 - protein, 12 aa, Artificial Sequence
  Synthetic peptide
DLGTNSIGWCLL

SEQ ID NO: 85 - protein, 12 aa, Artificial Sequence
  Synthetic peptide
DIGTDSLGWAVF

SEQ ID NO: 86 - protein, 12 aa, Artificial Sequence
  Synthetic peptide
DIGSNSIGFAVV

SEQ ID NO: 87 - protein, 12 aa, Artificial Sequence
  Synthetic peptide
DLGVGSIGVAVA

SEQ ID NO: 88 - protein, 12 aa, Artificial Sequence
  Synthetic peptide
DLGIASCGWGVV

SEQ ID NO: 89 - protein, 12 aa, Artificial Sequence
  Synthetic peptide
DLGIASVGWCLT

SEQ ID NO: 90 - protein, 12 aa, Artificial Sequence
  Synthetic peptide
DIGIGSVGVGIL

SEQ ID NO: 91 - protein, 12 aa, Artificial Sequence
  Synthetic peptide
DIGITSVGYGLI

SEQ ID NO: 92 - protein, 12 aa, Artificial Sequence
  Synthetic peptide
DIGITSVGFGII

SEQ ID NO: 93 - protein, 12 aa, Artificial Sequence
  Synthetic peptide
DVGITSTGYAVL

SEQ ID NO: 94 - protein, 12 aa, Artificial Sequence
  Synthetic peptide
DLGITSFGYAIL

SEQ ID NO: 95 - protein, 12 aa, Artificial Sequence
  Synthetic peptide
DIGNASVGWSAF

SEQ ID NO: 96 - protein, 12 aa, Artificial Sequence
  Synthetic peptide
DVGTNSCGWVAM

SEQ ID NO: 97 - protein, 12 aa, Artificial Sequence
  Synthetic peptide
DVGERSIGLAAV

SEQ ID NO: 98 - protein, 12 aa, Artificial Sequence
  Synthetic peptide
DVGLNSVGLAAV

SEQ ID NO: 99 - protein, 12 aa, Artificial Sequence
  Synthetic peptide
DVGLMSVGLAAI

SEQ ID NO: 100 - protein, 12 aa, Artificial Sequence
  Synthetic peptide
DVGTFSVGLAAI

SEQ ID NO: 101 - protein, 12 aa, Artificial Sequence
  Synthetic peptide
DIGTGSVGYACM

SEQ ID NO: 102 - protein, 12 aa, Artificial Sequence
  Synthetic peptide
DLGTTSIGFAHI

SEQ ID NO: 103 - protein, 12 aa, Artificial Sequence
  Synthetic peptide
DLGTNSIGSSVR

SEQ ID NO: 104 - protein, 12 aa, Artificial Sequence
  Synthetic peptide
DIGTNSVGWAVT

SEQ ID NO: 105 - protein, 12 aa, Artificial Sequence
  Synthetic peptide
DIGTNSVGWAVT

SEQ ID NO: 106 - protein, 12 aa, Artificial Sequence
  Synthetic peptide
DVGTNSVGWAVT

SEQ ID NO: 107 - protein, 12 aa, Artificial Sequence
  Synthetic peptide
DVGTNSVGWAVT

SEQ ID NO: 108 - protein, 12 aa, Artificial Sequence
  Synthetic peptide
DMGTNSVGWAVT

SEQ ID NO: 109 - protein, 12 aa, Artificial Sequence
  Synthetic peptide
DVGTSSVGWAVT

SEQ ID NO: 110 - protein, 12 aa, Artificial Sequence
  Synthetic peptide
DIGTASVGWAVT

SEQ ID NO: 111 - protein, 12 aa, Artificial Sequence
  Synthetic peptide
DVGTGSVGWAVT

SEQ ID NO: 112 - protein, 12 aa, Artificial Sequence
  Synthetic peptide
DIGTNSVGWAVV

SEQ ID NO: 113 - protein, 12 aa, Artificial Sequence
  Synthetic peptide
DIGTNSVGWAVI

SEQ ID NO: 114 - protein, 12 aa, Artificial Sequence
  Synthetic peptide
DIGTNSIGWAVI

SEQ ID NO: 115 - protein, 12 aa, Artificial Sequence
  Synthetic peptide
DIGTNSVGWAVL

SEQ ID NO: 116 - protein, 12 aa, Artificial Sequence
  Synthetic peptide
DLGTNSIGWAVV

SEQ ID NO: 117 - protein, 11 aa, Artificial Sequence
  Synthetic peptide
DLGTNSIGWAI

SEQ ID NO: 118 - protein, 12 aa, Artificial Sequence
  Synthetic peptide
DLGTNSIGWALV

SEQ ID NO: 119 - protein, 12 aa, Artificial Sequence
  Synthetic peptide
DIGTNSVGWCVT

SEQ ID NO: 120 - protein, 12 aa, Artificial Sequence
  Synthetic peptide
DIGTNSVGYAVT

SEQ ID NO: 121 - protein, 12 aa, Artificial Sequence
  Synthetic peptide
DMGTGSLGWAVT

SEQ ID NO: 122 - protein, 12 aa, Artificial Sequence
  Synthetic peptide
DIGTSSVGWAAI

SEQ ID NO: 123 - protein, 12 aa, Artificial Sequence
  Synthetic peptide
DLGTGSVGWAVV

SEQ ID NO: 124 - protein, 12 aa, Artificial Sequence
  Synthetic peptide
DLGVGSVGWAIV

SEQ ID NO: 125 - protein, 12 aa, Artificial Sequence
  Synthetic peptide
DLGIASIGWAII

SEQ ID NO: 126 - protein, 12 aa, Artificial Sequence
  Synthetic peptide
DLGIASVGWAIV

SEQ ID NO: 127 - protein, 12 aa, Artificial Sequence
  Synthetic peptide
DLGIASVGWAVV

SEQ ID NO: 128 - protein, 12 aa, Artificial Sequence
  Synthetic peptide
DLGVASVGWSIV

SEQ ID NO: 129 - protein, 12 aa, Artificial Sequence
  Synthetic peptide
DIGIASVGWAIL

SEQ ID NO: 130 - protein, 12 aa, Artificial Sequence
  Synthetic peptide
DIGIASVGWAVL

SEQ ID NO: 131 - protein, 12 aa, Artificial Sequence
  Synthetic peptide
DIGIASIGWAVI

SEQ ID NO: 132 - protein, 12 aa, Artificial Sequence
  Synthetic peptide
DIGIASVGWAII

SEQ ID NO: 133 - protein, 12 aa, Artificial Sequence
  Synthetic peptide
DVGIASVGWAVI

SEQ ID NO: 134 - protein, 11 aa, Artificial Sequence
  Synthetic peptide
DIGIASVGWAL

SEQ ID NO: 135 - protein, 12 aa, Artificial Sequence
  Synthetic peptide
DIGIASVGWAMV

SEQ ID NO: 136 - protein, 12 aa, Artificial Sequence
  Synthetic peptide
DIGIASVGWSVI

SEQ ID NO: 137 - protein, 12 aa, Artificial Sequence
  Synthetic peptide
DLGISSVGWSVI

SEQ ID NO: 138 - protein, 12 aa, Artificial Sequence
  Synthetic peptide
DIGITSVGWAVI

SEQ ID NO: 139 - protein, 12 aa, Artificial Sequence
  Synthetic peptide
DVGIGSIGWAVI

SEQ ID NO: 140 - protein, 12 aa, Artificial Sequence
  Synthetic peptide
DLGISSLGWAIV

SEQ ID NO: 141 - protein, 12 aa, Artificial Sequence
  Synthetic peptide
DLGVGSIGFAIV

SEQ ID NO: 142 - protein, 12 aa, Artificial Sequence
  Synthetic peptide
DIGYASIGWAVI

SEQ ID NO: 143 - protein, 12 aa, Artificial Sequence
  Synthetic peptide
DLGTNSIGWCLL

SEQ ID NO: 144 - protein, 12 aa, Artificial Sequence
  Synthetic peptide
DLGTNSIGWGLL

SEQ ID NO: 145 - protein, 12 aa, Artificial Sequence
  Synthetic peptide
DTGTNSLGWAIV

SEQ ID NO: 146 - protein, 12 aa, Artificial Sequence
  Synthetic peptide
DIGTDSLGWAVF

SEQ ID NO: 147 - protein, 12 aa, Artificial Sequence
  Synthetic peptide
DLGSTSLGWAIF

SEQ ID NO: 148 - protein, 12 aa, Artificial Sequence
  Synthetic peptide
DIGISSIGWAFS

SEQ ID NO: 149 - protein, 12 aa, Artificial Sequence
  Synthetic peptide
DLGIASVGWCLT

SEQ ID NO: 150 - protein, 12 aa, Artificial Sequence
  Synthetic peptide
DLGIASCGWGVV

SEQ ID NO: 151 - protein, 12 aa, Artificial Sequence
  Synthetic peptide
DIGSNSIGFAVV

SEQ ID NO: 152 - protein, 12 aa, Artificial Sequence
  Synthetic peptide
DIGTTSIGFSVI

SEQ ID NO: 153 - protein, 12 aa, Artificial Sequence
  Synthetic peptide
DIGITSVGYGLI

SEQ ID NO: 154 - protein, 12 aa, Artificial Sequence
  Synthetic peptide
DIGITSVGFGII

SEQ ID NO: 155 - protein, 12 aa, Artificial Sequence
  Synthetic peptide
DLGTTSIGFAHI

SEQ ID NO: 156 - protein, 12 aa, Artificial Sequence
  Synthetic peptide
DIGIGSVGVGIL

SEQ ID NO: 157 - protein, 12 aa, Artificial Sequence
  Synthetic peptide
DLGVGSIGVAVA

SEQ ID NO: 158 - protein, 12 aa, Artificial Sequence
  Synthetic peptide
DVGITSTGYAVL

SEQ ID NO: 159 - protein, 12 aa, Artificial Sequence
  Synthetic peptide
DLGITSFGYAIL

SEQ ID NO: 160 - protein, 12 aa, Artificial Sequence
  Synthetic peptide
DIGTSSIGWWLY

SEQ ID NO: 161 - protein, 12 aa, Artificial Sequence
  Synthetic peptide
DLGSNSLGWFVT

SEQ ID NO: 162 - protein, 12 aa, Artificial Sequence
  Synthetic peptide
DLGANSLGWFVV

SEQ ID NO: 163 - protein, 12 aa, Artificial Sequence
  Synthetic peptide
DIGNASVGWSAF

SEQ ID NO: 164 - protein, 12 aa, Artificial Sequence
  Synthetic peptide
DVGTNSCGWVAM

SEQ ID NO: 165 - protein, 12 aa, Artificial Sequence
  Synthetic peptide
DVGERSIGLAAV

SEQ ID NO: 166 - protein, 12 aa, Artificial Sequence
  Synthetic peptide
DVGLNSVGLAAV

SEQ ID NO: 167 - protein, 12 aa, Artificial Sequence
  Synthetic peptide
DVGLMSVGLAAI

SEQ ID NO: 168 - protein, 12 aa, Artificial Sequence
  Synthetic peptide
DVGTFSVGLAAI

SEQ ID NO: 169 - protein, 12 aa, Artificial Sequence
  Synthetic peptide
DIGTGSVGYACM

SEQ ID NO: 170 - protein, 12 aa, Artificial Sequence
  Synthetic peptide
DLGTNSIGSSVR

SEQ ID NO: 171 - protein, 15 aa, Artificial Sequence
  Synthetic peptide
DIGLRIGITSCGWSI

SEQ ID NO: 172 - protein, 12 aa, Artificial Sequence
  Synthetic peptide
DMGAKYTGVFYA

SEQ ID NO: 173 - protein, 12 aa, Artificial Sequence
  Synthetic peptide
DLGGKNTGFFSF

SEQ ID NO: 174 - protein, 12 aa, Artificial Sequence
  Synthetic peptide
DLGVKNTGVFSA

SEQ ID NO: 175 - protein, 12 aa, Artificial Sequence
  Synthetic peptide
DLGAKFTGVALY

SEQ ID NO: 176 - protein, 12 aa, Artificial Sequence
  Synthetic peptide
DLGGKFTGVCLS

SEQ ID NO: 177 - protein, 12 aa, Artificial Sequence
  Synthetic peptide
DLGGTYTGTFIT

SEQ ID NO: 178 - protein, 28 aa, Artificial Sequence
  Synthetic peptide
YDIDHIYPRSLTKDDSFDNLVLCERTAN

SEQ ID NO: 179 - protein, 28 aa, Artificial Sequence
  Synthetic peptide
DIDHIYPRSKVIKDDSFDNLVLVLKNEN

SEQ ID NO: 180 - protein, 27 aa, Artificial Sequence
  Synthetic peptide
DRDHIYPQSKIKDDSIDNLVLVNKTYN

SEQ ID NO: 181 - protein, 27 aa, Artificial Sequence
  Synthetic peptide
DIDHIYPRSKIKDDSITNRVLVEKDIN

SEQ ID NO: 182 - protein, 27 aa, Artificial Sequence
  Synthetic peptide
DIDHIYPQSKIKDDSISNRVLVCSSCN

SEQ ID NO: 183 - protein, 27 aa, Artificial Sequence
  Synthetic peptide
DIDHIYPQSKTMDDSLNNRVLVKKNYN

SEQ ID NO: 184 - protein, 27 aa, Artificial Sequence
  Synthetic peptide
DQDHIYPKSKIYDDSLENRVLVKKNLN

SEQ ID NO: 185 - protein, 27 aa, Artificial Sequence
  Synthetic peptide
QIDHIVPQSLVKDDSFDNRVLVVPSEN

SEQ ID NO: 186 - protein, 27 aa, Artificial Sequence
  Synthetic peptide
DIDHIIPQAFIKDNSIDNRVLTSSKEN

SEQ ID NO: 187 - protein, 27 aa, Artificial Sequence
  Synthetic peptide
DIDHIIPQAFLKDNSIDNKVLVSSASN

SEQ ID NO: 188 - protein, 27 aa, Artificial Sequence
  Synthetic peptide
DIDHIIPQAYTKDNSLDNRVLVSNITN

SEQ ID NO: 189 - protein, 27 aa, Artificial Sequence
  Synthetic peptide
DIDHIVPQSFITDNSIDNLVLTSSAGN

SEQ ID NO: 190 - protein, 27 aa, Artificial Sequence
  Synthetic peptide
DVDHIVPQSFLKDDSIDNKVLTRSDKN

SEQ ID NO: 191 - protein, 27 aa, Artificial Sequence
  Synthetic peptide
NIDHIYPQSMVKDDSLDNKVLVQSEIN

SEQ ID NO: 192 - protein, 27 aa, Artificial Sequence
  Synthetic peptide
DIDHILPQSLIKDDSLDNRVLVNATIN

SEQ ID NO: 193 - protein, 27 aa, Artificial Sequence
  Synthetic peptide
DIDHILPQSFIKDDSLENRVLVKKAVN

SEQ ID NO: 194 - protein, 27 aa, Artificial Sequence
  Synthetic peptide
EVDHIFPRSFIKDDSIDNKVLVIKKMN

SEQ ID NO: 195 - protein, 27 aa, Artificial Sequence
  Synthetic peptide
EVDHIIPRSYIKDDSFENKVLVYREEN

SEQ ID NO: 196 - protein, 27 aa, Artificial Sequence
  Synthetic peptide
DIDHIIPQAVTQNDSIDNRVLVARAEN

SEQ ID NO: 197 - protein, 27 aa, Artificial Sequence
  Synthetic peptide
EIDHIIPYSISFDDSSSNKLLVLAESN

SEQ ID NO: 198 - protein, 27 aa, Artificial Sequence
  Synthetic peptide
EIDHIIPYSLCFDDSSANKVLVHKQSN

SEQ ID NO: 199 - protein, 27 aa, Artificial Sequence
  Synthetic peptide
DIDHIIPYSRSMDDSYSNKVLVLSGEN

SEQ ID NO: 200 - protein, 27 aa, Artificial Sequence
  Synthetic peptide
DIDHIIPYSKSMDDSFNNKVLCLAEEN

SEQ ID NO: 201 - protein, 27 aa, Artificial Sequence
  Synthetic peptide
EIDHIYPYSRSFDDSYMNKVLVFTKQN

SEQ ID NO: 202 - protein, 27 aa, Artificial Sequence
  Synthetic peptide
QIDHIYPYSRSMDDSYMNKVLVLTDEN

SEQ ID NO: 203 - protein, 27 aa, Artificial Sequence
  Synthetic peptide
EIDHIIPFSRSFDDSLSNKILVLGSEN

SEQ ID NO: 204 - protein, 27 aa, Artificial Sequence
  Synthetic peptide
EIDHALPFSRTWDDSFNNKVLVLGSEN

SEQ ID NO: 205 - protein, 27 aa, Artificial Sequence
  Synthetic peptide
EIDHALPFSRTWDDSFNNKVLVLASEN

SEQ ID NO: 206 - protein, 27 aa, Artificial Sequence
  Synthetic peptide
EIDHIIPISISLDDSINNKVLVLSKAN

SEQ ID NO: 207 - protein, 27 aa, Artificial Sequence
  Synthetic peptide
EVDHIIPISISLDDSITNKVLVTHREN

SEQ ID NO: 208 - protein, 27 aa, Artificial Sequence
  Synthetic peptide
QVDHALPYSRSYDDSKNNKVLVLTHEN

SEQ ID NO: 209 - protein, 27 aa, Artificial Sequence
  Synthetic peptide
EVDHILPLSITFDDSLANKVLVYATAN

SEQ ID NO: 210 - protein, 27 aa, Artificial Sequence
  Synthetic peptide
EIDHIIPRSISFDDARSNKVLVYRSEN

SEQ ID NO: 211 - protein, 27 aa, Artificial Sequence
  Synthetic peptide
EVDHIIPRSVSFDNSYHNKVLVKQSEN

SEQ ID NO: 212 - protein, 27 aa, Artificial Sequence
  Synthetic peptide
DIDHILPYSITFDDSFRNKVLVTSQEN

SEQ ID NO: 213 - protein, 27 aa, Artificial Sequence
  Synthetic peptide
EIDHILPRSRSADDSFANKVLCLARAN

SEQ ID NO: 214 - protein, 27 aa, Artificial Sequence
  Synthetic peptide
EIEHLLPFSLTLDDSMANKTVCFRQAN

SEQ ID NO: 215 - protein, 27 aa, Artificial Sequence
  Synthetic peptide
DIDHILPFSVSLDDSAANKVVCLREAN

SEQ ID NO: 216 - protein, 27 aa, Artificial Sequence
  Synthetic peptide
DIDHLIPFSISWDDSAANKVVCMRYAN

SEQ ID NO: 217 - protein, 27 aa, Artificial Sequence
  Synthetic peptide
DIDHILPVAMTLDDSPANKIICMRYAN

SEQ ID NO: 218 - protein, 27 aa, Artificial Sequence
  Synthetic peptide
DVDHILPYSRTLDDSFPNRTLCLREAN

SEQ ID NO: 219 - protein, 27 aa, Artificial Sequence
  Synthetic peptide
EIEHILPFSRTLDDSLNNRTVAMRRAN

SEQ ID NO: 220 - protein, 27 aa, Artificial Sequence
  Synthetic peptide
EVDHIIPYSISWDDSYTNKVLTSAKCN

SEQ ID NO: 221 - protein, 27 aa, Artificial Sequence
  Synthetic peptide
QVDHILPWSRFGDDSYLNKTLCTARSN

SEQ ID NO: 222 - protein, 27 aa, Artificial Sequence
  Synthetic peptide
QVDHILPFSKTLDDSFANKVLAQHDAN

SEQ ID NO: 223 - protein, 27 aa, Artificial Sequence
  Synthetic peptide
QIDHAFPLSRSLDDSQSNKVLCLTSSN

SEQ ID NO: 224 - protein, 27 aa, Artificial Sequence
  Synthetic peptide
DIDHIVPRSISFDDSFSNLVIVNKLDN

SEQ ID NO: 225 - protein, 27 aa, Artificial Sequence
  Synthetic peptide
EIEHIIPYSMSYDNSQANKILTEKAEN

SEQ ID NO: 226 - protein, 27 aa, Artificial Sequence
  Synthetic peptide
EIDHVIPYSKSADDSWFNKLLVKKSTN

SEQ ID NO: 227 - protein, 27 aa, Artificial Sequence
  Synthetic peptide
EMDHILPYSRSLDNGWHNRVLVHGKDN

SEQ ID NO: 228 - protein, 27 aa, Artificial Sequence
  Synthetic peptide
EVDHIVPYSLILDNTINNKALVYAEEN

SEQ ID NO: 229 - protein, 27 aa, Artificial Sequence
  Synthetic peptide
EIEHVIPQSLYFDDSFSNKVICEAEVN

SEQ ID NO: 230 - protein, 27 aa, Artificial Sequence
  Synthetic peptide
DIEHIIPQARLFDDSFSNKTLEARSVN

SEQ ID NO: 231 - protein, 27 aa, Artificial Sequence
  Synthetic peptide
EIEHIVPKARVFDDSFSNKTLTFHRIN

SEQ ID NO: 232 - protein, 28 aa, Artificial Sequence
  Synthetic peptide
DKDHIIPQSMKKDDSIINNLVLVNKNAN

SEQ ID NO: 233 - protein, 27 aa, Artificial Sequence
  Synthetic peptide
EVEHIWPRSRSFDNSPRNKTLCRKDVN

SEQ ID NO: 234 - protein, 27 aa, Artificial Sequence
  Synthetic peptide
IVNHIIPYNRSFDDTYHNRVLTLTETK

SEQ ID NO: 235 - protein, 27 aa, Artificial Sequence
  Synthetic peptide
DMEHTIPKSISFDNSDQNLTLCESYYN

SEQ ID NO: 236 - protein, 27 aa, Artificial Sequence
  Synthetic peptide
DIEHTIPRSAGGDSTKMNLTLCSSRFN

SEQ ID NO: 237 - protein, 27 aa, Artificial Sequence
  Synthetic peptide
DIEHTIPRSISQDNSQMNKTLCSLKFN

SEQ ID NO: 238 - protein, 27 aa, Artificial Sequence
  Synthetic peptide
DIDHVIPLARGGRDSLDNMVLCQSDAN

SEQ ID NO: 239 - protein, 27 aa, Artificial Sequence
  Synthetic peptide
DIEHLFPIAESEDNGRNNLVISHSACN

SEQ ID NO: 240 - protein, 27 aa, Artificial Sequence
  Synthetic peptide
DVDHIFPRDDTADNSYGNKVVAHRQCN

SEQ ID NO: 241 - protein, 27 aa, Artificial Sequence
  Synthetic peptide
DIEHIVPQSLGGLSTDYNTIVTLKSVN

SEQ ID NO: 242 - protein, 27 aa, Artificial Sequence
  Synthetic peptide
ELDHIVPRTDGGSNRHENLAITCGACN

SEQ ID NO: 243 - protein, 28 aa, Artificial Sequence
  Synthetic peptide
EMDHIVPRKGVGSTNTRTNFAAVCAECN

SEQ ID NO: 244 - protein, 28 aa, Artificial Sequence
  Synthetic peptide
EMDHIVPRKGVGSTNTRVNLAAACAACN

SEQ ID NO: 245 - protein, 28 aa, Artificial Sequence
  Synthetic peptide
EMDHIVPRAGQGSTNTRENLVAVCHRCN

SEQ ID NO: 246 - protein, 33 aa, Artificial Sequence
  Synthetic polypeptide
EIDHILPRSLIKDARGIVFNAEPNLIYASSRGN

SEQ ID NO: 247 - protein, 33 aa, Artificial Sequence
  Synthetic polypeptide
EIDHIIPRSLTGRTKKTVFNSEANLIYCSSKGN

SEQ ID NO: 248 - protein, 33 aa, Artificial Sequence
  Synthetic polypeptide
EIDHIIPRSLTLKKSESIYNSEVNLIFVSAQGN

SEQ ID NO: 249 - protein, 33 aa, Artificial Sequence
  Synthetic polypeptide
EIDHIYPRSLSKKHFGVIFNSEVNLIYCSSQGN

SEQ ID NO: 250 - protein, 33 aa, Artificial Sequence
  Synthetic polypeptide
EIDHILPRSHTLKIYGTVFNPEGNLIYVHQKCN

SEQ ID NO: 251 - protein, 30 aa, Artificial Sequence
  Synthetic polypeptide
ELDHIIPRSHKKYGTLNDEANLICVTRGDN

SEQ ID NO: 252 - protein, 27 aa, Artificial Sequence
  Synthetic peptide
ELEHIVPHSFRQSNALSSLVLTWPGVN

SEQ ID NO: 253 - protein, 28 aa, Artificial Sequence
  Synthetic peptide
YDIDHIYPRSLTKDDSFDNLVLCERTAN

SEQ ID NO: 254 - protein, 28 aa, Artificial Sequence
  Synthetic peptide
DIDHIYPRSKVIKDDSFDNLVLVLKNEN

SEQ ID NO: 255 - protein, 27 aa, Artificial Sequence
  Synthetic peptide
DRDHIYPQSKIKDDSIDNLVLVNKTYN

SEQ ID NO: 256 - protein, 27 aa, Artificial Sequence
  Synthetic peptide
DIDHIYPRSKIKDDSITNRVLVEKDIN

SEQ ID NO: 257 - protein, 27 aa, Artificial Sequence
  Synthetic peptide
DIDHIYPQSKIKDDSISNRVLVCSSCN

SEQ ID NO: 258 - protein, 27 aa, Artificial Sequence
  Synthetic peptide
DIDHIYPQSKTMDDSLNNRVLVKKNYN

SEQ ID NO: 259 - protein, 27 aa, Artificial Sequence
  Synthetic peptide
DQDHIYPKSKIYDDSLENRVLVKKNLN

SEQ ID NO: 260 - protein, 27 aa, Artificial Sequence
  Synthetic peptide
QIDHIVPQSLVKDDSFDNRVLVVPSEN

SEQ ID NO: 261 - protein, 27 aa, Artificial Sequence
  Synthetic peptide
DIDHIIPQAFIKDNSIDNRVLTSSKEN

SEQ ID NO: 262 - protein, 27 aa, Artificial Sequence
  Synthetic peptide
DIDHIIPQAFLKDNSIDNKVLVSSASN

SEQ ID NO: 263 - protein, 27 aa, Artificial Sequence
  Synthetic peptide
DIDHIIPQAYTKDNSLDNRVLVSNITN

SEQ ID NO: 264 - protein, 27 aa, Artificial Sequence
  Synthetic peptide
DIDHIVPQSFITDNSIDNLVLTSSAGN

SEQ ID NO: 265 - protein, 27 aa, Artificial Sequence
  Synthetic peptide
DVDHIVPQSFLKDDSIDNKVLTRSDKN

SEQ ID NO: 266 - protein, 27 aa, Artificial Sequence
  Synthetic peptide
NIDHIYPQSMVKDDSLDNKVLVQSEIN

SEQ ID NO: 267 - protein, 27 aa, Artificial Sequence
  Synthetic peptide
DIDHILPQSLIKDDSLDNRVLVNATIN

SEQ ID NO: 268 - protein, 27 aa, Artificial Sequence
  Synthetic peptide
DIDHILPQSFIKDDSLENRVLVKKAVN

SEQ ID NO: 269 - protein, 27 aa, Artificial Sequence
  Synthetic peptide
EVDHIFPRSFIKDDSIDNKVLVIKKMN

SEQ ID NO: 270 - protein, 27 aa, Artificial Sequence
  Synthetic peptide
EVDHIIPRSYIKDDSFENKVLVYREEN

SEQ ID NO: 271 - protein, 27 aa, Artificial Sequence
  Synthetic peptide
DIDHIIPQAVTQNDSIDNRVLVARAEN

SEQ ID NO: 272 - protein, 27 aa, Artificial Sequence
  Synthetic peptide
DIDHIVPRSISFDDSFSNLVIVNKLDN

SEQ ID NO: 273 - protein, 27 aa, Artificial Sequence
  Synthetic peptide
EIDHIIPYSISFDDSSSNKLLVLAESN

SEQ ID NO: 274 - protein, 27 aa, Artificial Sequence
  Synthetic peptide
EIDHIIPYSLCFDDSSANKVLVHKQSN

SEQ ID NO: 275 - protein, 27 aa, Artificial Sequence
  Synthetic peptide
EIDHIIPISISLDDSINNKVLVLSKAN

SEQ ID NO: 276 - protein, 27 aa, Artificial Sequence
  Synthetic peptide
EVDHIIPISISLDDSITNKVLVTHREN

SEQ ID NO: 277 - protein, 27 aa, Artificial Sequence
  Synthetic peptide
EVDHILPLSITFDDSLANKVLVYATAN

SEQ ID NO: 278 - protein, 27 aa, Artificial Sequence
  Synthetic peptide
EIDHIIPRSISFDDARSNKVLVYRSEN

SEQ ID NO: 279 - protein, 27 aa, Artificial Sequence
  Synthetic peptide
EVDHIIPRSVSFDNSYHNKVLVKQSEN

SEQ ID NO: 280 - protein, 27 aa, Artificial Sequence
  Synthetic peptide
EVDHIIPYSISWDDSYTNKVLTSAKCN

SEQ ID NO: 281 - protein, 27 aa, Artificial Sequence
  Synthetic peptide
DIDHIIPYSRSMDDSYSNKVLVLSGEN

SEQ ID NO: 282 - protein, 27 aa, Artificial Sequence
  Synthetic peptide
EIEHIIPYSMSYDNSQANKILTEKAEN

SEQ ID NO: 283 - protein, 27 aa, Artificial Sequence
  Synthetic peptide
EVDHIVPYSLILDNTINNKALVYAEEN

SEQ ID NO: 284 - protein, 27 aa, Artificial Sequence
  Synthetic peptide
EIDHVIPYSKSADDSWFNKLLVKKSTN

SEQ ID NO: 285 - protein, 27 aa, Artificial Sequence
  Synthetic peptide
EMDHILPYSRSLDNGWHNRVLVHGKDN

SEQ ID NO: 286 - protein, 27 aa, Artificial Sequence
  Synthetic peptide
EIEHVIPQSLYFDDSFSNKVICEAEVN

SEQ ID NO: 287 - protein, 27 aa, Artificial Sequence
  Synthetic peptide
DIEHIIPQARLFDDSFSNKTLEARSVN

SEQ ID NO: 288 - protein, 27 aa, Artificial Sequence
  Synthetic peptide
EIEHIVPKARVFDDSFSNKTLTFHRIN

SEQ ID NO: 289 - protein, 28 aa, Artificial Sequence
  Synthetic peptide
DKDHIIPQSMKKDDSIINNLVLVNKNAN

SEQ ID NO: 290 - protein, 27 aa, Artificial Sequence
  Synthetic peptide
QVDHILPWSRFGDDSYLNKTLCTARSN

SEQ ID NO: 291 - protein, 27 aa, Artificial Sequence
  Synthetic peptide
DIDHVIPLARGGRDSLDNMVLCQSDAN

SEQ ID NO: 292 - protein, 27 aa, Artificial Sequence
  Synthetic peptide
DMEHTIPKSISFDNSDQNLTLCESYYN

SEQ ID NO: 293 - protein, 27 aa, Artificial Sequence
  Synthetic peptide
DIEHTIPRSAGGDSTKMNLTLCSSRFN

SEQ ID NO: 294 - protein, 27 aa, Artificial Sequence
  Synthetic peptide
DIEHTIPRSISQDNSQMNKTLCSLKFN

SEQ ID NO: 295 - protein, 27 aa, Artificial Sequence
  Synthetic peptide
DIEHLFPIAESEDNGRNNLVISHSACN

SEQ ID NO: 296 - protein, 27 aa, Artificial Sequence
  Synthetic peptide
DVDHIFPRDDTADNSYGNKVVAHRQCN

SEQ ID NO: 297 - protein, 27 aa, Artificial Sequence
  Synthetic peptide
DIEHIVPQSLGGLSTDYNTIVTLKSVN

SEQ ID NO: 298 - protein, 27 aa, Artificial Sequence
  Synthetic peptide
ELDHIVPRTDGGSNRHENLAITCGACN

SEQ ID NO: 299 - protein, 28 aa, Artificial Sequence
  Synthetic peptide
EMDHIVPRKGVGSTNTRTNFAAVCAECN

SEQ ID NO: 300 - protein, 28 aa, Artificial Sequence
  Synthetic peptide
EMDHIVPRKGVGSTNTRVNLAAACAACN

SEQ ID NO: 301 - protein, 28 aa, Artificial Sequence
  Synthetic peptide
EMDHIVPRAGQGSTNTRENLVAVCHRCN

SEQ ID NO: 302 - protein, 27 aa, Artificial Sequence
  Synthetic peptide
ELEHIVPHSFRQSNALSSLVLTWPGVN

SEQ ID NO: 303 - DNA, 3333 bp, Artificial Sequence
  Synthetic polynucleotide
atggtgcctaagaagaagagaaaggtggctgccttcaaacctaattcaatcaactacatcctcggcctcgatatcggcatcgcatccgtcggctgggcgatggtagaaattgacgaagaagaaaaccccatccgcctgattgatttgggcgtgcgcgtatttgagcgtgccgaagtaccgaaaacaggcgactcccttgccatggcaaggcgtttggcgcgcagtgttcgccgcctgacccgccgtcgcgcccaccgcctgcttcggacccgccgcctattgaaacgcgaaggcgtattacaagccgccaattttgacgaaaacggcttgattaaatccttaccgaatacaccatggcaacttcgcgcagccgcattagaccgcaaactgacgcctttagagtggtcggcagtcttgttgcatttaatcaaacatcgcggctatttatcgcaacggaaaaacgagggcgaaactgccgataaggagcttggcgctttgcttaaaggcgtagccggcaatgcccatgccttacagacaggcgatttccgcacaccggccgaattggctttaaataaatttgagaaagaaagcggccatatccgcaatcagcgcagcgattattcgcatacgttcagccgcaaagatttacaggcggagctgattttgctgtttgaaaaacaaaaagaatttggcaatccgcatgtttcaggcggccttaaagaaggtattgaaaccctactgatgacgcaacgccctgccctgtccggcgatgccgttcaaaaaatgttggggcattgcaccttcgaaccggcagagccgaaagccgctaaaaacacctacacagccgaacgtttcatctggctgaccaagctgaacaacctgcgtattttagagcaaggcagcgagcggccattgaccgataccgaacgcgccacgcttatggacgagccatacagaaaatccaaactgacttacgcacaagcccgtaagctgctgggtttagaagataccgcctttttcaaaggcttgcgctatggtaaagacaatgccgaagcctcaacattgatggaaatgaaggcctaccatgccatcagccgtgcactggaaaaagaaggattgaaagacaaaaaatccccattaaacctttctcccgaattacaagacgaaatcggcacggcattctccctgttcaaaaccgatgaagacattacaggccgtctgaaagaccgtatacagcccgaaatcttagaagcgctgttgaaacacatcagcttcgataagttcgtccaaatttccttgaaagcattgcgccgaattgtgcctctaatggaacaaggcaaacgttacgatgaagcctgcgccgaaatctacggagaccattacggcaagaagaatacggaagaaaagatttatctgccgccgattcccgccgacgaaatccgcaaccccgtcgtcttgcgcgccttatctcaagcacgtaaggtcattaacggcgtggtacgccgttacggctccccagctcgtatccatattgaaactgcaagggaagtaggtaaatcgtttaaagaccgcaaagaaattgagaaacgccaagaagaaaaccgcaaagaccgggaaaaagccgccgccaaattccgagagtatttccccaattttgtcggagaacccaaatccaaagatattctgaaactgcgcctgtacgagcaacaacacggcaaatgcctgtattcgggcaaagaaatcaacttaggccgtctgaacgaaaaaggctatgtcgaaatcgaccatgccctgccgttctcgcgcacatgggacgacagtttcaacaataaagtactggtattgggcagcgaaaaccaaaacaaaggcaatcaaaccccttacgaatacttcaacggcaaagacaacagccgcgaatggcaggaatttaaagcgcgtgtcgaaaccagccgtttcccgcgcagtaaaaaacaacggattctgctgcaaaaattcgatgaagacggctttaaagaacgcaatctgaacgacacgcgctacgtcaaccgtttcctgtgtcaatttgttgccgaccgtatgcggctgacaggtaaaggcaagaaacgtgtctttgcatccaacggacaaattaccaatctgttgcgcggcttttggggattgcgcaaagtgcgtgcggaaaacgaccgccatcacgccttggacgccgtcgtcgttgcctgctcgaccgttgccatgcagcagaaaattacccgttttgtacgctataaagagatgaacgcgtttgacggtaaaaccatagacaaagaaacaggagaagtgctgcatcaaaaaacacacttcccacaaccttgggaatttttcgcacaagaagtcatgattcgcgtcttcggcaaaccggacggcaaacccgaattcgaagaagccgataccctagaaaaactgcgcacgttgcttgccgaaaaattatcatctcgccccgaagccgtacacgaatacgttacgccactgtttgtttcacgcgcgcccaatcggaagatgagcgggcaagggcatatggagaccgtcaaatccgccaaacgactggacgaaggcgtcagcgtgttgcgcgtaccgctgacacagttaaaactgaaagacttggaaaaaatggtcaatcgggagcgcgaacctaagctatacgaagcactgaaagcacggctggaagcacataaagacgatcctgccaaagcctttgccgagccgttttacaaatacgataaagcaggcaaccgcacccaacaggtaaaagccgtacgcgtagagcaagtacagaaaaccggcgtatgggtgcgcaaccataacggtattgccgacaacgcaaccatggtgcgcgtagatgtgtttgagaaaggcgacaagtattatctggtaccgatttacagttggcaggtagcgaaagggattttgccggatagggctgttgtacaaggaaaagatgaagaagattggcaacttattgatgatagtttcaactttaaattctcattacaccctaatgatttagtcgaggttataacaaaaaaagctagaatgtttggttactttgccagctgccatcgaggcacaggtaatatcaatatacgcattcatgatcttgatcataaaattggcaaaaatggaatactggaaggtatcggcgtcaaaaccgccctttcattccaaaaataccaaattgacgaactgggcaaagaaatcagaccatgccgtctgaaaaaacgcccgcctgtccgttacccatacgatgttccagattacgctgcagctccagcagcgaagaaaaagaagctggattaa

SEQ ID NO: 304 - protein, 1053 aa, Staphylococcus aureus; identical to SEQ ID NO: 26

SEQ ID NO: 305 - protein, 1368 aa, Streptococcus pyogenes [sequence omitted]

SEQ ID NO: 306 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 307 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 308 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 309 - protein, 1397 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 310 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 311 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 312 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 313 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 314 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 315 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 316 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 317 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 318 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 319 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 320 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 321 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 322 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 323 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 324 - protein, 1368 aa, Streptococcus pyogenes [sequence omitted]

SEQ ID NO: 325 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 326 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 327 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 328 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 329 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 330 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 331 - protein, 1472 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 332 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 333 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 334 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 335 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 336 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 337 - protein, 1517 aa, Bacteroides sp.
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 338 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 339 - protein, 1424 aa, Prevotella sp.
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 340 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 341 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 342 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 343 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 344 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 345 - protein, 1197 aa, Porphyromonas sp.
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 346 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 347 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 348 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 349 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 350 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 351 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 352 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 353 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 354 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 355 - protein, 1181 aa, Actinomyces sp.
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 356 - protein, 1113 aa, Alcanivorax sp.
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 357 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 358 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 359 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 360 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 361 - protein, 1082 aa, Neisseria meningitidis; identical to SEQ ID NO: 25

SEQ ID NO: 362 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 363 - protein, 1059 aa, Rhodovulum sp.
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 364 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 365 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 366 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 367 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 368 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 369 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 370 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 371 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 372 - protein, 1061 aa, Treponema sp.
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 373 - protein, 1011 aa, Unknown
  Uncultured delta polypeptide
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 374 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 375 - protein, 1168 aa, Azospirillum sp.
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 376 - protein, 1064 aa, Bradyrhizobium sp.
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 377 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 378 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 379 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 380 - protein, 1035 aa, Puniceispirillum marinum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 381 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 382 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 383 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 384 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 385 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 386 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 387 - RNA, 20 nt, Artificial Sequence
  Synthetic
ggacaguuccuguauucuug

SEQ ID NO: 388 - RNA, 20 nt, Artificial Sequence
  Synthetic
guauucuugggguggcuaca

SEQ ID NO: 389 - RNA, 20 nt, Artificial Sequence
  Synthetic
ggucauuuacagcaccgaug

SEQ ID NO: 390 - RNA, 20 nt, Artificial Sequence
  Synthetic
guguagccaccccaagaaua

SEQ ID NO: 391 - RNA, 20 nt, Artificial Sequence
  Synthetic
guccgugguagccagcucca

SEQ ID NO: 392 - RNA, 17 nt, Artificial Sequence
  Synthetic
gaauaccgagacaguga

SEQ ID NO: 393 - RNA, 17 nt, Artificial Sequence
  Synthetic
gacaguuccuguauucu

SEQ ID NO: 394 - RNA, 17 nt, Artificial Sequence
  Synthetic
cuacacggacauugacu

SEQ ID NO: 395 - RNA, 17 nt, Artificial Sequence
  Synthetic
uagccaccccaagaaua

SEQ ID NO: 396 - RNA, 17 nt, Artificial Sequence
  Synthetic
aauacaggaacuguccg

SEQ ID NO: 397 - RNA, 17 nt, Artificial Sequence
  Synthetic
cgugguagccagcucca

SEQ ID NO: 398 - RNA, 20 nt, Artificial Sequence
  Synthetic
gcugaauaccgagacaguga

SEQ ID NO: 399 - RNA, 20 nt, Artificial Sequence
  Synthetic
gagaaggaaaucccuggagc

SEQ ID NO: 400 - RNA, 20 nt, Artificial Sequence
  Synthetic
gacuuggcuguggaugaagc

SEQ ID NO: 401 - RNA, 17 nt, Artificial Sequence
  Synthetic
gacagugaaggcugaga

SEQ ID NO: 402 - RNA, 17 nt, Artificial Sequence
  Synthetic
ggacauugacuuggcug

SEQ ID NO: 403 - RNA, 17 nt, Artificial Sequence
  Synthetic
ggaugaagcaggccucu

SEQ ID NO: 404 - RNA, 17 nt, Artificial Sequence
  Synthetic
ggcaccuuuggccucau

SEQ ID NO: 405 - RNA, 20 nt, Artificial Sequence
  Synthetic
cgagacagugaaggcugaga

SEQ ID NO: 406 - RNA, 20 nt, Artificial Sequence
  Synthetic
aaggcugagaaggaaauccc

SEQ ID NO: 407 - RNA, 20 nt, Artificial Sequence
  Synthetic
aucccuggagcuggcuacca

SEQ ID NO: 408 - RNA, 20 nt, Artificial Sequence
  Synthetic
acggacaguucccguauucu

SEQ ID NO: 409 - RNA, 20 nt, Artificial Sequence
  Synthetic
cggacaguucccguauucuu

SEQ ID NO: 410 - RNA, 20 nt, Artificial Sequence
  Synthetic
caguucccguauucuugggg

SEQ ID NO: 411 - RNA, 20 nt, Artificial Sequence
  Synthetic
uggcuacacggacauugacu

SEQ ID NO: 412 - RNA, 20 nt, Artificial Sequence
  Synthetic
cacggacauugacuuggcug

SEQ ID NO: 413 - RNA, 20 nt, Artificial Sequence
  Synthetic
cuguggaugaagcaggccuc

SEQ ID NO: 414 - RNA, 20 nt, Artificial Sequence
  Synthetic
uguggaugaagcaggccucu

SEQ ID NO: 415 - RNA, 20 nt, Artificial Sequence
  Synthetic
uacagcaccgaugaggccaa

SEQ ID NO: 416 - RNA, 20 nt, Artificial Sequence
  Synthetic
aauggcaccuuuggccucau

SEQ ID NO: 417 - RNA, 20 nt, Artificial Sequence
  Synthetic
cggugcuguaaaugacccag

SEQ ID NO: 418 - RNA, 20 nt, Artificial Sequence
  Synthetic
uguagccaccccaagaauac

SEQ ID NO: 419 - RNA, 20 nt, Artificial Sequence
  Synthetic
aagaauacgggaacuguccg

SEQ ID NO: 420 - RNA, 20 nt, Artificial Sequence
  Synthetic
uguccgugguagccagcucc

SEQ ID NO: 421 - RNA, 20 nt, Artificial Sequence
  Synthetic
cuucucagccuucacugucu

SEQ ID NO: 422 - RNA, 20 nt, Artificial Sequence
  Synthetic
cucauaucuuaugacaguuc

SEQ ID NO: 423 - RNA, 17 nt, Artificial Sequence
  Synthetic
gcugagaaggaaauccc

SEQ ID NO: 424 - RNA, 17 nt, Artificial Sequence
  Synthetic
aaggaaaucccuggagc

SEQ ID NO: 425 - RNA, 17 nt, Artificial Sequence
  Synthetic
ccuggagcuggcuacca

SEQ ID NO: 426 - RNA, 17 nt, Artificial Sequence
  Synthetic
acaguucccguauucuu

SEQ ID NO: 427 - RNA, 17 nt, Artificial Sequence
  Synthetic
caguucccguauucuug

SEQ ID NO: 428 - RNA, 17 nt, Artificial Sequence
  Synthetic
uucccguauucuugggg

SEQ ID NO: 429 - RNA, 17 nt, Artificial Sequence
  Synthetic
uucuugggguggcuaca

SEQ ID NO: 430 - RNA, 17 nt, Artificial Sequence
  Synthetic
uuggcuguggaugaagc

SEQ ID NO: 431 - RNA, 17 nt, Artificial Sequence
  Synthetic
uggaugaagcaggccuc

SEQ ID NO: 432 - RNA, 17 nt, Artificial Sequence
  Synthetic
cauuuacagcaccgaug

SEQ ID NO: 433 - RNA, 17 nt, Artificial Sequence
  Synthetic
agcaccgaugaggccaa

SEQ ID NO: 434 - RNA, 17 nt, Artificial Sequence
  Synthetic
ugcuguaaaugacccag

SEQ ID NO: 435 - RNA, 17 nt, Artificial Sequence
  Synthetic
agccaccccaagaauac

SEQ ID NO: 436 - RNA, 17 nt, Artificial Sequence
  Synthetic
ccgugguagccagcucc

SEQ ID NO: 437 - RNA, 17 nt, Artificial Sequence
  Synthetic
cucagccuucacugucu

SEQ ID NO: 438 - RNA, 17 nt, Artificial Sequence
  Synthetic
auaucuuaugacaguuc

SEQ ID NO: 439 - RNA, 20 nt, Artificial Sequence
  Synthetic
gucaacuuugcuuaugacac

SEQ ID NO: 440 - RNA, 20 nt, Artificial Sequence
  Synthetic
ggagaagaagcucuuugccu

SEQ ID NO: 441 - RNA, 20 nt, Artificial Sequence
  Synthetic
gaccauguucaaguuguccc

SEQ ID NO: 442 - RNA, 20 nt, Artificial Sequence
  Synthetic
gcaaagagcuucuucuccag

SEQ ID NO: 443 - RNA, 20 nt, Artificial Sequence
  Synthetic
auagcgguucuugaauggga

SEQ ID NO: 444 - RNA, 17 nt, Artificial Sequence
  Synthetic
gaaugacuacaaccccc

SEQ ID NO: 445 - RNA, 17 nt, Artificial Sequence
  Synthetic
ggaggcuuuucacaucu

SEQ ID NO: 446 - RNA, 17 nt, Artificial Sequence
  Synthetic
gcgguucuugaauggga

SEQ ID NO: 447 - RNA, 17 nt, Artificial Sequence
  Synthetic
gucauaagcaaaguuga

SEQ ID NO: 448 - RNA, 20 nt, Artificial Sequence
  Synthetic
ggcaaagagcuucuucucca

SEQ ID NO: 449 - RNA, 20 nt, Artificial Sequence
  Synthetic
gguucuugaaugggaugguc

SEQ ID NO: 450 - RNA, 20 nt, Artificial Sequence
  Synthetic
guucuugaaugggaugguca

SEQ ID NO: 451 - RNA, 17 nt, Artificial Sequence
  Synthetic
gcuuaugacacaggcac

SEQ ID NO: 452 - RNA, 17 nt, Artificial Sequence
  Synthetic
gaagaagcucuuugccu

SEQ ID NO: 453 - RNA, 20 nt, Artificial Sequence
  Synthetic
uuugcuuaugacacaggcac

SEQ ID NO: 454 - RNA, 20 nt, Artificial Sequence
  Synthetic
caugauugacuacaaccccc

SEQ ID NO: 455 - RNA, 20 nt, Artificial Sequence
  Synthetic
uggagaagaagcucuuugcc

SEQ ID NO: 456 - RNA, 20 nt, Artificial Sequence
  Synthetic
ugccugggacaacuugaaca

SEQ ID NO: 457 - RNA, 20 nt, Artificial Sequence
  Synthetic
cuuggaggcuuuucacaucu

SEQ ID NO: 458 - RNA, 20 nt, Artificial Sequence
  Synthetic
aggcaaagagcuucuucucc

SEQ ID NO: 459 - RNA, 20 nt, Artificial Sequence
  Synthetic
caaagagcuucuucuccagg

SEQ ID NO: 460 - RNA, 20 nt, Artificial Sequence
  Synthetic
ucaugcugcuguacuuauag

SEQ ID NO: 461 - RNA, 20 nt, Artificial Sequence
  Synthetic
uacuuauagcgguucuugaa

SEQ ID NO: 462 - RNA, 20 nt, Artificial Sequence
  Synthetic
acuuauagcgguucuugaau

SEQ ID NO: 463 - RNA, 20 nt, Artificial Sequence
  Synthetic
ugugucauaagcaaaguuga

SEQ ID NO: 464 - RNA, 17 nt, Artificial Sequence
  Synthetic
aacuuugcuuaugacac

SEQ ID NO: 465 - RNA, 17 nt, Artificial Sequence
  Synthetic
agaagaagcucuuugcc

SEQ ID NO: 466 - RNA, 17 nt, Artificial Sequence
  Synthetic
cugggacaacuugaaca

SEQ ID NO: 467 - RNA, 17 nt, Artificial Sequence
  Synthetic
cauguucaaguuguccc

SEQ ID NO: 468 - RNA, 17 nt, Artificial Sequence
  Synthetic
caaagagcuucuucucc

SEQ ID NO: 469 - RNA, 17 nt, Artificial Sequence
  Synthetic
aaagagcuucuucucca

SEQ ID NO: 470 - RNA, 17 nt, Artificial Sequence
  Synthetic
aagagcuucuucuccag

SEQ ID NO: 471 - RNA, 17 nt, Artificial Sequence
  Synthetic
agagcuucuucuccagg

SEQ ID NO: 472 - RNA, 17 nt, Artificial Sequence
  Synthetic
ugcugcuguacuuauag

SEQ ID NO: 473 - RNA, 17 nt, Artificial Sequence
  Synthetic
uuauagcgguucuugaa

SEQ ID NO: 474 - RNA, 17 nt, Artificial Sequence
  Synthetic
uauagcgguucuugaau

SEQ ID NO: 475 - RNA, 17 nt, Artificial Sequence
  Synthetic
ucuugaaugggaugguc

SEQ ID NO: 476 - RNA, 17 nt, Artificial Sequence
  Synthetic
cuugaaugggaugguca

SEQ ID NO: 477 - RNA, 20 nt, Artificial Sequence
  Synthetic
gugcacguugcugcagcuuu

SEQ ID NO: 478 - RNA, 20 nt, Artificial Sequence
  Synthetic
gcuucuggccugccuggugu

SEQ ID NO: 479 - RNA, 20 nt, Artificial Sequence
  Synthetic
ggaaacccaaaccagagagu

SEQ ID NO: 480 - RNA, 20 nt, Artificial Sequence
  Synthetic
guuggaaagcagcagccagg

SEQ ID NO: 481 - RNA, 20 nt, Artificial Sequence
  Synthetic
gcacagcccgagcagugucu

SEQ ID NO: 482 - RNA, 20 nt, Artificial Sequence
  Synthetic
gaacugacuugucucggagg

SEQ ID NO: 483 - RNA, 20 nt, Artificial Sequence
  Synthetic
guaggcagucuccaacucuc

SEQ ID NO: 484 - RNA, 20 nt, Artificial Sequence
  Synthetic
gcuggucccgcucccgccuc

SEQ ID NO: 485 - RNA, 20 nt, Artificial Sequence
  Synthetic
gucgagcuuugguggccucc

SEQ ID NO: 486 - RNA, 20 nt, Artificial Sequence
  Synthetic
ggccuccaggucuaagcguu

SEQ ID NO: 487 - RNA, 20 nt, Artificial Sequence
  Synthetic
gcaucggccacucuggucau

SEQ ID NO: 488 - RNA, 17 nt, Artificial Sequence
  Synthetic
gcacguugcugcagcuu

SEQ ID NO: 489 - RNA, 17 nt, Artificial Sequence
  Synthetic
gacccgagacacugcuc

SEQ ID NO: 490 - RNA, 17 nt, Artificial Sequence
  Synthetic
gcucgggcugugccacc

SEQ ID NO: 491 - RNA, 17 nt, Artificial Sequence
  Synthetic
gagcagugucucggguc

SEQ ID NO: 492 - RNA, 17 nt, Artificial Sequence
  Synthetic
gaacugacuugucucgg

SEQ ID NO: 493 - RNA, 17 nt, Artificial Sequence
  Synthetic
gguccaaggucaauugg

SEQ ID NO: 494 - RNA, 17 nt, Artificial Sequence
  Synthetic
ggagcugagucgagcuu

SEQ ID NO: 495 - RNA, 17 nt, Artificial Sequence
  Synthetic
gcugagucgagcuuugg

SEQ ID NO: 496 - RNA, 17 nt, Artificial Sequence
  Synthetic
guuauggaugacugaca

SEQ ID NO: 497 - RNA, 17 nt, Artificial Sequence
  Synthetic
gcuggauucauugggac

SEQ ID NO: 498 - RNA, 20 nt, Artificial Sequence
  Synthetic
gcugcugcuucuggccugcc

SEQ ID NO: 499 - RNA, 20 nt, Artificial Sequence
  Synthetic
ggccugccuggugugggaug

SEQ ID NO: 500 - RNA, 20 nt, Artificial Sequence
  Synthetic
gccugccuggugugggaugu

SEQ ID NO: 501 - RNA, 20 nt, Artificial Sequence
  Synthetic
gggccaggacagcucagcuc

SEQ ID NO: 502 - RNA, 20 nt, Artificial Sequence
  Synthetic
ggaccaggcugccaggcccc

SEQ ID NO: 503 - RNA, 20 nt, Artificial Sequence
  Synthetic
ggccccaggagacccaggag

SEQ ID NO: 504 - RNA, 20 nt, Artificial Sequence
  Synthetic
gacccaggaggggcugcaga

SEQ ID NO: 505 - RNA, 20 nt, Artificial Sequence
  Synthetic
ggaggggcugcagagggagc

SEQ ID NO: 506 - RNA, 20 nt, Artificial Sequence
  Synthetic
gaggggcugcagagggagcu

SEQ ID NO: 507 - RNA, 20 nt, Artificial Sequence
  Synthetic
gggagcugggcacccugagg

SEQ ID NO: 508 - RNA, 20 nt, Artificial Sequence
  Synthetic
ggagcugggcacccugaggc

SEQ ID NO: 509 - RNA, 20 nt, Artificial Sequence
  Synthetic
gggcacccugaggcgggagc

SEQ ID NO: 510 - RNA, 20 nt, Artificial Sequence
  Synthetic
gaggcgggagcgggaccagc

SEQ ID NO: 511 - RNA, 20 nt, Artificial Sequence
  Synthetic
gagguuggaaagcagcagcc

SEQ ID NO: 512 - RNA, 20 nt, Artificial Sequence
  Synthetic
gcagcagccaggagguagca

SEQ ID NO: 513 - RNA, 20 nt, Artificial Sequence
  Synthetic
ggagguagcaaggcugagaa

SEQ ID NO: 514 - RNA, 20 nt, Artificial Sequence
  Synthetic
gagguagcaaggcugagaag

SEQ ID NO: 515 - RNA, 20 nt, Artificial Sequence
  Synthetic
gcugcugcuuuccaaccucc

SEQ ID NO: 516 - RNA, 20 nt, Artificial Sequence
  Synthetic
gucucggaggagguugcugu

SEQ ID NO: 517 - RNA, 20 nt, Artificial Sequence
  Synthetic
gcucccucugcagccccucc

SEQ ID NO: 518 - RNA, 20 nt, Artificial Sequence
  Synthetic
gcagccccuccugggucucc

SEQ ID NO: 519 - RNA, 20 nt, Artificial Sequence
  Synthetic
gggccuggcagccuggucca

SEQ ID NO: 520 - RNA, 20 nt, Artificial Sequence
  Synthetic
gguccaaggucaauuggugg

SEQ ID NO: 521 - RNA, 20 nt, Artificial Sequence
  Synthetic
ggagcugagucgagcuuugg

SEQ ID NO: 522 - RNA, 20 nt, Artificial Sequence
  Synthetic
gacauggccuggcucugcuc

SEQ ID NO: 523 - RNA, 20 nt, Artificial Sequence
  Synthetic
gcagcuggauucauugggac

SEQ ID NO: 524 - RNA, 20 nt, Artificial Sequence
  Synthetic
ggcaggccagaagcagcagc

SEQ ID NO: 525 - RNA, 17 nt, Artificial Sequence
  Synthetic
gcugcuucuggccugcc

SEQ ID NO: 526 - RNA, 17 nt, Artificial Sequence
  Synthetic
gccuggugugggaugug

SEQ ID NO: 527 - RNA, 17 nt, Artificial Sequence
  Synthetic
gacagcucagcucagga

SEQ ID NO: 528 - RNA, 17 nt, Artificial Sequence
  Synthetic
gccccaggagacccagg

SEQ ID NO: 529 - RNA, 17 nt, Artificial Sequence
  Synthetic
ggggcugcagagggagc

SEQ ID NO: 530 - RNA, 17 nt, Artificial Sequence
  Synthetic
gggcugcagagggagcu

SEQ ID NO: 531 - RNA, 17 nt, Artificial Sequence
  Synthetic
gggagcugggcacccug

SEQ ID NO: 532 - RNA, 17 nt, Artificial Sequence
  Synthetic
gcugggcacccugaggc

SEQ ID NO: 533 - RNA, 17 nt, Artificial Sequence
  Synthetic
gcacccugaggcgggag

SEQ ID NO: 534 - RNA, 17 nt, Artificial Sequence
  Synthetic
gcgggagcgggaccagc

SEQ ID NO: 535 - RNA, 17 nt, Artificial Sequence
  Synthetic
gcaagaaaaugagaauc

SEQ ID NO: 536 - RNA, 17 nt, Artificial Sequence
  Synthetic
gaaucuggccaggaggu

SEQ ID NO: 537 - RNA, 17 nt, Artificial Sequence
  Synthetic
guuggaaagcagcagcc

SEQ ID NO: 538 - RNA, 17 nt, Artificial Sequence
  Synthetic
ggaaagcagcagccagg

SEQ ID NO: 539 - RNA, 17 nt, Artificial Sequence
  Synthetic
gcagccaggagguagca

SEQ ID NO: 540 - RNA, 17 nt, Artificial Sequence
  Synthetic
gguagcaaggcugagaa

SEQ ID NO: 541 - RNA, 17 nt, Artificial Sequence
  Synthetic
guagcaaggcugagaag

SEQ ID NO: 542 - RNA, 17 nt, Artificial Sequence
  Synthetic
gcagugucucgggucug

SEQ ID NO: 543 - RNA, 17 nt, Artificial Sequence
  Synthetic
gcugcuuuccaaccucc

SEQ ID NO: 544 - RNA, 17 nt, Artificial Sequence
  Synthetic
ggcagucuccaacucuc

SEQ ID NO: 545 - RNA, 17 nt, Artificial Sequence
  Synthetic
ggucccgcucccgccuc

SEQ ID NO: 546 - RNA, 17 nt, Artificial Sequence
  Synthetic
gucccgcucccgccuca

SEQ ID NO: 547 - RNA, 17 nt, Artificial Sequence
  Synthetic
gccccuccugggucucc

SEQ ID NO: 548 - RNA, 17 nt, Artificial Sequence
  Synthetic
gguggaggaggcucucc

SEQ ID NO: 549 - RNA, 17 nt, Artificial Sequence
  Synthetic
guggaggaggcucucca

SEQ ID NO: 550 - RNA, 17 nt, Artificial Sequence
  Synthetic
gagcuuugguggccucc

SEQ ID NO: 551 - RNA, 17 nt, Artificial Sequence
  Synthetic
ggaugacugacauggcc

SEQ ID NO: 552 - RNA, 17 nt, Artificial Sequence
  Synthetic
gcucugcucugggcagc

SEQ ID NO: 553 - RNA, 17 nt, Artificial Sequence
  Synthetic
gggcagcuggauucauu

SEQ ID NO: 554 - RNA, 17 nt, Artificial Sequence
  Synthetic
gggacuggccacacuga

SEQ ID NO: 555 - RNA, 20 nt, Artificial Sequence
  Synthetic
ugugcacguugcugcagcuu

SEQ ID NO: 556 - RNA, 20 nt, Artificial Sequence
  Synthetic
agcuguccagcugcugcuuc

SEQ ID NO: 557 - RNA, 20 nt, Artificial Sequence
  Synthetic
ugcuucuggccugccuggug

SEQ ID NO: 558 - RNA, 20 nt, Artificial Sequence
  Synthetic
ccugccuggugugggaugug

SEQ ID NO: 559 - RNA, 20 nt, Artificial Sequence
  Synthetic
cugccuggugugggaugugg

SEQ ID NO: 560 - RNA, 20 nt, Artificial Sequence
  Synthetic
uggugugggaugugggggcc

SEQ ID NO: 561 - RNA, 20 nt, Artificial Sequence
  Synthetic
caggacagcucagcucagga

SEQ ID NO: 562 - RNA, 20 nt, Artificial Sequence
  Synthetic
aggaaggccaaugaccagag

SEQ ID NO: 563 - RNA, 20 nt, Artificial Sequence
  Synthetic
augccaguauaccuucagug

SEQ ID NO: 564 - RNA, 20 nt, Artificial Sequence
  Synthetic
cagcugcccagagcagagcc

SEQ ID NO: 565 - RNA, 20 nt, Artificial Sequence
  Synthetic
cagcacccaacgcuuagacc

SEQ ID NO: 566 - RNA, 20 nt, Artificial Sequence
  Synthetic
cacccaacgcuuagaccugg

SEQ ID NO: 567 - RNA, 20 nt, Artificial Sequence
  Synthetic
caaagcucgacucagcuccc

SEQ ID NO: 568 - RNA, 20 nt, Artificial Sequence
  Synthetic
ccuccuccaccaauugaccu

SEQ ID NO: 569 - RNA, 20 nt, Artificial Sequence
  Synthetic
ccaccaauugaccuuggacc

SEQ ID NO: 570 - RNA, 20 nt, Artificial Sequence
  Synthetic
ugaccuuggaccaggcugcc

SEQ ID NO: 571 - RNA, 20 nt, Artificial Sequence
  Synthetic
ugccaggccccaggagaccc

SEQ ID NO: 572 - RNA, 20 nt, Artificial Sequence
  Synthetic
caggccccaggagacccagg

SEQ ID NO: 573 - RNA, 20 nt, Artificial Sequence
  Synthetic
aggccccaggagacccagga

SEQ ID NO: 574 - RNA, 20 nt, Artificial Sequence
  Synthetic
agacccaggaggggcugcag

SEQ ID NO: 575 - RNA, 20 nt, Artificial Sequence
  Synthetic
agagggagcugggcacccug

SEQ ID NO: 576 - RNA, 20 nt, Artificial Sequence
  Synthetic
ugggcacccugaggcgggag

SEQ ID NO: 577 - RNA, 20 nt, Artificial Sequence
  Synthetic
ccuccgagacaagucaguuc

SEQ ID NO: 578 - RNA, 20 nt, Artificial Sequence
  Synthetic
ccgagacaagucaguucugg

SEQ ID NO: 579 - RNA, 20 nt, Artificial Sequence
  Synthetic
aggaagagaagaagcgacua

SEQ ID NO: 580 - RNA, 20 nt, Artificial Sequence
  Synthetic
aaggcaagaaaaugagaauc

SEQ ID NO: 581 - RNA, 20 nt, Artificial Sequence
  Synthetic
aagaaaaugagaaucuggcc

SEQ ID NO: 582 - RNA, 20 nt, Artificial Sequence
  Synthetic
aaaaugagaaucuggccagg

SEQ ID NO: 583 - RNA, 20 nt, Artificial Sequence
  Synthetic
ugagaaucuggccaggaggu

SEQ ID NO: 584 - RNA, 20 nt, Artificial Sequence
  Synthetic
aggagguagcaaggcugaga

SEQ ID NO: 585 - RNA, 20 nt, Artificial Sequence
  Synthetic
cccagacccgagacacugcu

SEQ ID NO: 586 - RNA, 20 nt, Artificial Sequence
  Synthetic
ccagacccgagacacugcuc

SEQ ID NO: 587 - RNA, 20 nt, Artificial Sequence
  Synthetic
acugcucgggcugugccacc

SEQ ID NO: 588 - RNA, 20 nt, Artificial Sequence
  Synthetic
cacagcccgagcagugucuc

SEQ ID NO: 589 - RNA, 20 nt, Artificial Sequence
  Synthetic
cccgagcagugucucggguc

SEQ ID NO: 590 - RNA, 20 nt, Artificial Sequence
  Synthetic
ccgagcagugucucgggucu

SEQ ID NO: 591 - RNA, 20 nt, Artificial Sequence
  Synthetic
cgagcagugucucgggucug

SEQ ID NO: 592 - RNA, 20 nt, Artificial Sequence
  Synthetic
ugucucgggucuggggacac

SEQ ID NO: 593 - RNA, 20 nt, Artificial Sequence
  Synthetic
uucucagccuugcuaccucc

SEQ ID NO: 594 - RNA, 20 nt, Artificial Sequence
  Synthetic
ccuccagaacugacuugucu

SEQ ID NO: 595 - RNA, 20 nt, Artificial Sequence
  Synthetic
ccagaacugacuugucucgg

SEQ ID NO: 596 - RNA, 20 nt, Artificial Sequence
  Synthetic
cagucuccaacucucugguu

SEQ ID NO: 597 - RNA, 20 nt, Artificial Sequence
  Synthetic
agucuccaacucucugguuu

SEQ ID NO: 598 - RNA, 20 nt, Artificial Sequence
  Synthetic
cucugguuuggguuuccagc

SEQ ID NO: 599 - RNA, 20 nt, Artificial Sequence
  Synthetic
cuggucccgcucccgccuca

SEQ ID NO: 600 - RNA, 20 nt, Artificial Sequence
  Synthetic
cucccucugcagccccuccu

SEQ ID NO: 601 - RNA, 20 nt, Artificial Sequence
  Synthetic
cagccccuccugggucuccu

SEQ ID NO: 602 - RNA, 20 nt, Artificial Sequence
  Synthetic
agccccuccugggucuccug

SEQ ID NO: 603 - RNA, 20 nt, Artificial Sequence
  Synthetic
cuccugggucuccuggggcc

SEQ ID NO: 604 - RNA, 20 nt, Artificial Sequence
  Synthetic
ucuccuggggccuggcagcc

SEQ ID NO: 605 - RNA, 20 nt, Artificial Sequence
  Synthetic
cagccugguccaaggucaau

SEQ ID NO: 606 - RNA, 20 nt, Artificial Sequence
  Synthetic
ccugguccaaggucaauugg

SEQ ID NO: 607 - RNA, 20 nt, Artificial Sequence
  Synthetic
ccaaggucaauugguggagg

SEQ ID NO: 608 - RNA, 20 nt, Artificial Sequence
  Synthetic
auugguggaggaggcucucc

SEQ ID NO: 609 - RNA, 20 nt, Artificial Sequence
  Synthetic
uugguggaggaggcucucca

SEQ ID NO: 610 - RNA, 20 nt, Artificial Sequence
  Synthetic
cagggagcugagucgagcuu

SEQ ID NO: 611 - RNA, 20 nt, Artificial Sequence
  Synthetic
uggccuccaggucuaagcgu

SEQ ID NO: 612 - RNA, 20 nt, Artificial Sequence
  Synthetic
ugcugucucucuguaaguua

SEQ ID NO: 613 - RNA, 20 nt, Artificial Sequence
  Synthetic
uaaguuauggaugacugaca

SEQ ID NO: 614 - RNA, 20 nt, Artificial Sequence
  Synthetic
uauggaugacugacauggcc

SEQ ID NO: 615 - RNA, 20 nt, Artificial Sequence
  Synthetic
acauggccuggcucugcucu

SEQ ID NO: 616 - RNA, 20 nt, Artificial Sequence
  Synthetic
cuggcucugcucugggcagc

SEQ ID NO: 617 - RNA, 20 nt, Artificial Sequence
  Synthetic
cucugggcagcuggauucau

SEQ ID NO: 618 - RNA, 20 nt, Artificial Sequence
  Synthetic
ucugggcagcuggauucauu

SEQ ID NO: 619 - RNA, 20 nt, Artificial Sequence
  Synthetic
auugggacuggccacacuga

SEQ ID NO: 620 - RNA, 20 nt, Artificial Sequence
  Synthetic
uggccacacugaagguauac

SEQ ID NO: 621 - RNA, 20 nt, Artificial Sequence
  Synthetic
cacugaagguauacuggcau

SEQ ID NO: 622 - RNA, 20 nt, Artificial Sequence
  Synthetic
uauacuggcaucggccacuc

SEQ ID NO: 623 - RNA, 20 nt, Artificial Sequence
  Synthetic
cuuccugagcugagcugucc

SEQ ID NO: 624 - RNA, 20 nt, Artificial Sequence
  Synthetic
uggcccccacaucccacacc

SEQ ID NO: 625 - RNA, 20 nt, Artificial Sequence
  Synthetic
ccccacaucccacaccaggc

SEQ ID NO: 626 - RNA, 20 nt, Artificial Sequence
  Synthetic
agaagcagcagcuggacagc

SEQ ID NO: 627 - RNA, 20 nt, Artificial Sequence
  Synthetic
agcuggacagcuggcaucuc

SEQ ID NO: 628 - RNA, 17 nt, Artificial Sequence
  Synthetic
cacguugcugcagcuuu

SEQ ID NO: 629 - RNA, 17 nt, Artificial Sequence
  Synthetic
uguccagcugcugcuuc

SEQ ID NO: 630 - RNA, 17 nt, Artificial Sequence
  Synthetic
uucuggccugccuggug

SEQ ID NO: 631 - RNA, 17 nt, Artificial Sequence
  Synthetic
ucuggccugccuggugu

SEQ ID NO: 632 - RNA, 17 nt, Artificial Sequence
  Synthetic
cugccuggugugggaug

SEQ ID NO: 633 - RNA, 17 nt, Artificial Sequence
  Synthetic
ugccuggugugggaugu

SEQ ID NO: 634 - RNA, 17 nt, Artificial Sequence
  Synthetic
ccuggugugggaugugg

SEQ ID NO: 635 - RNA, 17 nt, Artificial Sequence
  Synthetic
ugugggaugugggggcc

SEQ ID NO: 636 - RNA, 17 nt, Artificial Sequence
  Synthetic
ccaggacagcucagcuc

SEQ ID NO: 637 - RNA, 17 nt, Artificial Sequence
  Synthetic
aaggccaaugaccagag

SEQ ID NO: 638 - RNA, 17 nt, Artificial Sequence
  Synthetic
ccaguauaccuucagug

SEQ ID NO: 639 - RNA, 17 nt, Artificial Sequence
  Synthetic
cugcccagagcagagcc

SEQ ID NO: 640 - RNA, 17 nt, Artificial Sequence
  Synthetic
cacccaacgcuuagacc

SEQ ID NO: 641 - RNA, 17 nt, Artificial Sequence
  Synthetic
ccaacgcuuagaccugg

SEQ ID NO: 642 - RNA, 17 nt, Artificial Sequence
  Synthetic
agcucgacucagcuccc

SEQ ID NO: 643 - RNA, 17 nt, Artificial Sequence
  Synthetic
ccuccaccaauugaccu

SEQ ID NO: 644 - RNA, 17 nt, Artificial Sequence
  Synthetic
ccaauugaccuuggacc

SEQ ID NO: 645 - RNA, 17 nt, Artificial Sequence
  Synthetic
ccuuggaccaggcugcc

SEQ ID NO: 646 - RNA, 17 nt, Artificial Sequence
  Synthetic
ccaggcugccaggcccc

SEQ ID NO: 647 - RNA, 17 nt, Artificial Sequence
  Synthetic
caggccccaggagaccc

SEQ ID NO: 648 - RNA, 17 nt, Artificial Sequence
  Synthetic
ccccaggagacccagga

SEQ ID NO: 649 - RNA, 17 nt, Artificial Sequence
  Synthetic
cccaggagacccaggag

SEQ ID NO: 650 - RNA, 17 nt, Artificial Sequence
  Synthetic
cccaggaggggcugcag

SEQ ID NO: 651 - RNA, 17 nt, Artificial Sequence
  Synthetic
ccaggaggggcugcaga

SEQ ID NO: 652 - RNA, 17 nt, Artificial Sequence
  Synthetic
agcugggcacccugagg

SEQ ID NO: 653 - RNA, 17 nt, Artificial Sequence
  Synthetic
cacccugaggcgggagc

SEQ ID NO: 654 - RNA, 17 nt, Artificial Sequence
  Synthetic
aacccaaaccagagagu

SEQ ID NO: 655 - RNA, 17 nt, Artificial Sequence
  Synthetic
ccgagacaagucaguuc

SEQ ID NO: 656 - RNA, 17 nt, Artificial Sequence
  Synthetic
agacaagucaguucugg

SEQ ID NO: 657 - RNA, 17 nt, Artificial Sequence
  Synthetic
aagagaagaagcgacua

SEQ ID NO: 658 - RNA, 17 nt, Artificial Sequence
  Synthetic
aaaaugagaaucuggcc

SEQ ID NO: 659 - RNA, 17 nt, Artificial Sequence
  Synthetic
augagaaucuggccagg

SEQ ID NO: 660 - RNA, 17 nt, Artificial Sequence
  Synthetic
agguagcaaggcugaga

SEQ ID NO: 661 - RNA, 17 nt, Artificial Sequence
  Synthetic
agacccgagacacugcu

SEQ ID NO: 662 - RNA, 17 nt, Artificial Sequence
  Synthetic
cagcccgagcagugucu

SEQ ID NO: 663 - RNA, 17 nt, Artificial Sequence
  Synthetic
agcccgagcagugucuc

SEQ ID NO: 664 - RNA, 17 nt, Artificial Sequence
  Synthetic
agcagugucucgggucu

SEQ ID NO: 665 - RNA, 17 nt, Artificial Sequence
  Synthetic
cucgggucuggggacac

SEQ ID NO: 666 - RNA, 17 nt, Artificial Sequence
  Synthetic
ucagccuugcuaccucc

SEQ ID NO: 667 - RNA, 17 nt, Artificial Sequence
  Synthetic
ccagaacugacuugucu

SEQ ID NO: 668 - RNA, 17 nt, Artificial Sequence
  Synthetic
cugacuugucucggagg

SEQ ID NO: 669 - RNA, 17 nt, Artificial Sequence
  Synthetic
ucggaggagguugcugu

SEQ ID NO: 670 - RNA, 17 nt, Artificial Sequence
  Synthetic
ucuccaacucucugguu

SEQ ID NO: 671 - RNA, 17 nt, Artificial Sequence
  Synthetic
cuccaacucucugguuu

SEQ ID NO: 672 - RNA, 17 nt, Artificial Sequence
  Synthetic
ugguuuggguuuccagc

SEQ ID NO: 673 - RNA, 17 nt, Artificial Sequence
  Synthetic
cccucugcagccccucc

SEQ ID NO: 674 - RNA, 17 nt, Artificial Sequence
  Synthetic
ccucugcagccccuccu

SEQ ID NO: 675 - RNA, 17 nt, Artificial Sequence
  Synthetic
ccccuccugggucuccu

SEQ ID NO: 676 - RNA, 17 nt, Artificial Sequence
  Synthetic
cccuccugggucuccug

SEQ ID NO: 677 - RNA, 17 nt, Artificial Sequence
  Synthetic
cugggucuccuggggcc

SEQ ID NO: 678 - RNA, 17 nt, Artificial Sequence
  Synthetic
ccuggggccuggcagcc

SEQ ID NO: 679 - RNA, 17 nt, Artificial Sequence
  Synthetic
ccuggcagccuggucca

SEQ ID NO: 680 - RNA, 17 nt, Artificial Sequence
  Synthetic
ccugguccaaggucaau

SEQ ID NO: 681 - RNA, 17 nt, Artificial Sequence
  Synthetic
ccaaggucaauuggugg

SEQ ID NO: 682 - RNA, 17 nt, Artificial Sequence
  Synthetic
aggucaauugguggagg

SEQ ID NO: 683 - RNA, 17 nt, Artificial Sequence
  Synthetic
ccuccaggucuaagcgu

SEQ ID NO: 684 - RNA, 17 nt, Artificial Sequence
  Synthetic
cuccaggucuaagcguu

SEQ ID NO: 685 - RNA, 17 nt, Artificial Sequence
  Synthetic
ugucucucuguaaguua

SEQ ID NO: 686 - RNA, 17 nt, Artificial Sequence
  Synthetic
auggccuggcucugcuc

SEQ ID NO: 687 - RNA, 17 nt, Artificial Sequence
  Synthetic
uggccuggcucugcucu

SEQ ID NO: 688 - RNA, 17 nt, Artificial Sequence
  Synthetic
ugggcagcuggauucau

SEQ ID NO: 689 - RNA, 17 nt, Artificial Sequence
  Synthetic
ccacacugaagguauac

SEQ ID NO: 690 - RNA, 17 nt, Artificial Sequence
  Synthetic
ugaagguauacuggcau

SEQ ID NO: 691 - RNA, 17 nt, Artificial Sequence
  Synthetic
acuggcaucggccacuc

SEQ ID NO: 692 - RNA, 17 nt, Artificial Sequence
  Synthetic
ucggccacucuggucau

SEQ ID NO: 693 - RNA, 17 nt, Artificial Sequence
  Synthetic
ccugagcugagcugucc

SEQ ID NO: 694 - RNA, 17 nt, Artificial Sequence
  Synthetic
cccccacaucccacacc

SEQ ID NO: 695 - RNA, 17 nt, Artificial Sequence
  Synthetic
cacaucccacaccaggc

SEQ ID NO: 696 - RNA, 17 nt, Artificial Sequence
  Synthetic
aggccagaagcagcagc

SEQ ID NO: 697 - RNA, 17 nt, Artificial Sequence
  Synthetic
agcagcagcuggacagc

SEQ ID NO: 698 - RNA, 17 nt, Artificial Sequence
  Synthetic
uggacagcuggcaucuc

SEQ ID NO: 699 - RNA, 20 nt, Artificial Sequence
  Synthetic
cuuuuaaugcaguuucuacg

SEQ ID NO: 700 - RNA, 20 nt, Artificial Sequence
  Synthetic
ugcaguuucuacguggaauu

SEQ ID NO: 701 - RNA, 20 nt, Artificial Sequence
  Synthetic
uacguggaauuuggacacuu

SEQ ID NO: 702 - RNA, 20 nt, Artificial Sequence
  Synthetic
uuuggacacuuuggccuucc

SEQ ID NO: 703 - RNA, 20 nt, Artificial Sequence
  Synthetic
uccugcuucccgaauuuuga

SEQ ID NO: 704 - RNA, 20 nt, Artificial Sequence
  Synthetic
auuuugaaggagagcccauc

SEQ ID NO: 705 - RNA, 20 nt, Artificial Sequence
  Synthetic
agagcccaucuggcuaucuc

SEQ ID NO: 706 - RNA, 20 nt, Artificial Sequence
  Synthetic
ccaucuggcuaucucaggag

SEQ ID NO: 707 - RNA, 20 nt, Artificial Sequence
  Synthetic
uggcuaucucaggaguggag

SEQ ID NO: 708 - RNA, 20 nt, Artificial Sequence
  Synthetic
ggcuaucucaggaguggaga

SEQ ID NO: 709 - RNA, 20 nt, Artificial Sequence
  Synthetic
aggaguggagagggagacac

SEQ ID NO: 710 - RNA, 20 nt, Artificial Sequence
  Synthetic
gaagaaacuuaacuucauac

SEQ ID NO: 711 - RNA, 20 nt, Artificial Sequence
  Synthetic
ccacuccugagauagccaga

SEQ ID NO: 712 - RNA, 20 nt, Artificial Sequence
  Synthetic
cacuccugagauagccagau

SEQ ID NO: 713 - RNA, 20 nt, Artificial Sequence
  Synthetic
augggcucuccuucaaaauu

SEQ ID NO: 714 - RNA, 20 nt, Artificial Sequence
  Synthetic
ugggcucuccuucaaaauuc

SEQ ID NO: 715 - RNA, 20 nt, Artificial Sequence
  Synthetic
uccuucaaaauucgggaagc

SEQ ID NO: 716 - RNA, 20 nt, Artificial Sequence
  Synthetic
agcaggaacuucaguuagcu

SEQ ID NO: 717 - RNA, 20 nt, Artificial Sequence
  Synthetic
uuagcucggacuucaguucc

SEQ ID NO: 718 - RNA, 20 nt, Artificial Sequence
  Synthetic
cucggacuucaguuccugga

SEQ ID NO: 719 - RNA, 17 nt, Artificial Sequence
  Synthetic
uuaaugcaguuucuacg

SEQ ID NO: 720 - RNA, 17 nt, Artificial Sequence
  Synthetic
aguuucuacguggaauu

SEQ ID NO: 721 - RNA, 17 nt, Artificial Sequence
  Synthetic
guggaauuuggacacuu

SEQ ID NO: 722 - RNA, 17 nt, Artificial Sequence
  Synthetic
ggacacuuuggccuucc

SEQ ID NO: 723 - RNA, 17 nt, Artificial Sequence
  Synthetic
ugcuucccgaauuuuga

SEQ ID NO: 724 - RNA, 17 nt, Artificial Sequence
  Synthetic
uugaaggagagcccauc

SEQ ID NO: 725 - RNA, 17 nt, Artificial Sequence
  Synthetic
gcccaucuggcuaucuc

SEQ ID NO: 726 - RNA, 17 nt, Artificial Sequence
  Synthetic
ucuggcuaucucaggag

SEQ ID NO: 727 - RNA, 17 nt, Artificial Sequence
  Synthetic
cuaucucaggaguggag

SEQ ID NO: 728 - RNA, 17 nt, Artificial Sequence
  Synthetic
uaucucaggaguggaga

SEQ ID NO: 729 - RNA, 17 nt, Artificial Sequence
  Synthetic
aguggagagggagacac

SEQ ID NO: 730 - RNA, 17 nt, Artificial Sequence
  Synthetic
gaaacuuaacuucauac

SEQ ID NO: 731 - RNA, 17 nt, Artificial Sequence
  Synthetic
cuccugagauagccaga

SEQ ID NO: 732 - RNA, 17 nt, Artificial Sequence
  Synthetic
uccugagauagccagau

SEQ ID NO: 733 - RNA, 17 nt, Artificial Sequence
  Synthetic
ggcucuccuucaaaauu

SEQ ID NO: 734 - RNA, 17 nt, Artificial Sequence
  Synthetic
gcucuccuucaaaauuc

SEQ ID NO: 735 - RNA, 17 nt, Artificial Sequence
  Synthetic
uucaaaauucgggaagc

SEQ ID NO: 736 - RNA, 17 nt, Artificial Sequence
  Synthetic
aggaacuucaguuagcu

SEQ ID NO: 737 - RNA, 17 nt, Artificial Sequence
  Synthetic
gcucggacuucaguucc

SEQ ID NO: 738 - RNA, 17 nt, Artificial Sequence
  Synthetic
ggacuucaguuccugga

SEQ ID NO: 739 - RNA, 20 nt, Artificial Sequence
  Synthetic
uuucugaauuuaccaggaug

SEQ ID NO: 740 - RNA, 20 nt, Artificial Sequence
  Synthetic
caggauguggagaacuaguu

SEQ ID NO: 741 - RNA, 20 nt, Artificial Sequence
  Synthetic
aggauguggagaacuaguuu

SEQ ID NO: 742 - RNA, 20 nt, Artificial Sequence
  Synthetic
uguggagaacuaguuugggu

SEQ ID NO: 743 - RNA, 20 nt, Artificial Sequence
  Synthetic
agaacagcagaaacaauuac

SEQ ID NO: 744 - RNA, 20 nt, Artificial Sequence
  Synthetic
gaaacaauuacuggcaagua

SEQ ID NO: 745 - RNA, 20 nt, Artificial Sequence
  Synthetic
uuacuggcaaguauggugug

SEQ ID NO: 746 - RNA, 20 nt, Artificial Sequence
  Synthetic
gcccaccuaccccuacaccc

SEQ ID NO: 747 - RNA, 20 nt, Artificial Sequence
  Synthetic
ccuacacccaggagaccacg

SEQ ID NO: 748 - RNA, 20 nt, Artificial Sequence
  Synthetic
acguggagaaucgacacagu

SEQ ID NO: 749 - RNA, 20 nt, Artificial Sequence
  Synthetic
gagaaucgacacaguuggca

SEQ ID NO: 750 - RNA, 20 nt, Artificial Sequence
  Synthetic
aguuggcacggauguccgcc

SEQ ID NO: 751 - RNA, 20 nt, Artificial Sequence
  Synthetic
ccucaucagccaguuuaugc

SEQ ID NO: 752 - RNA, 20 nt, Artificial Sequence
  Synthetic
cucaucagccaguuuaugca

SEQ ID NO: 753 - RNA, 20 nt, Artificial Sequence
  Synthetic
uaugcagggcuacccuucua

SEQ ID NO: 754 - RNA, 20 nt, Artificial Sequence
  Synthetic
cuaagguucacauacugccu

SEQ ID NO: 755 - RNA, 20 nt, Artificial Sequence
  Synthetic
ucacauacugccuaggccac

SEQ ID NO: 756 - RNA, 20 nt, Artificial Sequence
  Synthetic
gccuaggccacuggaaagca

SEQ ID NO: 757 - RNA, 20 nt, Artificial Sequence
  Synthetic
ccuaggccacuggaaagcac

SEQ ID NO: 758 - RNA, 20 nt, Artificial Sequence
  Synthetic
acuggaaagcacgggugcug

SEQ ID NO: 759 - RNA, 20 nt, Artificial Sequence
  Synthetic
cacgggugcugugguguacu

SEQ ID NO: 760 - RNA, 20 nt, Artificial Sequence
  Synthetic
acgggugcugugguguacuc

SEQ ID NO: 761 - RNA, 20 nt, Artificial Sequence
  Synthetic
cgggugcugugguguacucg

SEQ ID NO: 762 - RNA, 20 nt, Artificial Sequence
  Synthetic
cucggggagccucuauuucc

SEQ ID NO: 763 - RNA, 20 nt, Artificial Sequence
  Synthetic
ucggggagccucuauuucca

SEQ ID NO: 764 - RNA, 20 nt, Artificial Sequence
  Synthetic
ggacaguucccguauucuug

SEQ ID NO: 765 - RNA, 20 nt, Artificial Sequence
  Synthetic
caaacugaacccagagaauc

SEQ ID NO: 766 - RNA, 20 nt, Artificial Sequence
  Synthetic
aucuggaacucgaacaaacc

SEQ ID NO: 767 - RNA, 20 nt, Artificial Sequence
  Synthetic
ucuggaacucgaacaaaccu

SEQ ID NO: 768 - RNA, 20 nt, Artificial Sequence
  Synthetic
gccaaugccuucaucaucug

SEQ ID NO: 769 - RNA, 20 nt, Artificial Sequence
  Synthetic
gaaaagccuccaagcuguac

SEQ ID NO: 770 - RNA, 20 nt, Artificial Sequence
  Synthetic
ccuccaagcuguacaggcaa

SEQ ID NO: 771 - RNA, 20 nt, Artificial Sequence
  Synthetic
gcuguacaggcaauggcaga

SEQ ID NO: 772 - RNA, 20 nt, Artificial Sequence
  Synthetic
aauggcagaaggagaugcuc

SEQ ID NO: 773 - RNA, 20 nt, Artificial Sequence
  Synthetic
auggcagaaggagaugcuca

SEQ ID NO: 774 - RNA, 20 nt, Artificial Sequence
  Synthetic
aaggagaugcucagggcucc

SEQ ID NO: 775 - RNA, 20 nt, Artificial Sequence
  Synthetic
aggagaugcucagggcuccu

SEQ ID NO: 776 - RNA, 20 nt, Artificial Sequence
  Synthetic
ggagaugcucagggcuccug

SEQ ID NO: 777 - RNA, 20 nt, Artificial Sequence
  Synthetic
gagaugcucagggcuccugg

SEQ ID NO: 778 - RNA, 20 nt, Artificial Sequence
  Synthetic
agaugcucagggcuccuggg

SEQ ID NO: 779 - RNA, 20 nt, Artificial Sequence
  Synthetic
ucagggcuccuggggggagc

SEQ ID NO: 780 - RNA, 20 nt, Artificial Sequence
  Synthetic
uccuggggggagcaggcuga

SEQ ID NO: 781 - RNA, 20 nt, Artificial Sequence
  Synthetic
ccuggggggagcaggcugaa

SEQ ID NO: 782 - RNA, 20 nt, Artificial Sequence
  Synthetic
gaagggagagccagccagcc

SEQ ID NO: 783 - RNA, 20 nt, Artificial Sequence
  Synthetic
aagggagagccagccagcca

SEQ ID NO: 784 - RNA, 20 nt, Artificial Sequence
  Synthetic
gagccagccagccagggccc

SEQ ID NO: 785 - RNA, 20 nt, Artificial Sequence
  Synthetic
cccuucagccugcucccccc

SEQ ID NO: 786 - RNA, 20 nt, Artificial Sequence
  Synthetic
cugccauugccuguacagcu

SEQ ID NO: 787 - RNA, 20 nt, Artificial Sequence
  Synthetic
ccauugccuguacagcuugg

SEQ ID NO: 788 - RNA, 20 nt, Artificial Sequence
  Synthetic
guugacgguagcaucugcug

SEQ ID NO: 789 - RNA, 20 nt, Artificial Sequence
  Synthetic
ugcugagguguagcugcuga

SEQ ID NO: 790 - RNA, 20 nt, Artificial Sequence
  Synthetic
guagcugcugacgguguaca

SEQ ID NO: 791 - RNA, 20 nt, Artificial Sequence
  Synthetic
caaggugccacagaugauga

SEQ ID NO: 792 - RNA, 20 nt, Artificial Sequence
  Synthetic
gccacagaugaugaaggcau

SEQ ID NO: 793 - RNA, 20 nt, Artificial Sequence
  Synthetic
cauuggcgacugacugcuua

SEQ ID NO: 794 - RNA, 20 nt, Artificial Sequence
  Synthetic
cuuacggauguuugucuccc

SEQ ID NO: 795 - RNA, 20 nt, Artificial Sequence
  Synthetic
uguucgaguuccagauucuc

SEQ ID NO: 796 - RNA, 20 nt, Artificial Sequence
  Synthetic
guucgaguuccagauucucu

SEQ ID NO: 797 - RNA, 20 nt, Artificial Sequence
  Synthetic
cagauucucuggguucaguu

SEQ ID NO: 798 - RNA, 20 nt, Artificial Sequence
  Synthetic
ucucuggguucaguuuggag

SEQ ID NO: 799 - RNA, 20 nt, Artificial Sequence
  Synthetic
guucaguuuggagaggacaa

SEQ ID NO: 800 - RNA, 20 nt, Artificial Sequence
  Synthetic
ggagaggacaauggcaccuu

SEQ ID NO: 801 - RNA, 20 nt, Artificial Sequence
  Synthetic
caguucuggacucagcgccc

SEQ ID NO: 802 - RNA, 20 nt, Artificial Sequence
  Synthetic
acucagcgcccuggaaauag

SEQ ID NO: 803 - RNA, 20 nt, Artificial Sequence
  Synthetic
acagcacccgugcuuuccag

SEQ ID NO: 804 - RNA, 20 nt, Artificial Sequence
  Synthetic
cccgugcuuuccaguggccu

SEQ ID NO: 805 - RNA, 20 nt, Artificial Sequence
  Synthetic
ggcaguaugugaaccuuaga

SEQ ID NO: 806 - RNA, 20 nt, Artificial Sequence
  Synthetic
gcaguaugugaaccuuagaa

SEQ ID NO: 807 - RNA, 20 nt, Artificial Sequence
  Synthetic
aaggguagcccugcauaaac

SEQ ID NO: 808 - RNA, 20 nt, Artificial Sequence
  Synthetic
ccugcauaaacuggcugaug

SEQ ID NO: 809 - RNA, 20 nt, Artificial Sequence
  Synthetic
ugaggucauacucaaaaacc

SEQ ID NO: 810 - RNA, 20 nt, Artificial Sequence
  Synthetic
ggucauacucaaaaaccugg

SEQ ID NO: 811 - RNA, 20 nt, Artificial Sequence
  Synthetic
aacugugucgauucuccacg

SEQ ID NO: 812 - RNA, 20 nt, Artificial Sequence
  Synthetic
cgauucuccacguggucucc

SEQ ID NO: 813 - RNA, 20 nt, Artificial Sequence
  Synthetic
gauucuccacguggucuccu

SEQ ID NO: 814 - RNA, 20 nt, Artificial Sequence
  Synthetic
ccacguggucuccugggugu

SEQ ID NO: 815 - RNA, 20 nt, Artificial Sequence
  Synthetic
cacguggucuccugggugua

SEQ ID NO: 816 - RNA, 20 nt, Artificial Sequence
  Synthetic
acguggucuccuggguguag

SEQ ID NO: 817 - RNA, 20 nt, Artificial Sequence
  Synthetic
ggucuccuggguguaggggu

SEQ ID NO: 818 - RNA, 20 nt, Artificial Sequence
  Synthetic
cuccuggguguagggguagg

SEQ ID NO: 819 - RNA, 20 nt, Artificial Sequence
  Synthetic
uccuggguguagggguaggu

SEQ ID NO: 820 - RNA, 20 nt, Artificial Sequence
  Synthetic
gguguagggguaggugggcu

SEQ ID NO: 821 - RNA, 20 nt, Artificial Sequence
  Synthetic
guguagggguaggugggcuu

SEQ ID NO: 822 - RNA, 20 nt, Artificial Sequence
  Synthetic
uguagggguaggugggcuug

SEQ ID NO: 823 - RNA, 20 nt, Artificial Sequence
  Synthetic
ucugcuguucucagcgugag

SEQ ID NO: 824 - RNA, 20 nt, Artificial Sequence
  Synthetic
caaacuaguucuccacaucc

SEQ ID NO: 825 - RNA, 20 nt, Artificial Sequence
  Synthetic
caaguuuucauuaauccaga

SEQ ID NO: 826 - RNA, 20 nt, Artificial Sequence
  Synthetic
uuaauccagaaggaugaaca

SEQ ID NO: 827 - RNA, 20 nt, Artificial Sequence
  Synthetic
uggucaccaucuaacuauuc

SEQ ID NO: 828 - RNA, 20 nt, Artificial Sequence
  Synthetic
uauucaggaauuguagucug

SEQ ID NO: 829 - RNA, 20 nt, Artificial Sequence
  Synthetic
auucaggaauuguagucuga

SEQ ID NO: 830 - RNA, 20 nt, Artificial Sequence
  Synthetic
uuaucuucugucagcauuua

SEQ ID NO: 831 - RNA, 20 nt, Artificial Sequence
  Synthetic
uaucuucugucagcauuuau

SEQ ID NO: 832 - RNA, 20 nt, Artificial Sequence
  Synthetic
guucaaguuuucuugugauu

SEQ ID NO: 833 - RNA, 20 nt, Artificial Sequence
  Synthetic
uucaaguuuucuugugauuu

SEQ ID NO: 834 - RNA, 20 nt, Artificial Sequence
  Synthetic
ucaaguuuucuugugauuug

SEQ ID NO: 835 - RNA, 20 nt, Artificial Sequence
  Synthetic
gauuuggggcaaaagcugua

SEQ ID NO: 836 - RNA, 20 nt, Artificial Sequence
  Synthetic
cauugcucuugcauguuaca

SEQ ID NO: 837 - RNA, 20 nt, Artificial Sequence
  Synthetic
auaaaaagcauaacuucuaa

SEQ ID NO: 838 - RNA, 20 nt, Artificial Sequence
  Synthetic
aggaagcagaauagcuccuc

SEQ ID NO: 839 - RNA, 20 nt, Artificial Sequence
  Synthetic
uaagaugcauuuacuacagu

SEQ ID NO: 840 - RNA, 20 nt, Artificial Sequence
  Synthetic
ugcuucagauagaauacagu

SEQ ID NO: 841 - RNA, 20 nt, Artificial Sequence
  Synthetic
gcuucagauagaauacaguu

SEQ ID NO: 842 - RNA, 20 nt, Artificial Sequence
  Synthetic
aauuuuauuucacaauguaa

SEQ ID NO: 843 - RNA, 20 nt, Artificial Sequence
  Synthetic
auuuuauuucacaauguaaa

SEQ ID NO: 844 - RNA, 20 nt, Artificial Sequence
  Synthetic
aucuuacuuauauucgaugc

SEQ ID NO: 845 - RNA, 20 nt, Artificial Sequence
  Synthetic
uuauauucgaugcuggccag

SEQ ID NO: 846 - RNA, 20 nt, Artificial Sequence
  Synthetic
agaaguuaugcuuuuuauug

SEQ ID NO: 847 - RNA, 20 nt, Artificial Sequence
  Synthetic
augcuuuuuauuguggcuug

SEQ ID NO: 848 - RNA, 20 nt, Artificial Sequence
  Synthetic
cauguaacaugcaagagcaa

SEQ ID NO: 849 - RNA, 20 nt, Artificial Sequence
  Synthetic
augcaagagcaaugguuuuc

SEQ ID NO: 850 - RNA, 20 nt, Artificial Sequence
  Synthetic
uaaaugcugacagaagauaa

SEQ ID NO: 851 - RNA, 20 nt, Artificial Sequence
  Synthetic
acaauuccugaauaguuaga

SEQ ID NO: 852 - RNA, 20 nt, Artificial Sequence
  Synthetic
ggugaccauguucauccuuc

SEQ ID NO: 853 - RNA, 20 nt, Artificial Sequence
  Synthetic
cuucuggauuaaugaaaacu

SEQ ID NO: 854 - RNA, 20 nt, Artificial Sequence
  Synthetic
ggaaagcagucaaagcugcc

SEQ ID NO: 855 - RNA, 20 nt, Artificial Sequence
  Synthetic
gaaagcagucaaagcugccu

SEQ ID NO: 856 - RNA, 17 nt, Artificial Sequence
  Synthetic
cugaauuuaccaggaug

SEQ ID NO: 857 - RNA, 17 nt, Artificial Sequence
  Synthetic
gauguggagaacuaguu

SEQ ID NO: 858 - RNA, 17 nt, Artificial Sequence
  Synthetic
auguggagaacuaguuu

SEQ ID NO: 859 - RNA, 17 nt, Artificial Sequence
  Synthetic
ggagaacuaguuugggu

SEQ ID NO: 860 - RNA, 17 nt, Artificial Sequence
  Synthetic
acagcagaaacaauuac

SEQ ID NO: 861 - RNA, 17 nt, Artificial Sequence
  Synthetic
acaauuacuggcaagua

SEQ ID NO: 862 - RNA, 17 nt, Artificial Sequence
  Synthetic
cuggcaaguauggugug

SEQ ID NO: 863 - RNA, 17 nt, Artificial Sequence
  Synthetic
caccuaccccuacaccc

SEQ ID NO: 864 - RNA, 17 nt, Artificial Sequence
  Synthetic
acacccaggagaccacg

SEQ ID NO: 865 - RNA, 17 nt, Artificial Sequence
  Synthetic
uggagaaucgacacagu

SEQ ID NO: 866 - RNA, 17 nt, Artificial Sequence
  Synthetic
aaucgacacaguuggca

SEQ ID NO: 867 - RNA, 17 nt, Artificial Sequence
  Synthetic
uggcacggauguccgcc

SEQ ID NO: 868 - RNA, 17 nt, Artificial Sequence
  Synthetic
caucagccaguuuaugc

SEQ ID NO: 869 - RNA, 17 nt, Artificial Sequence
  Synthetic
aucagccaguuuaugca

SEQ ID NO: 870 - RNA, 17 nt, Artificial Sequence
  Synthetic
gcagggcuacccuucua

SEQ ID NO: 871 - RNA, 17 nt, Artificial Sequence
  Synthetic
agguucacauacugccu

SEQ ID NO: 872 - RNA, 17 nt, Artificial Sequence
  Synthetic
cauacugccuaggccac

SEQ ID NO: 873 - RNA, 17 nt, Artificial Sequence
  Synthetic
uaggccacuggaaagca

SEQ ID NO: 874 - RNA, 17 nt, Artificial Sequence
  Synthetic
aggccacuggaaagcac

SEQ ID NO: 875 - RNA, 17 nt, Artificial Sequence
  Synthetic
ggaaagcacgggugcug

SEQ ID NO: 876 - RNA, 17 nt, Artificial Sequence
  Synthetic
gggugcugugguguacu

SEQ ID NO: 877 - RNA, 17 nt, Artificial Sequence
  Synthetic
ggugcugugguguacuc

SEQ ID NO: 878 - RNA, 17 nt, Artificial Sequence
  Synthetic
gugcugugguguacucg

SEQ ID NO: 879 - RNA, 17 nt, Artificial Sequence
  Synthetic
ggggagccucuauuucc

SEQ ID NO: 880 - RNA, 17 nt, Artificial Sequence
  Synthetic
gggagccucuauuucca

SEQ ID NO: 881 - RNA, 17 nt, Artificial Sequence
  Synthetic
gacaguucccguauucu

SEQ ID NO: 882 - RNA, 17 nt, Artificial Sequence
  Synthetic
acugaacccagagaauc

SEQ ID NO: 883 - RNA, 17 nt, Artificial Sequence
  Synthetic
uggaacucgaacaaacc

SEQ ID NO: 884 - RNA, 17 nt, Artificial Sequence
  Synthetic
ggaacucgaacaaaccu

SEQ ID NO: 885 - RNA, 17 nt, Artificial Sequence
  Synthetic
aaugccuucaucaucug

SEQ ID NO: 886 - RNA, 17 nt, Artificial Sequence
  Synthetic
gauugacuacaaccccc

SEQ ID NO: 887 - RNA, 17 nt, Artificial Sequence
  Synthetic
aagccuccaagcuguac

SEQ ID NO: 888 - RNA, 17 nt, Artificial Sequence
  Synthetic
ccaagcuguacaggcaa

SEQ ID NO: 889 - RNA, 17 nt, Artificial Sequence
  Synthetic
guacaggcaauggcaga

SEQ ID NO: 890 - RNA, 17 nt, Artificial Sequence
  Synthetic
ggcagaaggagaugcuc

SEQ ID NO: 891 - RNA, 17 nt, Artificial Sequence
  Synthetic
gcagaaggagaugcuca

SEQ ID NO: 892 - RNA, 17 nt, Artificial Sequence
  Synthetic
gagaugcucagggcucc

SEQ ID NO: 893 - RNA, 17 nt, Artificial Sequence
  Synthetic
agaugcucagggcuccu

SEQ ID NO: 894 - RNA, 17 nt, Artificial Sequence
  Synthetic
gaugcucagggcuccug

SEQ ID NO: 895 - RNA, 17 nt, Artificial Sequence
  Synthetic
augcucagggcuccugg

SEQ ID NO: 896 - RNA, 17 nt, Artificial Sequence
  Synthetic
ugcucagggcuccuggg

SEQ ID NO: 897 - RNA, 17 nt, Artificial Sequence
  Synthetic
gggcuccuggggggagc

SEQ ID NO: 898 - RNA, 17 nt, Artificial Sequence
  Synthetic
uggggggagcaggcuga

SEQ ID NO: 899 - RNA, 17 nt, Artificial Sequence
  Synthetic
ggggggagcaggcugaa

SEQ ID NO: 900 - RNA, 17 nt, Artificial Sequence
  Synthetic
gggagagccagccagcc

SEQ ID NO: 901 - RNA, 17 nt, Artificial Sequence
  Synthetic
ggagagccagccagcca

SEQ ID NO: 902 - RNA, 17 nt, Artificial Sequence
  Synthetic
ccagccagccagggccc

SEQ ID NO: 903 - RNA, 17 nt, Artificial Sequence
  Synthetic
ccugggcccuggcuggc

SEQ ID NO: 904 - RNA, 17 nt, Artificial Sequence
  Synthetic
uucagccugcucccccc

SEQ ID NO: 905 - RNA, 17 nt, Artificial Sequence
  Synthetic
ccauugccuguacagcu

SEQ ID NO: 906 - RNA, 17 nt, Artificial Sequence
  Synthetic
uugccuguacagcuugg

SEQ ID NO: 907 - RNA, 17 nt, Artificial Sequence
  Synthetic
gacgguagcaucugcug

SEQ ID NO: 908 - RNA, 17 nt, Artificial Sequence
  Synthetic
ugagguguagcugcuga

SEQ ID NO: 909 - RNA, 17 nt, Artificial Sequence
  Synthetic
gcugcugacgguguaca

SEQ ID NO: 910 - RNA, 17 nt, Artificial Sequence
  Synthetic
ggugccacagaugauga

SEQ ID NO: 911 - RNA, 17 nt, Artificial Sequence
  Synthetic
acagaugaugaaggcau

SEQ ID NO: 912 - RNA, 17 nt, Artificial Sequence
  Synthetic
uggcgacugacugcuua

SEQ ID NO: 913 - RNA, 17 nt, Artificial Sequence
  Synthetic
acggauguuugucuccc

SEQ ID NO: 914 - RNA, 17 nt, Artificial Sequence
  Synthetic
ucgaguuccagauucuc

SEQ ID NO: 915 - RNA, 17 nt, Artificial Sequence
  Synthetic
cgaguuccagauucucu

SEQ ID NO: 916 - RNA, 17 nt, Artificial Sequence
  Synthetic
auucucuggguucaguu

SEQ ID NO: 917 - RNA, 17 nt, Artificial Sequence
  Synthetic
cuggguucaguuuggag

SEQ ID NO: 918 - RNA, 17 nt, Artificial Sequence
  Synthetic
caguuuggagaggacaa

SEQ ID NO: 919 - RNA, 17 nt, Artificial Sequence
  Synthetic
gaggacaauggcaccuu

SEQ ID NO: 920 - RNA, 17 nt, Artificial Sequence
  Synthetic
aauacgggaacuguccg

SEQ ID NO: 921 - RNA, 17 nt, Artificial Sequence
  Synthetic
uucuggacucagcgccc

SEQ ID NO: 922 - RNA, 17 nt, Artificial Sequence
  Synthetic
cagcgcccuggaaauag

SEQ ID NO: 923 - RNA, 17 nt, Artificial Sequence
  Synthetic
gcacccgugcuuuccag

SEQ ID NO: 924 - RNA, 17 nt, Artificial Sequence
  Synthetic
gugcuuuccaguggccu

SEQ ID NO: 925 - RNA, 17 nt, Artificial Sequence
  Synthetic
aguaugugaaccuuaga

SEQ ID NO: 926 - RNA, 17 nt, Artificial Sequence
  Synthetic
guaugugaaccuuagaa

SEQ ID NO: 927 - RNA, 17 nt, Artificial Sequence
  Synthetic
gguagcccugcauaaac

SEQ ID NO: 928 - RNA, 17 nt, Artificial Sequence
  Synthetic
gcauaaacuggcugaug

SEQ ID NO: 929 - RNA, 17 nt, Artificial Sequence
  Synthetic
ggucauacucaaaaacc

SEQ ID NO: 930 - RNA, 17 nt, Artificial Sequence
  Synthetic
cauacucaaaaaccugg

SEQ ID NO: 931 - RNA, 17 nt, Artificial Sequence
  Synthetic
ugugucgauucuccacg

SEQ ID NO: 932 - RNA, 17 nt, Artificial Sequence
  Synthetic
uucuccacguggucucc

SEQ ID NO: 933 - RNA, 17 nt, Artificial Sequence
  Synthetic
ucuccacguggucuccu

SEQ ID NO: 934 - RNA, 17 nt, Artificial Sequence
  Synthetic
cguggucuccugggugu

SEQ ID NO: 935 - RNA, 17 nt, Artificial Sequence
  Synthetic
guggucuccugggugua

SEQ ID NO: 936 - RNA, 17 nt, Artificial Sequence
  Synthetic
uggucuccuggguguag

SEQ ID NO: 937 - RNA, 17 nt, Artificial Sequence
  Synthetic
cuccuggguguaggggu

SEQ ID NO: 938 - RNA, 17 nt, Artificial Sequence
  Synthetic
cuggguguagggguagg

SEQ ID NO: 939 - RNA, 17 nt, Artificial Sequence
  Synthetic
uggguguagggguaggu

SEQ ID NO: 940 - RNA, 17 nt, Artificial Sequence
  Synthetic
guagggguaggugggcu

SEQ ID NO: 941 - RNA, 17 nt, Artificial Sequence
  Synthetic
uagggguaggugggcuu

SEQ ID NO: 942 - RNA, 17 nt, Artificial Sequence
  Synthetic
agggguaggugggcuug

SEQ ID NO: 943 - RNA, 17 nt, Artificial Sequence
  Synthetic
gcuguucucagcgugag

SEQ ID NO: 944 - RNA, 17 nt, Artificial Sequence
  Synthetic
acuaguucuccacaucc

SEQ ID NO: 945 - RNA, 17 nt, Artificial Sequence
  Synthetic
guuuucauuaauccaga

SEQ ID NO: 946 - RNA, 17 nt, Artificial Sequence
  Synthetic
auccagaaggaugaaca

SEQ ID NO: 947 - RNA, 17 nt, Artificial Sequence
  Synthetic
ucaccaucuaacuauuc

SEQ ID NO: 948 - RNA, 17 nt, Artificial Sequence
  Synthetic
ucaggaauuguagucug

SEQ ID NO: 949 - RNA, 17 nt, Artificial Sequence
  Synthetic
caggaauuguagucuga

SEQ ID NO: 950 - RNA, 17 nt, Artificial Sequence
  Synthetic
ucuucugucagcauuua

SEQ ID NO: 951 - RNA, 17 nt, Artificial Sequence
  Synthetic
cuucugucagcauuuau

SEQ ID NO: 952 - RNA, 17 nt, Artificial Sequence
  Synthetic
caaguuuucuugugauu

SEQ ID NO: 953 - RNA, 17 nt, Artificial Sequence
  Synthetic
aaguuuucuugugauuu

SEQ ID NO: 954 - RNA, 17 nt, Artificial Sequence
  Synthetic
aguuuucuugugauuug

SEQ ID NO: 955 - RNA, 17 nt, Artificial Sequence
  Synthetic
uuggggcaaaagcugua

SEQ ID NO: 956 - RNA, 17 nt, Artificial Sequence
  Synthetic
ugcucuugcauguuaca

SEQ ID NO: 957 - RNA, 17 nt, Artificial Sequence
  Synthetic
aaaagcauaacuucuaa

SEQ ID NO: 958 - RNA, 17 nt, Artificial Sequence
  Synthetic
aagcagaauagcuccuc

SEQ ID NO: 959 - RNA, 17 nt, Artificial Sequence
  Synthetic
gaugcauuuacuacagu

SEQ ID NO: 960 - RNA, 17 nt, Artificial Sequence
  Synthetic
uucagauagaauacagu

SEQ ID NO: 961 - RNA, 17 nt, Artificial Sequence
  Synthetic
ucagauagaauacaguu

SEQ ID NO: 962 - RNA, 17 nt, Artificial Sequence
  Synthetic
uuuauuucacaauguaa

SEQ ID NO: 963 - RNA, 17 nt, Artificial Sequence
  Synthetic
uuauuucacaauguaaa

SEQ ID NO: 964 - RNA, 17 nt, Artificial Sequence
  Synthetic
uuacuuauauucgaugc

SEQ ID NO: 965 - RNA, 17 nt, Artificial Sequence
  Synthetic
uauucgaugcuggccag

SEQ ID NO: 966 - RNA, 17 nt, Artificial Sequence
  Synthetic
aguuaugcuuuuuauug

SEQ ID NO: 967 - RNA, 17 nt, Artificial Sequence
  Synthetic
cuuuuuauuguggcuug

SEQ ID NO: 968 - RNA, 17 nt, Artificial Sequence
  Synthetic
guaacaugcaagagcaa

SEQ ID NO: 969 - RNA, 17 nt, Artificial Sequence
  Synthetic
caagagcaaugguuuuc

SEQ ID NO: 970 - RNA, 17 nt, Artificial Sequence
  Synthetic
augcugacagaagauaa

SEQ ID NO: 971 - RNA, 17 nt, Artificial Sequence
  Synthetic
auuccugaauaguuaga

SEQ ID NO: 972 - RNA, 17 nt, Artificial Sequence
  Synthetic
gaccauguucauccuuc

SEQ ID NO: 973 - RNA, 17 nt, Artificial Sequence
  Synthetic
cuggauuaaugaaaacu

SEQ ID NO: 974 - RNA, 17 nt, Artificial Sequence
  Synthetic
aagcagucaaagcugcc

SEQ ID NO: 975 - RNA, 17 nt, Artificial Sequence
  Synthetic
agcagucaaagcugccu

SEQ ID NO: 976 - RNA, 20 nt, Artificial Sequence
  Synthetic
gcugccuccaucgugcccgg

SEQ ID NO: 977 - RNA, 20 nt, Artificial Sequence
  Synthetic
gcuuggaagacucgggcuug

SEQ ID NO: 978 - RNA, 20 nt, Artificial Sequence
  Synthetic
ggcuuggaagacucgggcuu

SEQ ID NO: 979 - RNA, 20 nt, Artificial Sequence
  Synthetic
gggagcccugcaagcacccg

SEQ ID NO: 980 - RNA, 20 nt, Artificial Sequence
  Synthetic
ggggccuccgggcacgaugg

SEQ ID NO: 981 - RNA, 20 nt, Artificial Sequence
  Synthetic
gugcgcagcaucccuuaaca

SEQ ID NO: 982 - RNA, 17 nt, Artificial Sequence
  Synthetic
gaccccgggugcuugca

SEQ ID NO: 983 - RNA, 17 nt, Artificial Sequence
  Synthetic
gaggaaaccucugccgg

SEQ ID NO: 984 - RNA, 17 nt, Artificial Sequence
  Synthetic
gauaacaaaacaaccag

SEQ ID NO: 985 - RNA, 17 nt, Artificial Sequence
  Synthetic
gccuccaucgugcccgg

SEQ ID NO: 986 - RNA, 17 nt, Artificial Sequence
  Synthetic
gccuccgggcacgaugg

SEQ ID NO: 987 - RNA, 17 nt, Artificial Sequence
  Synthetic
gucaccuccacgaaggu

SEQ ID NO: 988 - RNA, 20 nt, Artificial Sequence
  Synthetic
gaaucuugcuggcagcguga

SEQ ID NO: 989 - RNA, 20 nt, Artificial Sequence
  Synthetic
gagauauaggaacuauuauu

SEQ ID NO: 990 - RNA, 20 nt, Artificial Sequence
  Synthetic
gccagcaaggccacccaucc

SEQ ID NO: 991 - RNA, 20 nt, Artificial Sequence
  Synthetic
ggagauauaggaacuauuau

SEQ ID NO: 992 - RNA, 20 nt, Artificial Sequence
  Synthetic
ggggagccagcccuucaugg

SEQ ID NO: 993 - RNA, 20 nt, Artificial Sequence
  Synthetic
gggguaugggugcauaaauu

SEQ ID NO: 994 - RNA, 20 nt, Artificial Sequence
  Synthetic
guaaaaccagguggagauau

SEQ ID NO: 995 - RNA, 20 nt, Artificial Sequence
  Synthetic
gugcugagaggugccuggau

SEQ ID NO: 996 - RNA, 17 nt, Artificial Sequence
  Synthetic
gaacuauuauuggggua

SEQ ID NO: 997 - RNA, 17 nt, Artificial Sequence
  Synthetic
gagagguuuauauauac

SEQ ID NO: 998 - RNA, 17 nt, Artificial Sequence
  Synthetic
guauauauaaaccucuc

SEQ ID NO: 999 - RNA, 17 nt, Artificial Sequence
  Synthetic
guaugggugcauaaauu

SEQ ID NO: 1000 - RNA, 17 nt, Artificial Sequence
  Synthetic
guccuuuaagacguagc

SEQ ID NO: 1001 - RNA, 17 nt, Artificial Sequence
  Synthetic
gucuuaaaggacuuguu

SEQ ID NO: 1002 - RNA, 17 nt, Artificial Sequence
  Synthetic
gugugcugauuucaaca

SEQ ID NO: 1003 - RNA, 20 nt, Artificial Sequence
  Synthetic
gacucgggcuugggggccuc

SEQ ID NO: 1004 - RNA, 20 nt, Artificial Sequence
  Synthetic
gacugauggaggaggaggcu

SEQ ID NO: 1005 - RNA, 20 nt, Artificial Sequence
  Synthetic
gagguuuccucuccagcugg

SEQ ID NO: 1006 - RNA, 20 nt, Artificial Sequence
  Synthetic
gcagagguuuccucuccagc

SEQ ID NO: 1007 - RNA, 20 nt, Artificial Sequence
  Synthetic
gcagguugcucaggacaccc

SEQ ID NO: 1008 - RNA, 20 nt, Artificial Sequence
  Synthetic
gccagacaccagagacaaaa

SEQ ID NO: 1009 - RNA, 20 nt, Artificial Sequence
  Synthetic
gcucaggacacccaggaccc

SEQ ID NO: 1010 - RNA, 20 nt, Artificial Sequence
  Synthetic
gcuggagaggaaaccucugc

SEQ ID NO: 1011 - RNA, 20 nt, Artificial Sequence
  Synthetic
gcugugacugauggaggagg

SEQ ID NO: 1012 - RNA, 20 nt, Artificial Sequence
  Synthetic
gcuugcagggcucccccagc

SEQ ID NO: 1013 - RNA, 20 nt, Artificial Sequence
  Synthetic
ggagaggaaaccucugccgg

SEQ ID NO: 1014 - RNA, 20 nt, Artificial Sequence
  Synthetic
ggaggaggcuuggaagacuc

SEQ ID NO: 1015 - RNA, 20 nt, Artificial Sequence
  Synthetic
ggaggcagcagggggcgcua

SEQ ID NO: 1016 - RNA, 20 nt, Artificial Sequence
  Synthetic
ggcacgauggaggcagcagg

SEQ ID NO: 1017 - RNA, 20 nt, Artificial Sequence
  Synthetic
ggcagcagggggcgcuaggg

SEQ ID NO: 1018 - RNA, 20 nt, Artificial Sequence
  Synthetic
gggcacgauggaggcagcag

SEQ ID NO: 1019 - RNA, 20 nt, Artificial Sequence
  Synthetic
ggggagcccugcaagcaccc

SEQ ID NO: 1020 - RNA, 20 nt, Artificial Sequence
  Synthetic
gggggagcccugcaagcacc

SEQ ID NO: 1021 - RNA, 20 nt, Artificial Sequence
  Synthetic
guggaggugacaguuucuca

SEQ ID NO: 1022 - RNA, 17 nt, Artificial Sequence
  Synthetic
gacucguucauucaucc

SEQ ID NO: 1023 - RNA, 17 nt, Artificial Sequence
  Synthetic
gagaggaaaccucugcc

SEQ ID NO: 1024 - RNA, 17 nt, Artificial Sequence
  Synthetic
gagcccugcaagcaccc

SEQ ID NO: 1025 - RNA, 17 nt, Artificial Sequence
  Synthetic
gaggugacaguuucuca

SEQ ID NO: 1026 - RNA, 17 nt, Artificial Sequence
  Synthetic
gagguuuccucuccagc

SEQ ID NO: 1027 - RNA, 17 nt, Artificial Sequence
  Synthetic
gcaagcacccggggucc

SEQ ID NO: 1028 - RNA, 17 nt, Artificial Sequence
  Synthetic
gcacgauggaggcagca

SEQ ID NO: 1029 - RNA, 17 nt, Artificial Sequence
  Synthetic
gcucaccauuuugucuc

SEQ ID NO: 1030 - RNA, 17 nt, Artificial Sequence
  Synthetic
gcugccuccaucgugcc

SEQ ID NO: 1031 - RNA, 17 nt, Artificial Sequence
  Synthetic
gcugugacugauggagg

SEQ ID NO: 1032 - RNA, 17 nt, Artificial Sequence
  Synthetic
ggaagacucgggcuugg

SEQ ID NO: 1033 - RNA, 17 nt, Artificial Sequence
  Synthetic
ggaccccgggugcuugc

SEQ ID NO: 1034 - RNA, 17 nt, Artificial Sequence
  Synthetic
ggagaggaaaccucugc

SEQ ID NO: 1035 - RNA, 17 nt, Artificial Sequence
  Synthetic
ggagcccugcaagcacc

SEQ ID NO: 1036 - RNA, 17 nt, Artificial Sequence
  Synthetic
ggaggcuuggaagacuc

SEQ ID NO: 1037 - RNA, 17 nt, Artificial Sequence
  Synthetic
ggagguggccuuguuaa

SEQ ID NO: 1038 - RNA, 17 nt, Artificial Sequence
  Synthetic
ggcacgauggaggcagc

SEQ ID NO: 1039 - RNA, 17 nt, Artificial Sequence
  Synthetic
ggcagcagggggcgcua

SEQ ID NO: 1040 - RNA, 17 nt, Artificial Sequence
  Synthetic
ggcucccccagcuggag

SEQ ID NO: 1041 - RNA, 17 nt, Artificial Sequence
  Synthetic
gggagguggccuuguua

SEQ ID NO: 1042 - RNA, 17 nt, Artificial Sequence
  Synthetic
gggcuggcagguugcuc

SEQ ID NO: 1043 - RNA, 17 nt, Artificial Sequence
  Synthetic
ggggccuccgggcacga

SEQ ID NO: 1044 - RNA, 17 nt, Artificial Sequence
  Synthetic
gguugcucaggacaccc

SEQ ID NO: 1045 - RNA, 17 nt, Artificial Sequence
  Synthetic
gguuuccucuccagcug

SEQ ID NO: 1046 - RNA, 17 nt, Artificial Sequence
  Synthetic
gugacugauggaggagg

SEQ ID NO: 1047 - RNA, 17 nt, Artificial Sequence
  Synthetic
guuuccucuccagcugg

SEQ ID NO: 1048 - RNA, 20 nt, Artificial Sequence
  Synthetic
gaaagcucugcugugcugag

SEQ ID NO: 1049 - RNA, 20 nt, Artificial Sequence
  Synthetic
gccuggauggguggccuugc

SEQ ID NO: 1050 - RNA, 20 nt, Artificial Sequence
  Synthetic
gcuggguggggcugugcaca

SEQ ID NO: 1051 - RNA, 20 nt, Artificial Sequence
  Synthetic
ggcuggguggggcugugcac

SEQ ID NO: 1052 - RNA, 20 nt, Artificial Sequence
  Synthetic
ggguggggcugugcacaggg

SEQ ID NO: 1053 - RNA, 20 nt, Artificial Sequence
  Synthetic
gguggccacgugaggcuggg

SEQ ID NO: 1054 - RNA, 20 nt, Artificial Sequence
  Synthetic
guggccacgugaggcugggu

SEQ ID NO: 1055 - RNA, 20 nt, Artificial Sequence
  Synthetic
guguguguguguguaaaacc

SEQ ID NO: 1056 - RNA, 17 nt, Artificial Sequence
  Synthetic
gagccagcccuucaugg

SEQ ID NO: 1057 - RNA, 17 nt, Artificial Sequence
  Synthetic
gagguuuauauauacug

SEQ ID NO: 1058 - RNA, 17 nt, Artificial Sequence
  Synthetic
gauauaggaacuauuau

SEQ ID NO: 1059 - RNA, 17 nt, Artificial Sequence
  Synthetic
gccacgugaggcugggu

SEQ ID NO: 1060 - RNA, 17 nt, Artificial Sequence
  Synthetic
gcugagaggugccugga

SEQ ID NO: 1061 - RNA, 17 nt, Artificial Sequence
  Synthetic
ggagccagcccuucaug

SEQ ID NO: 1062 - RNA, 17 nt, Artificial Sequence
  Synthetic
ggcacuaugcuaggaac

SEQ ID NO: 1063 - RNA, 17 nt, Artificial Sequence
  Synthetic
ggccacgugaggcuggg

SEQ ID NO: 1064 - RNA, 17 nt, Artificial Sequence
  Synthetic
gggagccagcccuucau

SEQ ID NO: 1065 - RNA, 17 nt, Artificial Sequence
  Synthetic
ggggagccagcccuuca

SEQ ID NO: 1066 - RNA, 17 nt, Artificial Sequence
  Synthetic
ggguggggcugugcaca

SEQ ID NO: 1067 - RNA, 17 nt, Artificial Sequence
  Synthetic
gguaugggugcauaaau

SEQ ID NO: 1068 - RNA, 17 nt, Artificial Sequence
  Synthetic
gguggccacgugaggcu

SEQ ID NO: 1069 - RNA, 17 nt, Artificial Sequence
  Synthetic
gguggggcugugcacag

SEQ ID NO: 1070 - RNA, 17 nt, Artificial Sequence
  Synthetic
guacacacacuuacacc

SEQ ID NO: 1071 - RNA, 17 nt, Artificial Sequence
  Synthetic
gugccaggcacuaugcu

SEQ ID NO: 1072 - RNA, 17 nt, Artificial Sequence
  Synthetic
guggggcugugcacagg

SEQ ID NO: 1073 - RNA, 17 nt, Artificial Sequence
  Synthetic
guguguguaaaaccagg

SEQ ID NO: 1074 - RNA, 17 nt, Artificial Sequence
  Synthetic
guuccuagcauagugcc

SEQ ID NO: 1075 - RNA, 17 nt, Artificial Sequence
  Synthetic
guuccuauaucuccacc

SEQ ID NO: 1076 - RNA, 20 nt, Artificial Sequence
  Synthetic
aaacaaccaguggcacgggc

SEQ ID NO: 1077 - RNA, 20 nt, Artificial Sequence
  Synthetic
aacaaaacaaccaguggcac

SEQ ID NO: 1078 - RNA, 20 nt, Artificial Sequence
  Synthetic
aaccaguggcacgggcuggc

SEQ ID NO: 1079 - RNA, 20 nt, Artificial Sequence
  Synthetic
aaccugccagcccgugccac

SEQ ID NO: 1080 - RNA, 20 nt, Artificial Sequence
  Synthetic
acacagaaauagaaagcaac

SEQ ID NO: 1081 - RNA, 20 nt, Artificial Sequence
  Synthetic
accauuuugucucugguguc

SEQ ID NO: 1082 - RNA, 20 nt, Artificial Sequence
  Synthetic
acucgggcuugggggccucc

SEQ ID NO: 1083 - RNA, 20 nt, Artificial Sequence
  Synthetic
acugucaccuccacgaaggu

SEQ ID NO: 1084 - RNA, 20 nt, Artificial Sequence
  Synthetic
agaaacugucaccuccacga

SEQ ID NO: 1085 - RNA, 20 nt, Artificial Sequence
  Synthetic
agagguuuccucuccagcug

SEQ ID NO: 1086 - RNA, 20 nt, Artificial Sequence
  Synthetic
agcacuggguuuaaguuggc

SEQ ID NO: 1087 - RNA, 20 nt, Artificial Sequence
  Synthetic
agcagggggcgcuagggagg

SEQ ID NO: 1088 - RNA, 20 nt, Artificial Sequence
  Synthetic
agcgcugugacugauggagg

SEQ ID NO: 1089 - RNA, 20 nt, Artificial Sequence
  Synthetic
agcugcagcgcugugacuga

SEQ ID NO: 1090 - RNA, 20 nt, Artificial Sequence
  Synthetic
aggaggaggcuuggaagacu

SEQ ID NO: 1091 - RNA, 20 nt, Artificial Sequence
  Synthetic
aggcuuggaagacucgggcu

SEQ ID NO: 1092 - RNA, 20 nt, Artificial Sequence
  Synthetic
agugauaacaaaacaaccag

SEQ ID NO: 1093 - RNA, 20 nt, Artificial Sequence
  Synthetic
auaaauugucaaugaaugcc

SEQ ID NO: 1094 - RNA, 20 nt, Artificial Sequence
  Synthetic
aucagucacagcgcugcagc

SEQ ID NO: 1095 - RNA, 20 nt, Artificial Sequence
  Synthetic
auuuccuuucuuucagcacu

SEQ ID NO: 1096 - RNA, 20 nt, Artificial Sequence
  Synthetic
cacgggcuggcagguugcuc

SEQ ID NO: 1097 - RNA, 20 nt, Artificial Sequence
  Synthetic
cagagguuuccucuccagcu

SEQ ID NO: 1098 - RNA, 20 nt, Artificial Sequence
  Synthetic
caggaccccgggugcuugca

SEQ ID NO: 1099 - RNA, 20 nt, Artificial Sequence
  Synthetic
cagggcucccccagcuggag

SEQ ID NO: 1100 - RNA, 20 nt, Artificial Sequence
  Synthetic
cagucacugcccuaccuucg

SEQ ID NO: 1101 - RNA, 20 nt, Artificial Sequence
  Synthetic
ccaggaccccgggugcuugc

SEQ ID NO: 1102 - RNA, 20 nt, Artificial Sequence
  Synthetic
ccgggcacgauggaggcagc

SEQ ID NO: 1103 - RNA, 20 nt, Artificial Sequence
  Synthetic
ccugcaagcacccggggucc

SEQ ID NO: 1104 - RNA, 20 nt, Artificial Sequence
  Synthetic
ccugcugccuccaucgugcc

SEQ ID NO: 1105 - RNA, 20 nt, Artificial Sequence
  Synthetic
cgggcacgauggaggcagca

SEQ ID NO: 1106 - RNA, 20 nt, Artificial Sequence
  Synthetic
cuagggagguggccuuguua

SEQ ID NO: 1107 - RNA, 20 nt, Artificial Sequence
  Synthetic
cucaggacacccaggacccc

SEQ ID NO: 1108 - RNA, 20 nt, Artificial Sequence
  Synthetic
cugcaagcacccgggguccu

SEQ ID NO: 1109 - RNA, 20 nt, Artificial Sequence
  Synthetic
cugcgcacaauucuucaaga

SEQ ID NO: 1110 - RNA, 20 nt, Artificial Sequence
  Synthetic
cuggagaggaaaccucugcc

SEQ ID NO: 1111 - RNA, 20 nt, Artificial Sequence
  Synthetic
cugucaccuccacgaaggua

SEQ ID NO: 1112 - RNA, 20 nt, Artificial Sequence
  Synthetic
cuuggaagacucgggcuugg

SEQ ID NO: 1113 - RNA, 20 nt, Artificial Sequence
  Synthetic
uaaacccagugcugaaagaa

SEQ ID NO: 1114 - RNA, 20 nt, Artificial Sequence
  Synthetic
uaacaaaacaaccaguggca

SEQ ID NO: 1115 - RNA, 20 nt, Artificial Sequence
  Synthetic
uagggagguggccuuguuaa

SEQ ID NO: 1116 - RNA, 20 nt, Artificial Sequence
  Synthetic
uauuuccuuucuuucagcac

SEQ ID NO: 1117 - RNA, 20 nt, Artificial Sequence
  Synthetic
ucacugcccuaccuucgugg

SEQ ID NO: 1118 - RNA, 20 nt, Artificial Sequence
  Synthetic
ugcagcgcugugacugaugg

SEQ ID NO: 1119 - RNA, 20 nt, Artificial Sequence
  Synthetic
uggagaggaaaccucugccg

SEQ ID NO: 1120 - RNA, 20 nt, Artificial Sequence
  Synthetic
uggaggcagcagggggcgcu

SEQ ID NO: 1121 - RNA, 20 nt, Artificial Sequence
  Synthetic
ugugacucguucauucaucc

SEQ ID NO: 1122 - RNA, 20 nt, Artificial Sequence
  Synthetic
uguuuuguuaucacucucua

SEQ ID NO: 1123 - RNA, 20 nt, Artificial Sequence
  Synthetic
uugggggccuccgggcacga

SEQ ID NO: 1124 - RNA, 20 nt, Artificial Sequence
  Synthetic
uuguuuuguuaucacucucu

SEQ ID NO: 1125 - RNA, 20 nt, Artificial Sequence
  Synthetic
uuucagcacuggguuuaagu

SEQ ID NO: 1126 - RNA, 20 nt, Artificial Sequence
  Synthetic
uuugcucaccauuuugucuc

SEQ ID NO: 1127 - RNA, 17 nt, Artificial Sequence
  Synthetic
aaaacaaccaguggcac

SEQ ID NO: 1128 - RNA, 17 nt, Artificial Sequence
  Synthetic
aacugucaccuccacga

SEQ ID NO: 1129 - RNA, 17 nt, Artificial Sequence
  Synthetic
aauugucaaugaaugcc

SEQ ID NO: 1130 - RNA, 17 nt, Artificial Sequence
  Synthetic
acccagugcugaaagaa

SEQ ID NO: 1131 - RNA, 17 nt, Artificial Sequence
  Synthetic
acgauggaggcagcagg

SEQ ID NO: 1132 - RNA, 17 nt, Artificial Sequence
  Synthetic
acuggguuuaaguuggc

SEQ ID NO: 1133 - RNA, 17 nt, Artificial Sequence
  Synthetic
agacaccagagacaaaa

SEQ ID NO: 1134 - RNA, 17 nt, Artificial Sequence
  Synthetic
agaggaaaccucugccg

SEQ ID NO: 1135 - RNA, 17 nt, Artificial Sequence
  Synthetic
agcagggggcgcuaggg

SEQ ID NO: 1136 - RNA, 17 nt, Artificial Sequence
  Synthetic
agcccugcaagcacccg

SEQ ID NO: 1137 - RNA, 17 nt, Artificial Sequence
  Synthetic
agcgcugugacugaugg

SEQ ID NO: 1138 - RNA, 17 nt, Artificial Sequence
  Synthetic
aggacacccaggacccc

SEQ ID NO: 1139 - RNA, 17 nt, Artificial Sequence
  Synthetic
aggaggcuuggaagacu

SEQ ID NO: 1140 - RNA, 17 nt, Artificial Sequence
  Synthetic
aggcagcagggggcgcu

SEQ ID NO: 1141 - RNA, 17 nt, Artificial Sequence
  Synthetic
agggggcgcuagggagg

SEQ ID NO: 1142 - RNA, 17 nt, Artificial Sequence
  Synthetic
agguuuccucuccagcu

SEQ ID NO: 1143 - RNA, 17 nt, Artificial Sequence
  Synthetic
agucacagcgcugcagc

SEQ ID NO: 1144 - RNA, 17 nt, Artificial Sequence
  Synthetic
auuuugucucugguguc

SEQ ID NO: 1145 - RNA, 17 nt, Artificial Sequence
  Synthetic
caaaacaaccaguggca

SEQ ID NO: 1146 - RNA, 17 nt, Artificial Sequence
  Synthetic
caaccaguggcacgggc

SEQ ID NO: 1147 - RNA, 17 nt, Artificial Sequence
  Synthetic
caagcacccgggguccu

SEQ ID NO: 1148 - RNA, 17 nt, Artificial Sequence
  Synthetic
cacgauggaggcagcag

SEQ ID NO: 1149 - RNA, 17 nt, Artificial Sequence
  Synthetic
cagaaauagaaagcaac

SEQ ID NO: 1150 - RNA, 17 nt, Artificial Sequence
  Synthetic
cagcacuggguuuaagu

SEQ ID NO: 1151 - RNA, 17 nt, Artificial Sequence
  Synthetic
caggacacccaggaccc

SEQ ID NO: 1152 - RNA, 17 nt, Artificial Sequence
  Synthetic
caguggcacgggcuggc

SEQ ID NO: 1153 - RNA, 17 nt, Artificial Sequence
  Synthetic
cgcacaauucuucaaga

SEQ ID NO: 1154 - RNA, 17 nt, Artificial Sequence
  Synthetic
cgcagcaucccuuaaca

SEQ ID NO: 1155 - RNA, 17 nt, Artificial Sequence
  Synthetic
cgggcuugggggccucc

SEQ ID NO: 1156 - RNA, 17 nt, Artificial Sequence
  Synthetic
cugccagcccgugccac

SEQ ID NO: 1157 - RNA, 17 nt, Artificial Sequence
  Synthetic
cugcccuaccuucgugg

SEQ ID NO: 1158 - RNA, 17 nt, Artificial Sequence
  Synthetic
cuuggaagacucgggcu

SEQ ID NO: 1159 - RNA, 17 nt, Artificial Sequence
  Synthetic
ucaccuccacgaaggua

SEQ ID NO: 1160 - RNA, 17 nt, Artificial Sequence
  Synthetic
ucacugcccuaccuucg

SEQ ID NO: 1161 - RNA, 17 nt, Artificial Sequence
  Synthetic
uccuuucuuucagcacu

SEQ ID NO: 1162 - RNA, 17 nt, Artificial Sequence
  Synthetic
ucgggcuugggggccuc

SEQ ID NO: 1163 - RNA, 17 nt, Artificial Sequence
  Synthetic
ugauggaggaggaggcu

SEQ ID NO: 1164 - RNA, 17 nt, Artificial Sequence
  Synthetic
ugcagcgcugugacuga

SEQ ID NO: 1165 - RNA, 17 nt, Artificial Sequence
  Synthetic
ugcagggcucccccagc

SEQ ID NO: 1166 - RNA, 17 nt, Artificial Sequence
  Synthetic
uggaagacucgggcuug

SEQ ID NO: 1167 - RNA, 17 nt, Artificial Sequence
  Synthetic
uucacgggaagcgaggc

SEQ ID NO: 1168 - RNA, 17 nt, Artificial Sequence
  Synthetic
uuccuuucuuucagcac

SEQ ID NO: 1169 - RNA, 17 nt, Artificial Sequence
  Synthetic
uuggaagacucgggcuu

SEQ ID NO: 1170 - RNA, 17 nt, Artificial Sequence
  Synthetic
uuuguuaucacucucua

SEQ ID NO: 1171 - RNA, 17 nt, Artificial Sequence
  Synthetic
uuuuguuaucacucucu

SEQ ID NO: 1172 - RNA, 20 nt, Artificial Sequence
  Synthetic
aagacagagguggccacgug

SEQ ID NO: 1173 - RNA, 20 nt, Artificial Sequence
  Synthetic
aaguccuuuaagacguagca

SEQ ID NO: 1174 - RNA, 20 nt, Artificial Sequence
  Synthetic
aaucagcacaccaguagucc

SEQ ID NO: 1175 - RNA, 20 nt, Artificial Sequence
  Synthetic
accucugucuucccccauga

SEQ ID NO: 1176 - RNA, 20 nt, Artificial Sequence
  Synthetic
acuccaaacagacuucugga

SEQ ID NO: 1177 - RNA, 20 nt, Artificial Sequence
  Synthetic
acuggggagccagcccuuca

SEQ ID NO: 1178 - RNA, 20 nt, Artificial Sequence
  Synthetic
acugugccaggcacuaugcu

SEQ ID NO: 1179 - RNA, 20 nt, Artificial Sequence
  Synthetic
agaaacuccaaacagacuuc

SEQ ID NO: 1180 - RNA, 20 nt, Artificial Sequence
  Synthetic
agagagguuuauauauacug

SEQ ID NO: 1181 - RNA, 20 nt, Artificial Sequence
  Synthetic
agagguggccacgugaggcu

SEQ ID NO: 1182 - RNA, 20 nt, Artificial Sequence
  Synthetic
agauauaggaacuauuauug

SEQ ID NO: 1183 - RNA, 20 nt, Artificial Sequence
  Synthetic
agcucgggcaugagccagca

SEQ ID NO: 1184 - RNA, 20 nt, Artificial Sequence
  Synthetic
aggaacuauuauugggguau

SEQ ID NO: 1185 - RNA, 20 nt, Artificial Sequence
  Synthetic
auaguuccuauaucuccacc

SEQ ID NO: 1186 - RNA, 20 nt, Artificial Sequence
  Synthetic
auauaaaccucucuggagcu

SEQ ID NO: 1187 - RNA, 20 nt, Artificial Sequence
  Synthetic
caaguccuuuaagacguagc

SEQ ID NO: 1188 - RNA, 20 nt, Artificial Sequence
  Synthetic
caaugaguuugcagagugaa

SEQ ID NO: 1189 - RNA, 20 nt, Artificial Sequence
  Synthetic
cacacuuacaccaggacuac

SEQ ID NO: 1190 - RNA, 20 nt, Artificial Sequence
  Synthetic
cacguacacacacuuacacc

SEQ ID NO: 1191 - RNA, 20 nt, Artificial Sequence
  Synthetic
cagagagguuuauauauacu

SEQ ID NO: 1192 - RNA, 20 nt, Artificial Sequence
  Synthetic
cagagguggccacgugaggc

SEQ ID NO: 1193 - RNA, 20 nt, Artificial Sequence
  Synthetic
cagccccacccagccucacg

SEQ ID NO: 1194 - RNA, 20 nt, Artificial Sequence
  Synthetic
cauagugccuggcacagugc

SEQ ID NO: 1195 - RNA, 20 nt, Artificial Sequence
  Synthetic
ccagagagguuuauauauac

SEQ ID NO: 1196 - RNA, 20 nt, Artificial Sequence
  Synthetic
ccaggcacuaugcuaggaac

SEQ ID NO: 1197 - RNA, 20 nt, Artificial Sequence
  Synthetic
ccaguauauauaaaccucuc

SEQ ID NO: 1198 - RNA, 20 nt, Artificial Sequence
  Synthetic
ccaguuccuagcauagugcc

SEQ ID NO: 1199 - RNA, 20 nt, Artificial Sequence
  Synthetic
cccuucaugggggaagacag

SEQ ID NO: 1200 - RNA, 20 nt, Artificial Sequence
  Synthetic
ccucugucuucccccaugaa

SEQ ID NO: 1201 - RNA, 20 nt, Artificial Sequence
  Synthetic
cucaugcccgagcuccagag

SEQ ID NO: 1202 - RNA, 20 nt, Artificial Sequence
  Synthetic
cugagaggugccuggauggg

SEQ ID NO: 1203 - RNA, 20 nt, Artificial Sequence
  Synthetic
cugcugugcugagaggugcc

SEQ ID NO: 1204 - RNA, 20 nt, Artificial Sequence
  Synthetic
cuggggagccagcccuucau

SEQ ID NO: 1205 - RNA, 20 nt, Artificial Sequence
  Synthetic
cuggguggggcugugcacag

SEQ ID NO: 1206 - RNA, 20 nt, Artificial Sequence
  Synthetic
cuggugugcugauuucaaca

SEQ ID NO: 1207 - RNA, 20 nt, Artificial Sequence
  Synthetic
cugucccugcuacgucuuaa

SEQ ID NO: 1208 - RNA, 20 nt, Artificial Sequence
  Synthetic
uaaccuuccagaagucuguu

SEQ ID NO: 1209 - RNA, 20 nt, Artificial Sequence
  Synthetic
uacgucuuaaaggacuuguu

SEQ ID NO: 1210 - RNA, 20 nt, Artificial Sequence
  Synthetic
uaggaacuauuauuggggua

SEQ ID NO: 1211 - RNA, 20 nt, Artificial Sequence
  Synthetic
uauaaaccucucuggagcuc

SEQ ID NO: 1212 - RNA, 20 nt, Artificial Sequence
  Synthetic
uggccacgugaggcugggug

SEQ ID NO: 1213 - RNA, 20 nt, Artificial Sequence
  Synthetic
uggggagccagcccuucaug

SEQ ID NO: 1214 - RNA, 20 nt, Artificial Sequence
  Synthetic
ugggguaugggugcauaaau

SEQ ID NO: 1215 - RNA, 20 nt, Artificial Sequence
  Synthetic
uggguggggcugugcacagg

SEQ ID NO: 1216 - RNA, 20 nt, Artificial Sequence
  Synthetic
ugucuucccccaugaagggc

SEQ ID NO: 1217 - RNA, 20 nt, Artificial Sequence
  Synthetic
ugugcugagaggugccugga

SEQ ID NO: 1218 - RNA, 20 nt, Artificial Sequence
  Synthetic
uguguguguguaaaaccagg

SEQ ID NO: 1219 - RNA, 20 nt, Artificial Sequence
  Synthetic
uuauuuucuaagaaucuugc

SEQ ID NO: 1220 - RNA, 20 nt, Artificial Sequence
  Synthetic
uucaugggggaagacagagg

SEQ ID NO: 1221 - RNA, 20 nt, Artificial Sequence
  Synthetic
uugagaaccugcacugugcc

SEQ ID NO: 1222 - RNA, 17 nt, Artificial Sequence
  Synthetic
aaaccagguggagauau

SEQ ID NO: 1223 - RNA, 17 nt, Artificial Sequence
  Synthetic
aaaccucucuggagcuc

SEQ ID NO: 1224 - RNA, 17 nt, Artificial Sequence
  Synthetic
aacuauuauugggguau

SEQ ID NO: 1225 - RNA, 17 nt, Artificial Sequence
  Synthetic
aacuccaaacagacuuc

SEQ ID NO: 1226 - RNA, 17 nt, Artificial Sequence
  Synthetic
acagagguggccacgug

SEQ ID NO: 1227 - RNA, 17 nt, Artificial Sequence
  Synthetic
acuuacaccaggacuac

SEQ ID NO: 1228 - RNA, 17 nt, Artificial Sequence
  Synthetic
agaaccugcacugugcc

SEQ ID NO: 1229 - RNA, 17 nt, Artificial Sequence
  Synthetic
agaggugccuggauggg

SEQ ID NO: 1230 - RNA, 17 nt, Artificial Sequence
  Synthetic
agagguuuauauauacu

SEQ ID NO: 1231 - RNA, 17 nt, Artificial Sequence
  Synthetic
agcaaggccacccaucc

SEQ ID NO: 1232 - RNA, 17 nt, Artificial Sequence
  Synthetic
agcucugcugugcugag

SEQ ID NO: 1233 - RNA, 17 nt, Artificial Sequence
  Synthetic
agguggccacgugaggc

SEQ ID NO: 1234 - RNA, 17 nt, Artificial Sequence
  Synthetic
agugccuggcacagugc

SEQ ID NO: 1235 - RNA, 17 nt, Artificial Sequence
  Synthetic
auauaggaacuauuauu

SEQ ID NO: 1236 - RNA, 17 nt, Artificial Sequence
  Synthetic
augcccgagcuccagag

SEQ ID NO: 1237 - RNA, 17 nt, Artificial Sequence
  Synthetic
augggggaagacagagg

SEQ ID NO: 1238 - RNA, 17 nt, Artificial Sequence
  Synthetic
cagcacaccaguagucc

SEQ ID NO: 1239 - RNA, 17 nt, Artificial Sequence
  Synthetic
ccaaacagacuucugga

SEQ ID NO: 1240 - RNA, 17 nt, Artificial Sequence
  Synthetic
ccacgugaggcugggug

SEQ ID NO: 1241 - RNA, 17 nt, Artificial Sequence
  Synthetic
ccccacccagccucacg

SEQ ID NO: 1242 - RNA, 17 nt, Artificial Sequence
  Synthetic
ccuuccagaagucuguu

SEQ ID NO: 1243 - RNA, 17 nt, Artificial Sequence
  Synthetic
cugagaggugccuggau

SEQ ID NO: 1244 - RNA, 17 nt, Artificial Sequence
  Synthetic
cugucuucccccaugaa

SEQ ID NO: 1245 - RNA, 17 nt, Artificial Sequence
  Synthetic
cugugcugagaggugcc

SEQ ID NO: 1246 - RNA, 17 nt, Artificial Sequence
  Synthetic
cuucccccaugaagggc

SEQ ID NO: 1247 - RNA, 17 nt, Artificial Sequence
  Synthetic
uaaaccucucuggagcu

SEQ ID NO: 1248 - RNA, 17 nt, Artificial Sequence
  Synthetic
uauaggaacuauuauug

SEQ ID NO: 1249 - RNA, 17 nt, Artificial Sequence
  Synthetic
ucccugcuacgucuuaa

SEQ ID NO: 1250 - RNA, 17 nt, Artificial Sequence
  Synthetic
uccuuuaagacguagca

SEQ ID NO: 1251 - RNA, 17 nt, Artificial Sequence
  Synthetic
ucgggcaugagccagca

SEQ ID NO: 1252 - RNA, 17 nt, Artificial Sequence
  Synthetic
ucugucuucccccauga

SEQ ID NO: 1253 - RNA, 17 nt, Artificial Sequence
  Synthetic
ucuugcuggcagcguga

SEQ ID NO: 1254 - RNA, 17 nt, Artificial Sequence
  Synthetic
ugaguuugcagagugaa

SEQ ID NO: 1255 - RNA, 17 nt, Artificial Sequence
  Synthetic
uggauggguggccuugc

SEQ ID NO: 1256 - RNA, 17 nt, Artificial Sequence
  Synthetic
uggggcugugcacaggg

SEQ ID NO: 1257 - RNA, 17 nt, Artificial Sequence
  Synthetic
uggguggggcugugcac

SEQ ID NO: 1258 - RNA, 17 nt, Artificial Sequence
  Synthetic
uguguguguguaaaacc

SEQ ID NO: 1259 - RNA, 17 nt, Artificial Sequence
  Synthetic
uucaugggggaagacag

SEQ ID NO: 1260 - RNA, 17 nt, Artificial Sequence
  Synthetic
uuuucuaagaaucuugc

SEQ ID NO: 1261 - RNA, 20 nt, Artificial Sequence
  Synthetic
caucugagcuggagacuccu

SEQ ID NO: 1262 - RNA, 20 nt, Artificial Sequence
  Synthetic
gcuggagacuccuuggcucc

SEQ ID NO: 1263 - RNA, 20 nt, Artificial Sequence
  Synthetic
cuuggcuccaggcuccagaa

SEQ ID NO: 1264 - RNA, 20 nt, Artificial Sequence
  Synthetic
uccaggcuccagaaaggaaa

SEQ ID NO: 1265 - RNA, 20 nt, Artificial Sequence
  Synthetic
gcuccagaaaggaaauggag

SEQ ID NO: 1266 - RNA, 20 nt, Artificial Sequence
  Synthetic
cuccagaaaggaaauggaga

SEQ ID NO: 1267 - RNA, 20 nt, Artificial Sequence
  Synthetic
ggagagggaaacuagucuaa

SEQ ID NO: 1268 - RNA, 20 nt, Artificial Sequence
  Synthetic
aacuagucuaacggagaauc

SEQ ID NO: 1269 - RNA, 20 nt, Artificial Sequence
  Synthetic
uagucuaacggagaaucugg

SEQ ID NO: 1270 - RNA, 20 nt, Artificial Sequence
  Synthetic
agucuaacggagaaucugga

SEQ ID NO: 1271 - RNA, 20 nt, Artificial Sequence
  Synthetic
gucuaacggagaaucuggag

SEQ ID NO: 1272 - RNA, 20 nt, Artificial Sequence
  Synthetic
aggggacaguguuuccucag

SEQ ID NO: 1273 - RNA, 20 nt, Artificial Sequence
  Synthetic
ggggacaguguuuccucaga

SEQ ID NO: 1274 - RNA, 20 nt, Artificial Sequence
  Synthetic
caguguuuccucagagggaa

SEQ ID NO: 1275 - RNA, 20 nt, Artificial Sequence
  Synthetic
aguguuuccucagagggaaa

SEQ ID NO: 1276 - RNA, 20 nt, Artificial Sequence
  Synthetic
guguuuccucagagggaaag

SEQ ID NO: 1277 - RNA, 20 nt, Artificial Sequence
  Synthetic
ggaaaggggccuccacgucc

SEQ ID NO: 1278 - RNA, 20 nt, Artificial Sequence
  Synthetic
uccacguccaggagaauucc

SEQ ID NO: 1279 - RNA, 20 nt, Artificial Sequence
  Synthetic
acguccaggagaauuccagg

SEQ ID NO: 1280 - RNA, 20 nt, Artificial Sequence
  Synthetic
uccaggagaauuccaggagg

SEQ ID NO: 1281 - RNA, 20 nt, Artificial Sequence
  Synthetic
ccaggagaauuccaggaggu

SEQ ID NO: 1282 - RNA, 20 nt, Artificial Sequence
  Synthetic
caggagaauuccaggaggug

SEQ ID NO: 1283 - RNA, 20 nt, Artificial Sequence
  Synthetic
uuccaggagguggggacugc

SEQ ID NO: 1284 - RNA, 20 nt, Artificial Sequence
  Synthetic
uccaggagguggggacugca

SEQ ID NO: 1285 - RNA, 20 nt, Artificial Sequence
  Synthetic
gagguggggacugcagggag

SEQ ID NO: 1286 - RNA, 20 nt, Artificial Sequence
  Synthetic
agguggggacugcagggagu

SEQ ID NO: 1287 - RNA, 20 nt, Artificial Sequence
  Synthetic
gguggggacugcagggagug

SEQ ID NO: 1288 - RNA, 20 nt, Artificial Sequence
  Synthetic
acugcagggaguggggacgc

SEQ ID NO: 1289 - RNA, 20 nt, Artificial Sequence
  Synthetic
cugcagggaguggggacgcu

SEQ ID NO: 1290 - RNA, 20 nt, Artificial Sequence
  Synthetic
ugcagggaguggggacgcug

SEQ ID NO: 1291 - RNA, 20 nt, Artificial Sequence
  Synthetic
guggggacgcuggggcugag

SEQ ID NO: 1292 - RNA, 20 nt, Artificial Sequence
  Synthetic
uggggacgcuggggcugagc

SEQ ID NO: 1293 - RNA, 20 nt, Artificial Sequence
  Synthetic
ggggcugagcgggugcugaa

SEQ ID NO: 1294 - RNA, 20 nt, Artificial Sequence
  Synthetic
cugagcgggugcugaaaggc

SEQ ID NO: 1295 - RNA, 20 nt, Artificial Sequence
  Synthetic
gcgggugcugaaaggcagga

SEQ ID NO: 1296 - RNA, 20 nt, Artificial Sequence
  Synthetic
ugaaaggcaggaaggugaaa

SEQ ID NO: 1297 - RNA, 20 nt, Artificial Sequence
  Synthetic
gaaaggcaggaaggugaaaa

SEQ ID NO: 1298 - RNA, 20 nt, Artificial Sequence
  Synthetic
gcaggaaggugaaaagggca

SEQ ID NO: 1299 - RNA, 20 nt, Artificial Sequence
  Synthetic
cagauguucaguguuguuca

SEQ ID NO: 1300 - RNA, 20 nt, Artificial Sequence
  Synthetic
agauguucaguguuguucac

SEQ ID NO: 1301 - RNA, 20 nt, Artificial Sequence
  Synthetic
gauguucaguguuguucacg

SEQ ID NO: 1302 - RNA, 20 nt, Artificial Sequence
  Synthetic
uucaguguuguucacggggc

SEQ ID NO: 1303 - RNA, 20 nt, Artificial Sequence
  Synthetic
ucaguguuguucacggggcu

SEQ ID NO: 1304 - RNA, 20 nt, Artificial Sequence
  Synthetic
cuuuuuaucuuuucucugcu

SEQ ID NO: 1305 - RNA, 20 nt, Artificial Sequence
  Synthetic
uuuaucuuuucucugcuugg

SEQ ID NO: 1306 - RNA, 20 nt, Artificial Sequence
  Synthetic
agaagaagucuauuucauga

SEQ ID NO: 1307 - RNA, 20 nt, Artificial Sequence
  Synthetic
gaagaagucuauuucaugaa

SEQ ID NO: 1308 - RNA, 20 nt, Artificial Sequence
  Synthetic
aagucagcuguuaaaauucc

SEQ ID NO: 1309 - RNA, 20 nt, Artificial Sequence
  Synthetic
agucagcuguuaaaauucca

SEQ ID NO: 1310 - RNA, 20 nt, Artificial Sequence
  Synthetic
uuaaaauuccagggugugca

SEQ ID NO: 1311 - RNA, 20 nt, Artificial Sequence
  Synthetic
uaaaauuccagggugugcau

SEQ ID NO: 1312 - RNA, 20 nt, Artificial Sequence
  Synthetic
gcauggguuuuccuucacga

SEQ ID NO: 1313 - RNA, 20 nt, Artificial Sequence
  Synthetic
ucacgaaggccuuuauuuaa

SEQ ID NO: 1314 - RNA, 20 nt, Artificial Sequence
  Synthetic
cacgaaggccuuuauuuaau

SEQ ID NO: 1315 - RNA, 20 nt, Artificial Sequence
  Synthetic
ccuuuauuuaaugggaauau

SEQ ID NO: 1316 - RNA, 20 nt, Artificial Sequence
  Synthetic
aggaagcgagcucauuuccu

SEQ ID NO: 1317 - RNA, 20 nt, Artificial Sequence
  Synthetic
uuuccuaggccguuaauuca

SEQ ID NO: 1318 - RNA, 20 nt, Artificial Sequence
  Synthetic
uaauucacggaagaagugac

SEQ ID NO: 1319 - RNA, 20 nt, Artificial Sequence
  Synthetic
gucuuuucuuucaugucuuc

SEQ ID NO: 1320 - RNA, 20 nt, Artificial Sequence
  Synthetic
ucuuuucuuucaugucuucu

SEQ ID NO: 1321 - RNA, 20 nt, Artificial Sequence
  Synthetic
ugggcaacuacucagcccug

SEQ ID NO: 1322 - RNA, 20 nt, Artificial Sequence
  Synthetic
gcaacuacucagcccugugg

SEQ ID NO: 1323 - RNA, 20 nt, Artificial Sequence
  Synthetic
acucagcccugugguggacu

SEQ ID NO: 1324 - RNA, 20 nt, Artificial Sequence
  Synthetic
uggacuuggcuuaugcaaga

SEQ ID NO: 1325 - RNA, 20 nt, Artificial Sequence
  Synthetic
ugcaagacggucgaaaaccu

SEQ ID NO: 1326 - RNA, 20 nt, Artificial Sequence
  Synthetic
cggucgaaaaccuuggaauc

SEQ ID NO: 1327 - RNA, 20 nt, Artificial Sequence
  Synthetic
aaccuuggaaucaggagacu

SEQ ID NO: 1328 - RNA, 20 nt, Artificial Sequence
  Synthetic
aggagacucgguuuucuuuc

SEQ ID NO: 1329 - RNA, 20 nt, Artificial Sequence
  Synthetic
uuucuuucugguucugccau

SEQ ID NO: 1330 - RNA, 20 nt, Artificial Sequence
  Synthetic
uuucugguucugccauuggu

SEQ ID NO: 1331 - RNA, 20 nt, Artificial Sequence
  Synthetic
auugguuggcugugcgaccg

SEQ ID NO: 1332 - RNA, 20 nt, Artificial Sequence
  Synthetic
uugguuggcugugcgaccgu

SEQ ID NO: 1333 - RNA, 20 nt, Artificial Sequence
  Synthetic
ggcaagugucucuccuuccc

SEQ ID NO: 1334 - RNA, 20 nt, Artificial Sequence
  Synthetic
gcaagugucucuccuucccu

SEQ ID NO: 1335 - RNA, 20 nt, Artificial Sequence
  Synthetic
cuucccugugauucucugug

SEQ ID NO: 1336 - RNA, 20 nt, Artificial Sequence
  Synthetic
uucccugugauucucuguga

SEQ ID NO: 1337 - RNA, 20 nt, Artificial Sequence
  Synthetic
ucccugugauucucugugag

SEQ ID NO: 1338 - RNA, 20 nt, Artificial Sequence
  Synthetic
cccugugauucucugugagg

SEQ ID NO: 1339 - RNA, 20 nt, Artificial Sequence
  Synthetic
ccugugauucucugugaggg

SEQ ID NO: 1340 - RNA, 20 nt, Artificial Sequence
  Synthetic
cugugaggggggauguugag

SEQ ID NO: 1341 - RNA, 20 nt, Artificial Sequence
  Synthetic
ugugaggggggauguugaga

SEQ ID NO: 1342 - RNA, 20 nt, Artificial Sequence
  Synthetic
gugaggggggauguugagag

SEQ ID NO: 1343 - RNA, 20 nt, Artificial Sequence
  Synthetic
ggggggauguugagagggga

SEQ ID NO: 1344 - RNA, 20 nt, Artificial Sequence
  Synthetic
gggauguugagaggggaagg

SEQ ID NO: 1345 - RNA, 20 nt, Artificial Sequence
  Synthetic
agaggggaaggaggcagagc

SEQ ID NO: 1346 - RNA, 20 nt, Artificial Sequence
  Synthetic
agcuggagcagcugagccac

SEQ ID NO: 1347 - RNA, 20 nt, Artificial Sequence
  Synthetic
gcuggagcagcugagccaca

SEQ ID NO: 1348 - RNA, 20 nt, Artificial Sequence
  Synthetic
cuggagcagcugagccacag

SEQ ID NO: 1349 - RNA, 20 nt, Artificial Sequence
  Synthetic
gagcagcugagccacagggg

SEQ ID NO: 1350 - RNA, 20 nt, Artificial Sequence
  Synthetic
cagcugagccacaggggagg

SEQ ID NO: 1351 - RNA, 20 nt, Artificial Sequence
  Synthetic
cugagccacaggggaggugg

SEQ ID NO: 1352 - RNA, 20 nt, Artificial Sequence
  Synthetic
ugagccacaggggaggugga

SEQ ID NO: 1353 - RNA, 20 nt, Artificial Sequence
  Synthetic
gagccacaggggagguggag

SEQ ID NO: 1354 - RNA, 20 nt, Artificial Sequence
  Synthetic
agccacaggggagguggagg

SEQ ID NO: 1355 - RNA, 20 nt, Artificial Sequence
  Synthetic
caggggagguggagggggac

SEQ ID NO: 1356 - RNA, 20 nt, Artificial Sequence
  Synthetic
ggagguggagggggacagga

SEQ ID NO: 1357 - RNA, 20 nt, Artificial Sequence
  Synthetic
guggagggggacaggaaggc

SEQ ID NO: 1358 - RNA, 20 nt, Artificial Sequence
  Synthetic
acaggaaggcaggcagaagc

SEQ ID NO: 1359 - RNA, 20 nt, Artificial Sequence
  Synthetic
caggaaggcaggcagaagcu

SEQ ID NO: 1360 - RNA, 20 nt, Artificial Sequence
  Synthetic
cacugaucacgucagacucc

SEQ ID NO: 1361 - RNA, 20 nt, Artificial Sequence
  Synthetic
accgagagccacaaugcuuc

SEQ ID NO: 1362 - RNA, 20 nt, Artificial Sequence
  Synthetic
ccuucccuaagcauagacaa

SEQ ID NO: 1363 - RNA, 20 nt, Artificial Sequence
  Synthetic
aaaagaaugcagagacuaac

SEQ ID NO: 1364 - RNA, 20 nt, Artificial Sequence
  Synthetic
agaaugcagagacuaacugg

SEQ ID NO: 1365 - RNA, 20 nt, Artificial Sequence
  Synthetic
aacuggugguagcuuuugcc

SEQ ID NO: 1366 - RNA, 20 nt, Artificial Sequence
  Synthetic
uuugccuggcauucaaaaac

SEQ ID NO: 1367 - RNA, 20 nt, Artificial Sequence
  Synthetic
uugccuggcauucaaaaacu

SEQ ID NO: 1368 - RNA, 20 nt, Artificial Sequence
  Synthetic
aaaaacugggccagagcaag

SEQ ID NO: 1369 - RNA, 20 nt, Artificial Sequence
  Synthetic
cuggcauuuuccacuugcuc

SEQ ID NO: 1370 - RNA, 20 nt, Artificial Sequence
  Synthetic
uggcccaguuuuugaaugcc

SEQ ID NO: 1371 - RNA, 20 nt, Artificial Sequence
  Synthetic
guuagucucugcauucuuuu

SEQ ID NO: 1372 - RNA, 20 nt, Artificial Sequence
  Synthetic
ucugcauucuuuuugguuau

SEQ ID NO: 1373 - RNA, 20 nt, Artificial Sequence
  Synthetic
aaaugccauugucuaugcuu

SEQ ID NO: 1374 - RNA, 20 nt, Artificial Sequence
  Synthetic
aaugccauugucuaugcuua

SEQ ID NO: 1375 - RNA, 20 nt, Artificial Sequence
  Synthetic
ccauugucuaugcuuaggga

SEQ ID NO: 1376 - RNA, 20 nt, Artificial Sequence
  Synthetic
augcuuagggaaggaaaaug

SEQ ID NO: 1377 - RNA, 20 nt, Artificial Sequence
  Synthetic
gggaaggaaaauguggcugu

SEQ ID NO: 1378 - RNA, 20 nt, Artificial Sequence
  Synthetic
ggaaggaaaauguggcuguu

SEQ ID NO: 1379 - RNA, 20 nt, Artificial Sequence
  Synthetic
ugagcuuuccugaagcauug

SEQ ID NO: 1380 - RNA, 20 nt, Artificial Sequence
  Synthetic
uccugaagcauuguggcucu

SEQ ID NO: 1381 - RNA, 20 nt, Artificial Sequence
  Synthetic
agcauuguggcucucggucc

SEQ ID NO: 1382 - RNA, 20 nt, Artificial Sequence
  Synthetic
ggagucugacgugaucagug

SEQ ID NO: 1383 - RNA, 20 nt, Artificial Sequence
  Synthetic
acgugaucagugaggacuga

SEQ ID NO: 1384 - RNA, 20 nt, Artificial Sequence
  Synthetic
gucccccuccaccuccccug

SEQ ID NO: 1385 - RNA, 20 nt, Artificial Sequence
  Synthetic
ccccccucacagagaaucac

SEQ ID NO: 1386 - RNA, 20 nt, Artificial Sequence
  Synthetic
cccccucacagagaaucaca

SEQ ID NO: 1387 - RNA, 20 nt, Artificial Sequence
  Synthetic
cacagaacacgagagcugca

SEQ ID NO: 1388 - RNA, 20 nt, Artificial Sequence
  Synthetic
acagaacacgagagcugcaa

SEQ ID NO: 1389 - RNA, 20 nt, Artificial Sequence
  Synthetic
cuuuauagcagagaagacua

SEQ ID NO: 1390 - RNA, 20 nt, Artificial Sequence
  Synthetic
agcagagaagacuauggccc

SEQ ID NO: 1391 - RNA, 20 nt, Artificial Sequence
  Synthetic
gcagagaagacuauggccca

SEQ ID NO: 1392 - RNA, 20 nt, Artificial Sequence
  Synthetic
agaagacuauggcccaggga

SEQ ID NO: 1393 - RNA, 20 nt, Artificial Sequence
  Synthetic
gaaggagagacacuugccca

SEQ ID NO: 1394 - RNA, 20 nt, Artificial Sequence
  Synthetic
acggucgcacagccaaccaa

SEQ ID NO: 1395 - RNA, 20 nt, Artificial Sequence
  Synthetic
aaccgagucuccugauucca

SEQ ID NO: 1396 - RNA, 20 nt, Artificial Sequence
  Synthetic
gcauaagccaaguccaccac

SEQ ID NO: 1397 - RNA, 20 nt, Artificial Sequence
  Synthetic
cauaagccaaguccaccaca

SEQ ID NO: 1398 - RNA, 20 nt, Artificial Sequence
  Synthetic
ucacuucuuccgugaauuaa

SEQ ID NO: 1399 - RNA, 20 nt, Artificial Sequence
  Synthetic
cuuccgugaauuaacggccu

SEQ ID NO: 1400 - RNA, 20 nt, Artificial Sequence
  Synthetic
ccuauauucccauuaaauaa

SEQ ID NO: 1401 - RNA, 20 nt, Artificial Sequence
  Synthetic
uuaaauaaaggccuucguga

SEQ ID NO: 1402 - RNA, 20 nt, Artificial Sequence
  Synthetic
aggaaaacccaugcacaccc

SEQ ID NO: 1403 - RNA, 20 nt, Artificial Sequence
  Synthetic
caagcagagaaaagauaaaa

SEQ ID NO: 1404 - RNA, 20 nt, Artificial Sequence
  Synthetic
gaaaagauaaaaaggcucac

SEQ ID NO: 1405 - RNA, 20 nt, Artificial Sequence
  Synthetic
aaaaggcucacaggaagcaa

SEQ ID NO: 1406 - RNA, 20 nt, Artificial Sequence
  Synthetic
cgugaacaacacugaacauc

SEQ ID NO: 1407 - RNA, 20 nt, Artificial Sequence
  Synthetic
gugaacaacacugaacaucu

SEQ ID NO: 1408 - RNA, 20 nt, Artificial Sequence
  Synthetic
ucccugcaguccccaccucc

SEQ ID NO: 1409 - RNA, 20 nt, Artificial Sequence
  Synthetic
cccaccuccuggaauucucc

SEQ ID NO: 1410 - RNA, 20 nt, Artificial Sequence
  Synthetic
uccuggaauucuccuggacg

SEQ ID NO: 1411 - RNA, 20 nt, Artificial Sequence
  Synthetic
uggaauucuccuggacgugg

SEQ ID NO: 1412 - RNA, 20 nt, Artificial Sequence
  Synthetic
uggaggccccuuucccucug

SEQ ID NO: 1413 - RNA, 20 nt, Artificial Sequence
  Synthetic
uucccucuccauuuccuuuc

SEQ ID NO: 1414 - RNA, 20 nt, Artificial Sequence
  Synthetic
uccauuuccuuucuggagcc

SEQ ID NO: 1415 - RNA, 20 nt, Artificial Sequence
  Synthetic
cuuucuggagccuggagcca

SEQ ID NO: 1416 - RNA, 20 nt, Artificial Sequence
  Synthetic
gucuccagcucagaugcacc

SEQ ID NO: 1417 - RNA, 20 nt, Artificial Sequence
  Synthetic
agcagugacugcugacagca

SEQ ID NO: 1418 - RNA, 20 nt, Artificial Sequence
  Synthetic
cacggagugaccugcagcgc

SEQ ID NO: 1419 - RNA, 20 nt, Artificial Sequence
  Synthetic
acggagugaccugcagcgca

SEQ ID NO: 1420 - RNA, 20 nt, Artificial Sequence
  Synthetic
cggagugaccugcagcgcag

SEQ ID NO: 1421 - RNA, 20 nt, Artificial Sequence
  Synthetic
agugaccugcagcgcagggg

SEQ ID NO: 1422 - RNA, 20 nt, Artificial Sequence
  Synthetic
ggggaggagaagaaaaagag

SEQ ID NO: 1423 - RNA, 20 nt, Artificial Sequence
  Synthetic
gggaggagaagaaaaagaga

SEQ ID NO: 1424 - RNA, 20 nt, Artificial Sequence
  Synthetic
aagaaagacagauucauuca

SEQ ID NO: 1425 - RNA, 20 nt, Artificial Sequence
  Synthetic
agaaagacagauucauucaa

SEQ ID NO: 1426 - RNA, 20 nt, Artificial Sequence
  Synthetic
acagauucauucaagggcag

SEQ ID NO: 1427 - RNA, 20 nt, Artificial Sequence
  Synthetic
cagauucauucaagggcagu

SEQ ID NO: 1428 - RNA, 20 nt, Artificial Sequence
  Synthetic
gggcagugggaauugaccac

SEQ ID NO: 1429 - RNA, 20 nt, Artificial Sequence
  Synthetic
ggcagugggaauugaccaca

SEQ ID NO: 1430 - RNA, 20 nt, Artificial Sequence
  Synthetic
gauuauaguccacgugaucc

SEQ ID NO: 1431 - RNA, 20 nt, Artificial Sequence
  Synthetic
auuauaguccacgugauccu

SEQ ID NO: 1432 - RNA, 20 nt, Artificial Sequence
  Synthetic
uccacgugauccuggguucu

SEQ ID NO: 1433 - RNA, 20 nt, Artificial Sequence
  Synthetic
acgugauccuggguucuagg

SEQ ID NO: 1434 - RNA, 20 nt, Artificial Sequence
  Synthetic
gauccuggguucuaggaggc

SEQ ID NO: 1435 - RNA, 20 nt, Artificial Sequence
  Synthetic
auccuggguucuaggaggca

SEQ ID NO: 1436 - RNA, 20 nt, Artificial Sequence
  Synthetic
uaggaggcagggcuauauug

SEQ ID NO: 1437 - RNA, 20 nt, Artificial Sequence
  Synthetic
aggaggcagggcuauauugu

SEQ ID NO: 1438 - RNA, 20 nt, Artificial Sequence
  Synthetic
ggaggcagggcuauauugug

SEQ ID NO: 1439 - RNA, 20 nt, Artificial Sequence
  Synthetic
gaggcagggcuauauugugg

SEQ ID NO: 1440 - RNA, 20 nt, Artificial Sequence
  Synthetic
aggcagggcuauauuguggg

SEQ ID NO: 1441 - RNA, 20 nt, Artificial Sequence
  Synthetic
ggggggaaaaaaucaguuca

SEQ ID NO: 1442 - RNA, 20 nt, Artificial Sequence
  Synthetic
gggggaaaaaaucaguucaa

SEQ ID NO: 1443 - RNA, 20 nt, Artificial Sequence
  Synthetic
aaaaucaguucaagggaagu

SEQ ID NO: 1444 - RNA, 20 nt, Artificial Sequence
  Synthetic
aaaucaguucaagggaaguc

SEQ ID NO: 1445 - RNA, 20 nt, Artificial Sequence
  Synthetic
guaauucugagcaagucaca

SEQ ID NO: 1446 - RNA, 20 nt, Artificial Sequence
  Synthetic
aagucacaagguaguaacug

SEQ ID NO: 1447 - RNA, 20 nt, Artificial Sequence
  Synthetic
uuacuuaguuucuccuuauu

SEQ ID NO: 1448 - RNA, 20 nt, Artificial Sequence
  Synthetic
uuaggaacucuuuuucucug

SEQ ID NO: 1449 - RNA, 20 nt, Artificial Sequence
  Synthetic
ucuguggaguuagcagcaca

SEQ ID NO: 1450 - RNA, 20 nt, Artificial Sequence
  Synthetic
cuguggaguuagcagcacaa

SEQ ID NO: 1451 - RNA, 20 nt, Artificial Sequence
  Synthetic
gcaaucccguuucuuuuaac

SEQ ID NO: 1452 - RNA, 20 nt, Artificial Sequence
  Synthetic
agccaaacagauucaagccu

SEQ ID NO: 1453 - RNA, 20 nt, Artificial Sequence
  Synthetic
ggucuugcugacuauaugau

SEQ ID NO: 1454 - RNA, 20 nt, Artificial Sequence
  Synthetic
aaaaugagacuaguacccuu

SEQ ID NO: 1455 - RNA, 20 nt, Artificial Sequence
  Synthetic
uuuguaaaugucucaaguuc

SEQ ID NO: 1456 - RNA, 20 nt, Artificial Sequence
  Synthetic
caaacuguguuucuccacuc

SEQ ID NO: 1457 - RNA, 20 nt, Artificial Sequence
  Synthetic
acuguguuucuccacucugg

SEQ ID NO: 1458 - RNA, 20 nt, Artificial Sequence
  Synthetic
acucuggaggugagucugcc

SEQ ID NO: 1459 - RNA, 20 nt, Artificial Sequence
  Synthetic
cucuggaggugagucugcca

SEQ ID NO: 1460 - RNA, 20 nt, Artificial Sequence
  Synthetic
gugagucugccagggcaguu

SEQ ID NO: 1461 - RNA, 20 nt, Artificial Sequence
  Synthetic
acaaguauugacacuguugu

SEQ ID NO: 1462 - RNA, 20 nt, Artificial Sequence
  Synthetic
aacaacauaaaguugcucaa

SEQ ID NO: 1463 - RNA, 20 nt, Artificial Sequence
  Synthetic
aaggcaaucauuauuucaag

SEQ ID NO: 1464 - RNA, 20 nt, Artificial Sequence
  Synthetic
aaaguuacuucugacaguuu

SEQ ID NO: 1465 - RNA, 20 nt, Artificial Sequence
  Synthetic
gacaguuuugguauauuuau

SEQ ID NO: 1466 - RNA, 20 nt, Artificial Sequence
  Synthetic
ugcuuuuuguuuuuucucuu

SEQ ID NO: 1467 - RNA, 20 nt, Artificial Sequence
  Synthetic
gcuuuuuguuuuuucucuuu

SEQ ID NO: 1468 - RNA, 20 nt, Artificial Sequence
  Synthetic
uggguuuauuaauguaaagc

SEQ ID NO: 1469 - RNA, 20 nt, Artificial Sequence
  Synthetic
ggguuuauuaauguaaagca

SEQ ID NO: 1470 - RNA, 20 nt, Artificial Sequence
  Synthetic
aaagccugugaauuugaaug

SEQ ID NO: 1471 - RNA, 20 nt, Artificial Sequence
  Synthetic
auagagccauaaacucaaag

SEQ ID NO: 1472 - RNA, 20 nt, Artificial Sequence
  Synthetic
uuauuaccacuuugaguuua

SEQ ID NO: 1473 - RNA, 20 nt, Artificial Sequence
  Synthetic
guuuauggcucuauucgcaa

SEQ ID NO: 1474 - RNA, 20 nt, Artificial Sequence
  Synthetic
aaauguuaaauuuaguuaga

SEQ ID NO: 1475 - RNA, 20 nt, Artificial Sequence
  Synthetic
uguuaaauuuaguuagaagg

SEQ ID NO: 1476 - RNA, 20 nt, Artificial Sequence
  Synthetic
uuuuccucauucaaauucac

SEQ ID NO: 1477 - RNA, 20 nt, Artificial Sequence
  Synthetic
auucaaauucacaggcuuuc

SEQ ID NO: 1478 - RNA, 20 nt, Artificial Sequence
  Synthetic
ucacaggcuuucuggacugu

SEQ ID NO: 1479 - RNA, 20 nt, Artificial Sequence
  Synthetic
gagaaaaaacaaaaagcaaa

SEQ ID NO: 1480 - RNA, 20 nt, Artificial Sequence
  Synthetic
uaaauauuuccaaacugccc

SEQ ID NO: 1481 - RNA, 20 nt, Artificial Sequence
  Synthetic
uggcagacucaccuccagag

SEQ ID NO: 1482 - RNA, 20 nt, Artificial Sequence
  Synthetic
agauucuauucuuauuugau

SEQ ID NO: 1483 - RNA, 20 nt, Artificial Sequence
  Synthetic
gaacuugagacauuuacaaa

SEQ ID NO: 1484 - RNA, 20 nt, Artificial Sequence
  Synthetic
aacuugagacauuuacaaau

SEQ ID NO: 1485 - RNA, 20 nt, Artificial Sequence
  Synthetic
guuuguuuacagcugaccaa

SEQ ID NO: 1486 - RNA, 20 nt, Artificial Sequence
  Synthetic
uuuguuuacagcugaccaaa

SEQ ID NO: 1487 - RNA, 20 nt, Artificial Sequence
  Synthetic
ucauauagucagcaagaccu

SEQ ID NO: 1488 - RNA, 20 nt, Artificial Sequence
  Synthetic
gaccuaggcuugaaucuguu

SEQ ID NO: 1489 - RNA, 20 nt, Artificial Sequence
  Synthetic
aucuguuuggcuuuacucuu

SEQ ID NO: 1490 - RNA, 20 nt, Artificial Sequence
  Synthetic
uuucuuccuguuaaaagaaa

SEQ ID NO: 1491 - RNA, 20 nt, Artificial Sequence
  Synthetic
uucuuccuguuaaaagaaac

SEQ ID NO: 1492 - RNA, 20 nt, Artificial Sequence
  Synthetic
gagaaaaagaguuccuaaua

SEQ ID NO: 1493 - RNA, 20 nt, Artificial Sequence
  Synthetic
cagaauuacucagcuuguaa

SEQ ID NO: 1494 - RNA, 20 nt, Artificial Sequence
  Synthetic
aaaauauaguauuagaaauc

SEQ ID NO: 1495 - RNA, 20 nt, Artificial Sequence
  Synthetic
agcccugccuccuagaaccc

SEQ ID NO: 1496 - RNA, 20 nt, Artificial Sequence
  Synthetic
uccuagaacccaggaucacg

SEQ ID NO: 1497 - RNA, 20 nt, Artificial Sequence
  Synthetic
cacguggacuauaaucccug

SEQ ID NO: 1498 - RNA, 20 nt, Artificial Sequence
  Synthetic
cuucuccuccccugcgcugc

SEQ ID NO: 1499 - RNA, 20 nt, Artificial Sequence
  Synthetic
gcagucacugcugagcugcg

SEQ ID NO: 1500 - RNA, 20 nt, Artificial Sequence
  Synthetic
cagucacugcugagcugcgu

SEQ ID NO: 1501 - RNA, 20 nt, Artificial Sequence
  Synthetic
agucacugcugagcugcgug

SEQ ID NO: 1502 - RNA, 20 nt, Artificial Sequence
  Synthetic
ugcugagcugcguggggugc

SEQ ID NO: 1503 - RNA, 20 nt, Artificial Sequence
  Synthetic
agcugcguggggugcugguc

SEQ ID NO: 1504 - RNA, 20 nt, Artificial Sequence
  Synthetic
gcugcguggggugcugguca

SEQ ID NO: 1505 - RNA, 20 nt, Artificial Sequence
  Synthetic
uuugaaauuagaccuccugc

SEQ ID NO: 1506 - RNA, 20 nt, Artificial Sequence
  Synthetic
uuccccagauuucaccaaug

SEQ ID NO: 1507 - RNA, 20 nt, Artificial Sequence
  Synthetic
gauuucaccaaugagguucu

SEQ ID NO: 1508 - RNA, 20 nt, Artificial Sequence
  Synthetic
cagaguaagaacugauuuag

SEQ ID NO: 1509 - RNA, 20 nt, Artificial Sequence
  Synthetic
uuagaggcuaacauugacau

SEQ ID NO: 1510 - RNA, 20 nt, Artificial Sequence
  Synthetic
gggaaaucugccgcuucuau

SEQ ID NO: 1511 - RNA, 20 nt, Artificial Sequence
  Synthetic
uucuauaggaaugcucuccc

SEQ ID NO: 1512 - RNA, 20 nt, Artificial Sequence
  Synthetic
ggaaugcucucccuggagcc

SEQ ID NO: 1513 - RNA, 20 nt, Artificial Sequence
  Synthetic
ugcucucccuggagccuggu

SEQ ID NO: 1514 - RNA, 20 nt, Artificial Sequence
  Synthetic
gcucucccuggagccuggua

SEQ ID NO: 1515 - RNA, 20 nt, Artificial Sequence
  Synthetic
agggugcuguccuuguguuc

SEQ ID NO: 1516 - RNA, 20 nt, Artificial Sequence
  Synthetic
cacaaggacagcacccuacc

SEQ ID NO: 1517 - RNA, 20 nt, Artificial Sequence
  Synthetic
acagcacccuaccaggcucc

SEQ ID NO: 1518 - RNA, 20 nt, Artificial Sequence
  Synthetic
cagcacccuaccaggcucca

SEQ ID NO: 1519 - RNA, 20 nt, Artificial Sequence
  Synthetic
ggagagcauuccuauagaag

SEQ ID NO: 1520 - RNA, 20 nt, Artificial Sequence
  Synthetic
uuaaaacaacuguguaucuu

SEQ ID NO: 1521 - RNA, 20 nt, Artificial Sequence
  Synthetic
uaaaacaacuguguaucuuu

SEQ ID NO: 1522 - RNA, 20 nt, Artificial Sequence
  Synthetic
uaauuucagucuugcaucuc

SEQ ID NO: 1523 - RNA, 20 nt, Artificial Sequence
  Synthetic
gugcaugccaagaaccucau

SEQ ID NO: 1524 - RNA, 20 nt, Artificial Sequence
  Synthetic
agaaccucauuggugaaauc

SEQ ID NO: 1525 - RNA, 20 nt, Artificial Sequence
  Synthetic
gaaccucauuggugaaaucu

SEQ ID NO: 1526 - RNA, 20 nt, Artificial Sequence
  Synthetic
aaccucauuggugaaaucug

SEQ ID NO: 1527 - RNA, 20 nt, Artificial Sequence
  Synthetic
auauaaaauauagauuacaa

SEQ ID NO: 1528 - RNA, 20 nt, Artificial Sequence
  Synthetic
uguuaaaaacaagauccagc

SEQ ID NO: 1529 - RNA, 20 nt, Artificial Sequence
  Synthetic
uaaaaacaagauccagcagg

SEQ ID NO: 1530 - RNA, 20 nt, Artificial Sequence
  Synthetic
aaaaugucugugauuucuau

SEQ ID NO: 1531 - RNA, 17 nt, Artificial Sequence
  Synthetic
cugagcuggagacuccu

SEQ ID NO: 1532 - RNA, 17 nt, Artificial Sequence
  Synthetic
ggagacuccuuggcucc

SEQ ID NO: 1533 - RNA, 17 nt, Artificial Sequence
  Synthetic
ggcuccaggcuccagaa

SEQ ID NO: 1534 - RNA, 17 nt, Artificial Sequence
  Synthetic
aggcuccagaaaggaaa

SEQ ID NO: 1535 - RNA, 17 nt, Artificial Sequence
  Synthetic
ccagaaaggaaauggag

SEQ ID NO: 1536 - RNA, 17 nt, Artificial Sequence
  Synthetic
cagaaaggaaauggaga

SEQ ID NO: 1537 - RNA, 17 nt, Artificial Sequence
  Synthetic
gagggaaacuagucuaa

SEQ ID NO: 1538 - RNA, 17 nt, Artificial Sequence
  Synthetic
uagucuaacggagaauc

SEQ ID NO: 1539 - RNA, 17 nt, Artificial Sequence
  Synthetic
ucuaacggagaaucugg

SEQ ID NO: 1540 - RNA, 17 nt, Artificial Sequence
  Synthetic
cuaacggagaaucugga

SEQ ID NO: 1541 - RNA, 17 nt, Artificial Sequence
  Synthetic
uaacggagaaucuggag

SEQ ID NO: 1542 - RNA, 17 nt, Artificial Sequence
  Synthetic
ggacaguguuuccucag

SEQ ID NO: 1543 - RNA, 17 nt, Artificial Sequence
  Synthetic
gacaguguuuccucaga

SEQ ID NO: 1544 - RNA, 17 nt, Artificial Sequence
  Synthetic
uguuuccucagagggaa

SEQ ID NO: 1545 - RNA, 17 nt, Artificial Sequence
  Synthetic
guuuccucagagggaaa

SEQ ID NO: 1546 - RNA, 17 nt, Artificial Sequence
  Synthetic
uuuccucagagggaaag

SEQ ID NO: 1547 - RNA, 17 nt, Artificial Sequence
  Synthetic
aaggggccuccacgucc

SEQ ID NO: 1548 - RNA, 17 nt, Artificial Sequence
  Synthetic
acguccaggagaauucc

SEQ ID NO: 1549 - RNA, 17 nt, Artificial Sequence
  Synthetic
uccaggagaauuccagg

SEQ ID NO: 1550 - RNA, 17 nt, Artificial Sequence
  Synthetic
aggagaauuccaggagg

SEQ ID NO: 1551 - RNA, 17 nt, Artificial Sequence
  Synthetic
ggagaauuccaggaggu

SEQ ID NO: 1552 - RNA, 17 nt, Artificial Sequence
  Synthetic
gagaauuccaggaggug

SEQ ID NO: 1553 - RNA, 17 nt, Artificial Sequence
  Synthetic
caggagguggggacugc

SEQ ID NO: 1554 - RNA, 17 nt, Artificial Sequence
  Synthetic
aggagguggggacugca

SEQ ID NO: 1555 - RNA, 17 nt, Artificial Sequence
  Synthetic
guggggacugcagggag

SEQ ID NO: 1556 - RNA, 17 nt, Artificial Sequence
  Synthetic
uggggacugcagggagu

SEQ ID NO: 1557 - RNA, 17 nt, Artificial Sequence
  Synthetic
ggggacugcagggagug

SEQ ID NO: 1558 - RNA, 17 nt, Artificial Sequence
  Synthetic
gcagggaguggggacgc

SEQ ID NO: 1559 - RNA, 17 nt, Artificial Sequence
  Synthetic
cagggaguggggacgcu

SEQ ID NO: 1560 - RNA, 17 nt, Artificial Sequence
  Synthetic
agggaguggggacgcug

SEQ ID NO: 1561 - RNA, 17 nt, Artificial Sequence
  Synthetic
gggacgcuggggcugag

SEQ ID NO: 1562 - RNA, 17 nt, Artificial Sequence
  Synthetic
ggacgcuggggcugagc

SEQ ID NO: 1563 - RNA, 17 nt, Artificial Sequence
  Synthetic
gcugagcgggugcugaa

SEQ ID NO: 1564 - RNA, 17 nt, Artificial Sequence
  Synthetic
agcgggugcugaaaggc

SEQ ID NO: 1565 - RNA, 17 nt, Artificial Sequence
  Synthetic
ggugcugaaaggcagga

SEQ ID NO: 1566 - RNA, 17 nt, Artificial Sequence
  Synthetic
aaggcaggaaggugaaa

SEQ ID NO: 1567 - RNA, 17 nt, Artificial Sequence
  Synthetic
aggcaggaaggugaaaa

SEQ ID NO: 1568 - RNA, 17 nt, Artificial Sequence
  Synthetic
ggaaggugaaaagggca

SEQ ID NO: 1569 - RNA, 17 nt, Artificial Sequence
  Synthetic
auguucaguguuguuca

SEQ ID NO: 1570 - RNA, 17 nt, Artificial Sequence
  Synthetic
uguucaguguuguucac

SEQ ID NO: 1571 - RNA, 17 nt, Artificial Sequence
  Synthetic
guucaguguuguucacg

SEQ ID NO: 1572 - RNA, 17 nt, Artificial Sequence
  Synthetic
aguguuguucacggggc

SEQ ID NO: 1573 - RNA, 17 nt, Artificial Sequence
  Synthetic
guguuguucacggggcu

SEQ ID NO: 1574 - RNA, 17 nt, Artificial Sequence
  Synthetic
uuuaucuuuucucugcu

SEQ ID NO: 1575 - RNA, 17 nt, Artificial Sequence
  Synthetic
aucuuuucucugcuugg

SEQ ID NO: 1576 - RNA, 17 nt, Artificial Sequence
  Synthetic
agaagucuauuucauga

SEQ ID NO: 1577 - RNA, 17 nt, Artificial Sequence
  Synthetic
gaagucuauuucaugaa

SEQ ID NO: 1578 - RNA, 17 nt, Artificial Sequence
  Synthetic
ucagcuguuaaaauucc

SEQ ID NO: 1579 - RNA, 17 nt, Artificial Sequence
  Synthetic
cagcuguuaaaauucca

SEQ ID NO: 1580 - RNA, 17 nt, Artificial Sequence
  Synthetic
aaauuccagggugugca

SEQ ID NO: 1581 - RNA, 17 nt, Artificial Sequence
  Synthetic
aauuccagggugugcau

SEQ ID NO: 1582 - RNA, 17 nt, Artificial Sequence
  Synthetic
uggguuuuccuucacga

SEQ ID NO: 1583 - RNA, 17 nt, Artificial Sequence
  Synthetic
cgaaggccuuuauuuaa

SEQ ID NO: 1584 - RNA, 17 nt, Artificial Sequence
  Synthetic
gaaggccuuuauuuaau

SEQ ID NO: 1585 - RNA, 17 nt, Artificial Sequence
  Synthetic
uuauuuaaugggaauau

SEQ ID NO: 1586 - RNA, 17 nt, Artificial Sequence
  Synthetic
aagcgagcucauuuccu

SEQ ID NO: 1587 - RNA, 17 nt, Artificial Sequence
  Synthetic
ccuaggccguuaauuca

SEQ ID NO: 1588 - RNA, 17 nt, Artificial Sequence
  Synthetic
uucacggaagaagugac

SEQ ID NO: 1589 - RNA, 17 nt, Artificial Sequence
  Synthetic
uuuucuuucaugucuuc

SEQ ID NO: 1590 - RNA, 17 nt, Artificial Sequence
  Synthetic
uuucuuucaugucuucu

SEQ ID NO: 1591 - RNA, 17 nt, Artificial Sequence
  Synthetic
gcaacuacucagcccug

SEQ ID NO: 1592 - RNA, 17 nt, Artificial Sequence
  Synthetic
acuacucagcccugugg

SEQ ID NO: 1593 - RNA, 17 nt, Artificial Sequence
  Synthetic
cagcccugugguggacu

SEQ ID NO: 1594 - RNA, 17 nt, Artificial Sequence
  Synthetic
acuuggcuuaugcaaga

SEQ ID NO: 1595 - RNA, 17 nt, Artificial Sequence
  Synthetic
aagacggucgaaaaccu

SEQ ID NO: 1596 - RNA, 17 nt, Artificial Sequence
  Synthetic
ucgaaaaccuuggaauc

SEQ ID NO: 1597 - RNA, 17 nt, Artificial Sequence
  Synthetic
cuuggaaucaggagacu

SEQ ID NO: 1598 - RNA, 17 nt, Artificial Sequence
  Synthetic
agacucgguuuucuuuc

SEQ ID NO: 1599 - RNA, 17 nt, Artificial Sequence
  Synthetic
cuuucugguucugccau

SEQ ID NO: 1600 - RNA, 17 nt, Artificial Sequence
  Synthetic
cugguucugccauuggu

SEQ ID NO: 1601 - RNA, 17 nt, Artificial Sequence
  Synthetic
gguuggcugugcgaccg

SEQ ID NO: 1602 - RNA, 17 nt, Artificial Sequence
  Synthetic
guuggcugugcgaccgu

SEQ ID NO: 1603 - RNA, 17 nt, Artificial Sequence
  Synthetic
aagugucucuccuuccc

SEQ ID NO: 1604 - RNA, 17 nt, Artificial Sequence
  Synthetic
agugucucuccuucccu

SEQ ID NO: 1605 - RNA, 17 nt, Artificial Sequence
  Synthetic
cccugugauucucugug

SEQ ID NO: 1606 - RNA, 17 nt, Artificial Sequence
  Synthetic
ccugugauucucuguga

SEQ ID NO: 1607 - RNA, 17 nt, Artificial Sequence
  Synthetic
cugugauucucugugag

SEQ ID NO: 1608 - RNA, 17 nt, Artificial Sequence
  Synthetic
ugugauucucugugagg

SEQ ID NO: 1609 - RNA, 17 nt, Artificial Sequence
  Synthetic
gugauucucugugaggg

SEQ ID NO: 1610 - RNA, 17 nt, Artificial Sequence
  Synthetic
ugaggggggauguugag

SEQ ID NO: 1611 - RNA, 17 nt, Artificial Sequence
  Synthetic
gaggggggauguugaga

SEQ ID NO: 1612 - RNA, 17 nt, Artificial Sequence
  Synthetic
aggggggauguugagag

SEQ ID NO: 1613 - RNA, 17 nt, Artificial Sequence
  Synthetic
gggauguugagagggga

SEQ ID NO: 1614 - RNA, 17 nt, Artificial Sequence
  Synthetic
auguugagaggggaagg

SEQ ID NO: 1615 - RNA, 17 nt, Artificial Sequence
  Synthetic
ggggaaggaggcagagc

SEQ ID NO: 1616 - RNA, 17 nt, Artificial Sequence
  Synthetic
uggagcagcugagccac

SEQ ID NO: 1617 - RNA, 17 nt, Artificial Sequence
  Synthetic
ggagcagcugagccaca

SEQ ID NO: 1618 - RNA, 17 nt, Artificial Sequence
  Synthetic
gagcagcugagccacag

SEQ ID NO: 1619 - RNA, 17 nt, Artificial Sequence
  Synthetic
cagcugagccacagggg

SEQ ID NO: 1620 - RNA, 17 nt, Artificial Sequence
  Synthetic
cugagccacaggggagg

SEQ ID NO: 1621 - RNA, 17 nt, Artificial Sequence
  Synthetic
agccacaggggaggugg

SEQ ID NO: 1622 - RNA, 17 nt, Artificial Sequence
  Synthetic
gccacaggggaggugga

SEQ ID NO: 1623 - RNA, 17 nt, Artificial Sequence
  Synthetic
ccacaggggagguggag

SEQ ID NO: 1624 - RNA, 17 nt, Artificial Sequence
  Synthetic
cacaggggagguggagg

SEQ ID NO: 1625 - RNA, 17 nt, Artificial Sequence
  Synthetic
gggagguggagggggac

SEQ ID NO: 1626 - RNA, 17 nt, Artificial Sequence
  Synthetic
gguggagggggacagga

SEQ ID NO: 1627 - RNA, 17 nt, Artificial Sequence
  Synthetic
gagggggacaggaaggc

SEQ ID NO: 1628 - RNA, 17 nt, Artificial Sequence
  Synthetic
ggaaggcaggcagaagc

SEQ ID NO: 1629 - RNA, 17 nt, Artificial Sequence
  Synthetic
gaaggcaggcagaagcu

SEQ ID NO: 1630 - RNA, 17 nt, Artificial Sequence
  Synthetic
ugaucacgucagacucc

SEQ ID NO: 1631 - RNA, 17 nt, Artificial Sequence
  Synthetic
gagagccacaaugcuuc

SEQ ID NO: 1632 - RNA, 17 nt, Artificial Sequence
  Synthetic
ucccuaagcauagacaa

SEQ ID NO: 1633 - RNA, 17 nt, Artificial Sequence
  Synthetic
agaaugcagagacuaac

SEQ ID NO: 1634 - RNA, 17 nt, Artificial Sequence
  Synthetic
augcagagacuaacugg

SEQ ID NO: 1635 - RNA, 17 nt, Artificial Sequence
  Synthetic
uggugguagcuuuugcc

SEQ ID NO: 1636 - RNA, 17 nt, Artificial Sequence
  Synthetic
gccuggcauucaaaaac

SEQ ID NO: 1637 - RNA, 17 nt, Artificial Sequence
  Synthetic
ccuggcauucaaaaacu

SEQ ID NO: 1638 - RNA, 17 nt, Artificial Sequence
  Synthetic
aacugggccagagcaag

SEQ ID NO: 1639 - RNA, 17 nt, Artificial Sequence
  Synthetic
gcauuuuccacuugcuc

SEQ ID NO: 1640 - RNA, 17 nt, Artificial Sequence
  Synthetic
cccaguuuuugaaugcc

SEQ ID NO: 1641 - RNA, 17 nt, Artificial Sequence
  Synthetic
agucucugcauucuuuu

SEQ ID NO: 1642 - RNA, 17 nt, Artificial Sequence
  Synthetic
gcauucuuuuugguuau

SEQ ID NO: 1643 - RNA, 17 nt, Artificial Sequence
  Synthetic
ugccauugucuaugcuu

SEQ ID NO: 1644 - RNA, 17 nt, Artificial Sequence
  Synthetic
gccauugucuaugcuua

SEQ ID NO: 1645 - RNA, 17 nt, Artificial Sequence
  Synthetic
uugucuaugcuuaggga

SEQ ID NO: 1646 - RNA, 17 nt, Artificial Sequence
  Synthetic
cuuagggaaggaaaaug

SEQ ID NO: 1647 - RNA, 17 nt, Artificial Sequence
  Synthetic
aaggaaaauguggcugu

SEQ ID NO: 1648 - RNA, 17 nt, Artificial Sequence
  Synthetic
aggaaaauguggcuguu

SEQ ID NO: 1649 - RNA, 17 nt, Artificial Sequence
  Synthetic
gcuuuccugaagcauug

SEQ ID NO: 1650 - RNA, 17 nt, Artificial Sequence
  Synthetic
ugaagcauuguggcucu

SEQ ID NO: 1651 - RNA, 17 nt, Artificial Sequence
  Synthetic
auuguggcucucggucc

SEQ ID NO: 1652 - RNA, 17 nt, Artificial Sequence
  Synthetic
gucugacgugaucagug

SEQ ID NO: 1653 - RNA, 17 nt, Artificial Sequence
  Synthetic
ugaucagugaggacuga

SEQ ID NO: 1654 - RNA, 17 nt, Artificial Sequence
  Synthetic
ccccuccaccuccccug

SEQ ID NO: 1655 - RNA, 17 nt, Artificial Sequence
  Synthetic
cccucacagagaaucac

SEQ ID NO: 1656 - RNA, 17 nt, Artificial Sequence
  Synthetic
ccucacagagaaucaca

SEQ ID NO: 1657 - RNA, 17 nt, Artificial Sequence
  Synthetic
agaacacgagagcugca

SEQ ID NO: 1658 - RNA, 17 nt, Artificial Sequence
  Synthetic
gaacacgagagcugcaa

SEQ ID NO: 1659 - RNA, 17 nt, Artificial Sequence
  Synthetic
uauagcagagaagacua

SEQ ID NO: 1660 - RNA, 17 nt, Artificial Sequence
  Synthetic
agagaagacuauggccc

SEQ ID NO: 1661 - RNA, 17 nt, Artificial Sequence
  Synthetic
gagaagacuauggccca

SEQ ID NO: 1662 - RNA, 17 nt, Artificial Sequence
  Synthetic
agacuauggcccaggga

SEQ ID NO: 1663 - RNA, 17 nt, Artificial Sequence
  Synthetic
ggagagacacuugccca

SEQ ID NO: 1664 - RNA, 17 nt, Artificial Sequence
  Synthetic
gucgcacagccaaccaa

SEQ ID NO: 1665 - RNA, 17 nt, Artificial Sequence
  Synthetic
cgagucuccugauucca

SEQ ID NO: 1666 - RNA, 17 nt, Artificial Sequence
  Synthetic
uaagccaaguccaccac

SEQ ID NO: 1667 - RNA, 17 nt, Artificial Sequence
  Synthetic
aagccaaguccaccaca

SEQ ID NO: 1668 - RNA, 17 nt, Artificial Sequence
  Synthetic
cuucuuccgugaauuaa

SEQ ID NO: 1669 - RNA, 17 nt, Artificial Sequence
  Synthetic
ccgugaauuaacggccu

SEQ ID NO: 1670 - RNA, 17 nt, Artificial Sequence
  Synthetic
auauucccauuaaauaa

SEQ ID NO: 1671 - RNA, 17 nt, Artificial Sequence
  Synthetic
aauaaaggccuucguga

SEQ ID NO: 1672 - RNA, 17 nt, Artificial Sequence
  Synthetic
aaaacccaugcacaccc

SEQ ID NO: 1673 - RNA, 17 nt, Artificial Sequence
  Synthetic
gcagagaaaagauaaaa

SEQ ID NO: 1674 - RNA, 17 nt, Artificial Sequence
  Synthetic
aagauaaaaaggcucac

SEQ ID NO: 1675 - RNA, 17 nt, Artificial Sequence
  Synthetic
aggcucacaggaagcaa

SEQ ID NO: 1676 - RNA, 17 nt, Artificial Sequence
  Synthetic
gaacaacacugaacauc

SEQ ID NO: 1677 - RNA, 17 nt, Artificial Sequence
  Synthetic
aacaacacugaacaucu

SEQ ID NO: 1678 - RNA, 17 nt, Artificial Sequence
  Synthetic
cugcaguccccaccucc

SEQ ID NO: 1679 - RNA, 17 nt, Artificial Sequence
  Synthetic
accuccuggaauucucc

SEQ ID NO: 1680 - RNA, 17 nt, Artificial Sequence
  Synthetic
uggaauucuccuggacg

SEQ ID NO: 1681 - RNA, 17 nt, Artificial Sequence
  Synthetic
aauucuccuggacgugg

SEQ ID NO: 1682 - RNA, 17 nt, Artificial Sequence
  Synthetic
aggccccuuucccucug

SEQ ID NO: 1683 - RNA, 17 nt, Artificial Sequence
  Synthetic
ccucuccauuuccuuuc

SEQ ID NO: 1684 - RNA, 17 nt, Artificial Sequence
  Synthetic
auuuccuuucuggagcc

SEQ ID NO: 1685 - RNA, 17 nt, Artificial Sequence
  Synthetic
ucuggagccuggagcca

SEQ ID NO: 1686 - RNA, 17 nt, Artificial Sequence
  Synthetic
uccagcucagaugcacc

SEQ ID NO: 1687 - RNA, 17 nt, Artificial Sequence
  Synthetic
agugacugcugacagca

SEQ ID NO: 1688 - RNA, 17 nt, Artificial Sequence
  Synthetic
ggagugaccugcagcgc

SEQ ID NO: 1689 - RNA, 17 nt, Artificial Sequence
  Synthetic
gagugaccugcagcgca

SEQ ID NO: 1690 - RNA, 17 nt, Artificial Sequence
  Synthetic
agugaccugcagcgcag

SEQ ID NO: 1691 - RNA, 17 nt, Artificial Sequence
  Synthetic
gaccugcagcgcagggg

SEQ ID NO: 1692 - RNA, 17 nt, Artificial Sequence
  Synthetic
gaggagaagaaaaagag

SEQ ID NO: 1693 - RNA, 17 nt, Artificial Sequence
  Synthetic
aggagaagaaaaagaga

SEQ ID NO: 1694 - RNA, 17 nt, Artificial Sequence
  Synthetic
aaagacagauucauuca

SEQ ID NO: 1695 - RNA, 17 nt, Artificial Sequence
  Synthetic
aagacagauucauucaa

SEQ ID NO: 1696 - RNA, 17 nt, Artificial Sequence
  Synthetic
gauucauucaagggcag

SEQ ID NO: 1697 - RNA, 17 nt, Artificial Sequence
  Synthetic
auucauucaagggcagu

SEQ ID NO: 1698 - RNA, 17 nt, Artificial Sequence
  Synthetic
cagugggaauugaccac

SEQ ID NO: 1699 - RNA, 17 nt, Artificial Sequence
  Synthetic
agugggaauugaccaca

SEQ ID NO: 1700 - RNA, 17 nt, Artificial Sequence
  Synthetic
uauaguccacgugaucc

SEQ ID NO: 1701 - RNA, 17 nt, Artificial Sequence
  Synthetic
auaguccacgugauccu

SEQ ID NO: 1702 - RNA, 17 nt, Artificial Sequence
  Synthetic
acgugauccuggguucu

SEQ ID NO: 1703 - RNA, 17 nt, Artificial Sequence
  Synthetic
ugauccuggguucuagg

SEQ ID NO: 1704 - RNA, 17 nt, Artificial Sequence
  Synthetic
ccuggguucuaggaggc

SEQ ID NO: 1705 - RNA, 17 nt, Artificial Sequence
  Synthetic
cuggguucuaggaggca

SEQ ID NO: 1706 - RNA, 17 nt, Artificial Sequence
  Synthetic
gaggcagggcuauauug

SEQ ID NO: 1707 - RNA, 17 nt, Artificial Sequence
  Synthetic
aggcagggcuauauugu

SEQ ID NO: 1708 - RNA, 17 nt, Artificial Sequence
  Synthetic
ggcagggcuauauugug

SEQ ID NO: 1709 - RNA, 17 nt, Artificial Sequence
  Synthetic
gcagggcuauauugugg

SEQ ID NO: 1710 - RNA, 17 nt, Artificial Sequence
  Synthetic
cagggcuauauuguggg

SEQ ID NO: 1711 - RNA, 17 nt, Artificial Sequence
  Synthetic
gggaaaaaaucaguuca

SEQ ID NO: 1712 - RNA, 17 nt, Artificial Sequence
  Synthetic
ggaaaaaaucaguucaa

SEQ ID NO: 1713 - RNA, 17 nt, Artificial Sequence
  Synthetic
aucaguucaagggaagu

SEQ ID NO: 1714 - RNA, 17 nt, Artificial Sequence
  Synthetic
ucaguucaagggaaguc

SEQ ID NO: 1715 - RNA, 17 nt, Artificial Sequence
  Synthetic
auucugagcaagucaca

SEQ ID NO: 1716 - RNA, 17 nt, Artificial Sequence
  Synthetic
ucacaagguaguaacug

SEQ ID NO: 1717 - RNA, 17 nt, Artificial Sequence
  Synthetic
cuuaguuucuccuuauu

SEQ ID NO: 1718 - RNA, 17 nt, Artificial Sequence
  Synthetic
ggaacucuuuuucucug

SEQ ID NO: 1719 - RNA, 17 nt, Artificial Sequence
  Synthetic
guggaguuagcagcaca

SEQ ID NO: 1720 - RNA, 17 nt, Artificial Sequence
  Synthetic
uggaguuagcagcacaa

SEQ ID NO: 1721 - RNA, 17 nt, Artificial Sequence
  Synthetic
aucccguuucuuuuaac

SEQ ID NO: 1722 - RNA, 17 nt, Artificial Sequence
  Synthetic
caaacagauucaagccu

SEQ ID NO: 1723 - RNA, 17 nt, Artificial Sequence
  Synthetic
cuugcugacuauaugau

SEQ ID NO: 1724 - RNA, 17 nt, Artificial Sequence
  Synthetic
augagacuaguacccuu

SEQ ID NO: 1725 - RNA, 17 nt, Artificial Sequence
  Synthetic
guaaaugucucaaguuc

SEQ ID NO: 1726 - RNA, 17 nt, Artificial Sequence
  Synthetic
acuguguuucuccacuc

SEQ ID NO: 1727 - RNA, 17 nt, Artificial Sequence
  Synthetic
guguuucuccacucugg

SEQ ID NO: 1728 - RNA, 17 nt, Artificial Sequence
  Synthetic
cuggaggugagucugcc

SEQ ID NO: 1729 - RNA, 17 nt, Artificial Sequence
  Synthetic
uggaggugagucugcca

SEQ ID NO: 1730 - RNA, 17 nt, Artificial Sequence
  Synthetic
agucugccagggcaguu

SEQ ID NO: 1731 - RNA, 17 nt, Artificial Sequence
  Synthetic
aguauugacacuguugu

SEQ ID NO: 1732 - RNA, 17 nt, Artificial Sequence
  Synthetic
aacauaaaguugcucaa

SEQ ID NO: 1733 - RNA, 17 nt, Artificial Sequence
  Synthetic
gcaaucauuauuucaag

SEQ ID NO: 1734 - RNA, 17 nt, Artificial Sequence
  Synthetic
guuacuucugacaguuu

SEQ ID NO: 1735 - RNA, 17 nt, Artificial Sequence
  Synthetic
aguuuugguauauuuau

SEQ ID NO: 1736 - RNA, 17 nt, Artificial Sequence
  Synthetic
uuuuuguuuuuucucuu

SEQ ID NO: 1737 - RNA, 17 nt, Artificial Sequence
  Synthetic
uuuuguuuuuucucuuu

SEQ ID NO: 1738 - RNA, 17 nt, Artificial Sequence
  Synthetic
guuuauuaauguaaagc

SEQ ID NO: 1739 - RNA, 17 nt, Artificial Sequence
  Synthetic
uuuauuaauguaaagca

SEQ ID NO: 1740 - RNA, 17 nt, Artificial Sequence
  Synthetic
gccugugaauuugaaug

SEQ ID NO: 1741 - RNA, 17 nt, Artificial Sequence
  Synthetic
gagccauaaacucaaag

SEQ ID NO: 1742 - RNA, 17 nt, Artificial Sequence
  Synthetic
uuaccacuuugaguuua

SEQ ID NO: 1743 - RNA, 17 nt, Artificial Sequence
  Synthetic
uauggcucuauucgcaa

SEQ ID NO: 1744 - RNA, 17 nt, Artificial Sequence
  Synthetic
uguuaaauuuaguuaga

SEQ ID NO: 1745 - RNA, 17 nt, Artificial Sequence
  Synthetic
uaaauuuaguuagaagg

SEQ ID NO: 1746 - RNA, 17 nt, Artificial Sequence
  Synthetic
uccucauucaaauucac

SEQ ID NO: 1747 - RNA, 17 nt, Artificial Sequence
  Synthetic
caaauucacaggcuuuc

SEQ ID NO: 1748 - RNA, 17 nt, Artificial Sequence
  Synthetic
caggcuuucuggacugu

SEQ ID NO: 1749 - RNA, 17 nt, Artificial Sequence
  Synthetic
aaaaaacaaaaagcaaa

SEQ ID NO: 1750 - RNA, 17 nt, Artificial Sequence
  Synthetic
auauuuccaaacugccc

SEQ ID NO: 1751 - RNA, 17 nt, Artificial Sequence
  Synthetic
cagacucaccuccagag

SEQ ID NO: 1752 - RNA, 17 nt, Artificial Sequence
  Synthetic
uucuauucuuauuugau

SEQ ID NO: 1753 - RNA, 17 nt, Artificial Sequence
  Synthetic
cuugagacauuuacaaa

SEQ ID NO: 1754 - RNA, 17 nt, Artificial Sequence
  Synthetic
uugagacauuuacaaau

SEQ ID NO: 1755 - RNA, 17 nt, Artificial Sequence
  Synthetic
uguuuacagcugaccaa

SEQ ID NO: 1756 - RNA, 17 nt, Artificial Sequence
  Synthetic
guuuacagcugaccaaa

SEQ ID NO: 1757 - RNA, 17 nt, Artificial Sequence
  Synthetic
uauagucagcaagaccu

SEQ ID NO: 1758 - RNA, 17 nt, Artificial Sequence
  Synthetic
cuaggcuugaaucuguu

SEQ ID NO: 1759 - RNA, 17 nt, Artificial Sequence
  Synthetic
uguuuggcuuuacucuu

SEQ ID NO: 1760 - RNA, 17 nt, Artificial Sequence
  Synthetic
cuuccuguuaaaagaaa

SEQ ID NO: 1761 - RNA, 17 nt, Artificial Sequence
  Synthetic
uuccuguuaaaagaaac

SEQ ID NO: 1762 - RNA, 17 nt, Artificial Sequence
  Synthetic
aaaaagaguuccuaaua

SEQ ID NO: 1763 - RNA, 17 nt, Artificial Sequence
  Synthetic
aauuacucagcuuguaa

SEQ ID NO: 1764 - RNA, 17 nt, Artificial Sequence
  Synthetic
auauaguauuagaaauc

SEQ ID NO: 1765 - RNA, 17 nt, Artificial Sequence
  Synthetic
ccugccuccuagaaccc

SEQ ID NO: 1766 - RNA, 17 nt, Artificial Sequence
  Synthetic
uagaacccaggaucacg

SEQ ID NO: 1767 - RNA, 17 nt, Artificial Sequence
  Synthetic
guggacuauaaucccug

SEQ ID NO: 1768 - RNA, 17 nt, Artificial Sequence
  Synthetic
cuccuccccugcgcugc

SEQ ID NO: 1769 - RNA, 17 nt, Artificial Sequence
  Synthetic
gucacugcugagcugcg

SEQ ID NO: 1770 - RNA, 17 nt, Artificial Sequence
  Synthetic
ucacugcugagcugcgu

SEQ ID NO: 1771 - RNA, 17 nt, Artificial Sequence
  Synthetic
cacugcugagcugcgug

SEQ ID NO: 1772 - RNA, 17 nt, Artificial Sequence
  Synthetic
ugagcugcguggggugc

SEQ ID NO: 1773 - RNA, 17 nt, Artificial Sequence
  Synthetic
ugcguggggugcugguc

SEQ ID NO: 1774 - RNA, 17 nt, Artificial Sequence
  Synthetic
gcguggggugcugguca

SEQ ID NO: 1775 - RNA, 17 nt, Artificial Sequence
  Synthetic
gaaauuagaccuccugc

SEQ ID NO: 1776 - RNA, 17 nt, Artificial Sequence
  Synthetic
cccagauuucaccaaug

SEQ ID NO: 1777 - RNA, 17 nt, Artificial Sequence
  Synthetic
uucaccaaugagguucu

SEQ ID NO: 1778 - RNA, 17 nt, Artificial Sequence
  Synthetic
aguaagaacugauuuag

SEQ ID NO: 1779 - RNA, 17 nt, Artificial Sequence
  Synthetic
gaggcuaacauugacau

SEQ ID NO: 1780 - RNA, 17 nt, Artificial Sequence
  Synthetic
aaaucugccgcuucuau

SEQ ID NO: 1781 - RNA, 17 nt, Artificial Sequence
  Synthetic
uauaggaaugcucuccc

SEQ ID NO: 1782 - RNA, 17 nt, Artificial Sequence
  Synthetic
augcucucccuggagcc

SEQ ID NO: 1783 - RNA, 17 nt, Artificial Sequence
  Synthetic
ucucccuggagccuggu

SEQ ID NO: 1784 - RNA, 17 nt, Artificial Sequence
  Synthetic
cucccuggagccuggua

SEQ ID NO: 1785 - RNA, 17 nt, Artificial Sequence
  Synthetic
gugcuguccuuguguuc

SEQ ID NO: 1786 - RNA, 17 nt, Artificial Sequence
  Synthetic
aaggacagcacccuacc

SEQ ID NO: 1787 - RNA, 17 nt, Artificial Sequence
  Synthetic
gcacccuaccaggcucc

SEQ ID NO: 1788 - RNA, 17 nt, Artificial Sequence
  Synthetic
cacccuaccaggcucca

SEQ ID NO: 1789 - RNA, 17 nt, Artificial Sequence
  Synthetic
gagcauuccuauagaag

SEQ ID NO: 1790 - RNA, 17 nt, Artificial Sequence
  Synthetic
aaacaacuguguaucuu

SEQ ID NO: 1791 - RNA, 17 nt, Artificial Sequence
  Synthetic
aacaacuguguaucuuu

SEQ ID NO: 1792 - RNA, 17 nt, Artificial Sequence
  Synthetic
uuucagucuugcaucuc

SEQ ID NO: 1793 - RNA, 17 nt, Artificial Sequence
  Synthetic
caugccaagaaccucau

SEQ ID NO: 1794 - RNA, 17 nt, Artificial Sequence
  Synthetic
accucauuggugaaauc

SEQ ID NO: 1795 - RNA, 17 nt, Artificial Sequence
  Synthetic
ccucauuggugaaaucu

SEQ ID NO: 1796 - RNA, 17 nt, Artificial Sequence
  Synthetic
cucauuggugaaaucug

SEQ ID NO: 1797 - RNA, 17 nt, Artificial Sequence
  Synthetic
uaaaauauagauuacaa

SEQ ID NO: 1798 - RNA, 17 nt, Artificial Sequence
  Synthetic
uaaaaacaagauccagc

SEQ ID NO: 1799 - RNA, 17 nt, Artificial Sequence
  Synthetic
aaacaagauccagcagg

SEQ ID NO: 1800 - RNA, 17 nt, Artificial Sequence
  Synthetic
augucugugauuucuau

SEQ ID NO: 1801 - RNA, 17 nt, Artificial Sequence
  Synthetic
gcugccugggcccuggc

SEQ ID NO: 1802 - RNA, 20 nt, Artificial Sequence
  Synthetic
agucaaagcugccugggccc

SEQ ID NO: 1803 - RNA, 20 nt, Artificial Sequence
  Synthetic
aaagcugccugggcccuggc

SEQ ID NO: 1804 - RNA, 20 nt, Artificial Sequence
  Synthetic
cugccugggcccuggcuggc

SEQ ID NO: 1805 - RNA, 17 nt, Artificial Sequence
  Synthetic
caaagcugccugggccc

SEQ ID NO: 1806 - RNA, 20 nt, Artificial Sequence
  Synthetic
guccagaacugucauaagau

SEQ ID NO: 1807 - RNA, 20 nt, Artificial Sequence
  Synthetic
gaacugucauaagauaugag

SEQ ID NO: 1808 - RNA, 20 nt, Artificial Sequence
  Synthetic
cauaagauaugagcugaaua

SEQ ID NO: 1809 - RNA, 20 nt, Artificial Sequence
  Synthetic
augagcugaauaccgagaca

SEQ ID NO: 1810 - RNA, 20 nt, Artificial Sequence
  Synthetic
gaauaccgagacagugaagg

SEQ ID NO: 1811 - RNA, 20 nt, Artificial Sequence
  Synthetic
auaccgagacagugaaggcu

SEQ ID NO: 1812 - RNA, 20 nt, Artificial Sequence
  Synthetic
ccgagacagugaaggcugag

SEQ ID NO: 1813 - RNA, 20 nt, Artificial Sequence
  Synthetic
gaaggcugagaaggaaaucc

SEQ ID NO: 1814 - RNA, 20 nt, Artificial Sequence
  Synthetic
aaucccuggagcuggcuacc

SEQ ID NO: 1815 - RNA, 20 nt, Artificial Sequence
  Synthetic
cacggacaguucccguauuc

SEQ ID NO: 1816 - RNA, 20 nt, Artificial Sequence
  Synthetic
cguauucuugggguggcuac

SEQ ID NO: 1817 - RNA, 20 nt, Artificial Sequence
  Synthetic
acacggacauugacuuggcu

SEQ ID NO: 1818 - RNA, 20 nt, Artificial Sequence
  Synthetic
ggacauugacuuggcugugg

SEQ ID NO: 1819 - RNA, 20 nt, Artificial Sequence
  Synthetic
gcuguggaugaagcaggccu

SEQ ID NO: 1820 - RNA, 20 nt, Artificial Sequence
  Synthetic
cugggucauuuacagcaccg

SEQ ID NO: 1821 - RNA, 20 nt, Artificial Sequence
  Synthetic
gcucauaucuuaugacaguu

SEQ ID NO: 1822 - RNA, 20 nt, Artificial Sequence
  Synthetic
cuguccgugguagccagcuc

SEQ ID NO: 1823 - RNA, 20 nt, Artificial Sequence
  Synthetic
cguguagccaccccaagaau

SEQ ID NO: 1824 - RNA, 20 nt, Artificial Sequence
  Synthetic
aauguccguguagccacccc

SEQ ID NO: 1825 - RNA, 20 nt, Artificial Sequence
  Synthetic
caucggugcuguaaaugacc

SEQ ID NO: 1826 - RNA, 17 nt, Artificial Sequence
  Synthetic
cagaacugucauaagau

SEQ ID NO: 1827 - RNA, 17 nt, Artificial Sequence
  Synthetic
cugucauaagauaugag

SEQ ID NO: 1828 - RNA, 17 nt, Artificial Sequence
  Synthetic
aagauaugagcugaaua

SEQ ID NO: 1829 - RNA, 17 nt, Artificial Sequence
  Synthetic
agcugaauaccgagaca

SEQ ID NO: 1830 - RNA, 17 nt, Artificial Sequence
  Synthetic
uaccgagacagugaagg

SEQ ID NO: 1831 - RNA, 17 nt, Artificial Sequence
  Synthetic
ccgagacagugaaggcu

SEQ ID NO: 1832 - RNA, 17 nt, Artificial Sequence
  Synthetic
agacagugaaggcugag

SEQ ID NO: 1833 - RNA, 17 nt, Artificial Sequence
  Synthetic
ggcugagaaggaaaucc

SEQ ID NO: 1834 - RNA, 17 nt, Artificial Sequence
  Synthetic
cccuggagcuggcuacc

SEQ ID NO: 1835 - RNA, 17 nt, Artificial Sequence
  Synthetic
ggacaguucccguauuc

SEQ ID NO: 1836 - RNA, 17 nt, Artificial Sequence
  Synthetic
auucuugggguggcuac

SEQ ID NO: 1837 - RNA, 17 nt, Artificial Sequence
  Synthetic
cggacauugacuuggcu

SEQ ID NO: 1838 - RNA, 17 nt, Artificial Sequence
  Synthetic
cauugacuuggcugugg

SEQ ID NO: 1839 - RNA, 17 nt, Artificial Sequence
  Synthetic
guggaugaagcaggccu

SEQ ID NO: 1840 - RNA, 17 nt, Artificial Sequence
  Synthetic
ggucauuuacagcaccg

SEQ ID NO: 1841 - RNA, 17 nt, Artificial Sequence
  Synthetic
cauaucuuaugacaguu

SEQ ID NO: 1842 - RNA, 17 nt, Artificial Sequence
  Synthetic
uccgugguagccagcuc

SEQ ID NO: 1843 - RNA, 17 nt, Artificial Sequence
  Synthetic
guagccaccccaagaau

SEQ ID NO: 1844 - RNA, 17 nt, Artificial Sequence
  Synthetic
guccguguagccacccc

SEQ ID NO: 1845 - RNA, 17 nt, Artificial Sequence
  Synthetic
cggugcuguaaaugacc

SEQ ID NO: 1846 - RNA, 20 nt, Artificial Sequence
  Synthetic
agacccugaccaucccauuc

SEQ ID NO: 1847 - RNA, 20 nt, Artificial Sequence
  Synthetic
gcaugauugacuacaacccc

SEQ ID NO: 1848 - RNA, 20 nt, Artificial Sequence
  Synthetic
ugauugacuacaacccccug

SEQ ID NO: 1849 - RNA, 20 nt, Artificial Sequence
  Synthetic
uugacuacaacccccuggag

SEQ ID NO: 1850 - RNA, 20 nt, Artificial Sequence
  Synthetic
cuggagaagaagcucuuugc

SEQ ID NO: 1851 - RNA, 20 nt, Artificial Sequence
  Synthetic
agcucuuugccugggacaac

SEQ ID NO: 1852 - RNA, 20 nt, Artificial Sequence
  Synthetic
gacaucaagcucuccaagau

SEQ ID NO: 1853 - RNA, 20 nt, Artificial Sequence
  Synthetic
aaaguugacgguagcaucug

SEQ ID NO: 1854 - RNA, 20 nt, Artificial Sequence
  Synthetic
cgguucuugaaugggauggu

SEQ ID NO: 1855 - RNA, 20 nt, Artificial Sequence
  Synthetic
guacuuauagcgguucuuga

SEQ ID NO: 1856 - RNA, 20 nt, Artificial Sequence
  Synthetic
ugcuguacuuauagcgguuc

SEQ ID NO: 1857 - RNA, 20 nt, Artificial Sequence
  Synthetic
caggcaaagagcuucuucuc

SEQ ID NO: 1858 - RNA, 20 nt, Artificial Sequence
  Synthetic
uguucaaguugucccaggca

SEQ ID NO: 1859 - RNA, 20 nt, Artificial Sequence
  Synthetic
uggaggcuuuucacaucuug

SEQ ID NO: 1860 - RNA, 20 nt, Artificial Sequence
  Synthetic
gcuuggaggcuuuucacauc

SEQ ID NO: 1861 - RNA, 17 nt, Artificial Sequence
  Synthetic
cccugaccaucccauuc

SEQ ID NO: 1862 - RNA, 17 nt, Artificial Sequence
  Synthetic
ugauugacuacaacccc

SEQ ID NO: 1863 - RNA, 17 nt, Artificial Sequence
  Synthetic
uugacuacaacccccug

SEQ ID NO: 1864 - RNA, 17 nt, Artificial Sequence
  Synthetic
acuacaacccccuggag

SEQ ID NO: 1865 - RNA, 17 nt, Artificial Sequence
  Synthetic
gagaagaagcucuuugc

SEQ ID NO: 1866 - RNA, 17 nt, Artificial Sequence
  Synthetic
ucuuugccugggacaac

SEQ ID NO: 1867 - RNA, 17 nt, Artificial Sequence
  Synthetic
aucaagcucuccaagau

SEQ ID NO: 1868 - RNA, 17 nt, Artificial Sequence
  Synthetic
guugacgguagcaucug

SEQ ID NO: 1869 - RNA, 17 nt, Artificial Sequence
  Synthetic
uucuugaaugggauggu

SEQ ID NO: 1870 - RNA, 17 nt, Artificial Sequence
  Synthetic
cuuauagcgguucuuga

SEQ ID NO: 1871 - RNA, 17 nt, Artificial Sequence
  Synthetic
uguacuuauagcgguuc

SEQ ID NO: 1872 - RNA, 17 nt, Artificial Sequence
  Synthetic
gcaaagagcuucuucuc

SEQ ID NO: 1873 - RNA, 17 nt, Artificial Sequence
  Synthetic
ucaaguugucccaggca

SEQ ID NO: 1874 - RNA, 17 nt, Artificial Sequence
  Synthetic
aggcuuuucacaucuug

SEQ ID NO: 1875 - RNA, 17 nt, Artificial Sequence
  Synthetic
uggaggcuuuucacauc

SEQ ID NO: 1876 - RNA, 20 nt, Artificial Sequence
  Synthetic
agccucaccaagccucugca

SEQ ID NO: 1877 - RNA, 20 nt, Artificial Sequence
  Synthetic
cugugcacguugcugcagcu

SEQ ID NO: 1878 - RNA, 20 nt, Artificial Sequence
  Synthetic
acguugcugcagcuuugggc

SEQ ID NO: 1879 - RNA, 20 nt, Artificial Sequence
  Synthetic
cugcuucuggccugccuggu

SEQ ID NO: 1880 - RNA, 20 nt, Artificial Sequence
  Synthetic
uggccugccuggugugggau

SEQ ID NO: 1881 - RNA, 20 nt, Artificial Sequence
  Synthetic
cuggugugggaugugggggc

SEQ ID NO: 1882 - RNA, 20 nt, Artificial Sequence
  Synthetic
ggggccaggacagcucagcu

SEQ ID NO: 1883 - RNA, 20 nt, Artificial Sequence
  Synthetic
agcucaggaaggccaaugac

SEQ ID NO: 1884 - RNA, 20 nt, Artificial Sequence
  Synthetic
cuucaguguggccaguccca

SEQ ID NO: 1885 - RNA, 20 nt, Artificial Sequence
  Synthetic
ucccaaugaauccagcugcc

SEQ ID NO: 1886 - RNA, 20 nt, Artificial Sequence
  Synthetic
augaauccagcugcccagag

SEQ ID NO: 1887 - RNA, 20 nt, Artificial Sequence
  Synthetic
ugucagucauccauaacuua

SEQ ID NO: 1888 - RNA, 20 nt, Artificial Sequence
  Synthetic
ucagucauccauaacuuaca

SEQ ID NO: 1889 - RNA, 20 nt, Artificial Sequence
  Synthetic
gcagcacccaacgcuuagac

SEQ ID NO: 1890 - RNA, 20 nt, Artificial Sequence
  Synthetic
ccaaagcucgacucagcucc

SEQ ID NO: 1891 - RNA, 20 nt, Artificial Sequence
  Synthetic
aagcucgacucagcucccug

SEQ ID NO: 1892 - RNA, 20 nt, Artificial Sequence
  Synthetic
gccuccuccaccaauugacc

SEQ ID NO: 1893 - RNA, 20 nt, Artificial Sequence
  Synthetic
uggaccaggcugccaggccc

SEQ ID NO: 1894 - RNA, 20 nt, Artificial Sequence
  Synthetic
cugccaggccccaggagacc

SEQ ID NO: 1895 - RNA, 20 nt, Artificial Sequence
  Synthetic
ccaggccccaggagacccag

SEQ ID NO: 1896 - RNA, 20 nt, Artificial Sequence
  Synthetic
aggagacccaggaggggcug

SEQ ID NO: 1897 - RNA, 20 nt, Artificial Sequence
  Synthetic
gagacccaggaggggcugca

SEQ ID NO: 1898 - RNA, 20 nt, Artificial Sequence
  Synthetic
aggaggggcugcagagggag

SEQ ID NO: 1899 - RNA, 20 nt, Artificial Sequence
  Synthetic
ugcagagggagcugggcacc

SEQ ID NO: 1900 - RNA, 20 nt, Artificial Sequence
  Synthetic
agggagcugggcacccugag

SEQ ID NO: 1901 - RNA, 20 nt, Artificial Sequence
  Synthetic
cugggcacccugaggcggga

SEQ ID NO: 1902 - RNA, 20 nt, Artificial Sequence
  Synthetic
ugaggcgggagcgggaccag

SEQ ID NO: 1903 - RNA, 20 nt, Artificial Sequence
  Synthetic
gaccagcuggaaacccaaac

SEQ ID NO: 1904 - RNA, 20 nt, Artificial Sequence
  Synthetic
ccagcuggaaacccaaacca

SEQ ID NO: 1905 - RNA, 20 nt, Artificial Sequence
  Synthetic
uggaaacccaaaccagagag

SEQ ID NO: 1906 - RNA, 20 nt, Artificial Sequence
  Synthetic
acugccuacagcaaccuccu

SEQ ID NO: 1907 - RNA, 20 nt, Artificial Sequence
  Synthetic
uccuccgagacaagucaguu

SEQ ID NO: 1908 - RNA, 20 nt, Artificial Sequence
  Synthetic
uccgagacaagucaguucug

SEQ ID NO: 1909 - RNA, 20 nt, Artificial Sequence
  Synthetic
agacaagucaguucuggagg

SEQ ID NO: 1910 - RNA, 20 nt, Artificial Sequence
  Synthetic
acaagucaguucuggaggaa

SEQ ID NO: 1911 - RNA, 20 nt, Artificial Sequence
  Synthetic
agucaguucuggaggaagag

SEQ ID NO: 1912 - RNA, 20 nt, Artificial Sequence
  Synthetic
agagaagaagcgacuaaggc

SEQ ID NO: 1913 - RNA, 20 nt, Artificial Sequence
  Synthetic
gaagcgacuaaggcaagaaa

SEQ ID NO: 1914 - RNA, 20 nt, Artificial Sequence
  Synthetic
agcgacuaaggcaagaaaau

SEQ ID NO: 1915 - RNA, 20 nt, Artificial Sequence
  Synthetic
caagaaaaugagaaucuggc

SEQ ID NO: 1916 - RNA, 20 nt, Artificial Sequence
  Synthetic
augagaaucuggccaggagg

SEQ ID NO: 1917 - RNA, 20 nt, Artificial Sequence
  Synthetic
ggagguuggaaagcagcagc

SEQ ID NO: 1918 - RNA, 20 nt, Artificial Sequence
  Synthetic
gcagccaggagguagcaagg

SEQ ID NO: 1919 - RNA, 20 nt, Artificial Sequence
  Synthetic
agccaggagguagcaaggcu

SEQ ID NO: 1920 - RNA, 20 nt, Artificial Sequence
  Synthetic
caggagguagcaaggcugag

SEQ ID NO: 1921 - RNA, 20 nt, Artificial Sequence
  Synthetic
aggggccaguguccccagac

SEQ ID NO: 1922 - RNA, 20 nt, Artificial Sequence
  Synthetic
ccccagacccgagacacugc

SEQ ID NO: 1923 - RNA, 20 nt, Artificial Sequence
  Synthetic
cgggcugugccaccaggcuc

SEQ ID NO: 1924 - RNA, 20 nt, Artificial Sequence
  Synthetic
ggcugugccaccaggcucca

SEQ ID NO: 1925 - RNA, 20 nt, Artificial Sequence
  Synthetic
aaccucauugcagaggcuug

SEQ ID NO: 1926 - RNA, 20 nt, Artificial Sequence
  Synthetic
ugcacagaagaaccucauug

SEQ ID NO: 1927 - RNA, 20 nt, Artificial Sequence
  Synthetic
agcugcagcaacgugcacag

SEQ ID NO: 1928 - RNA, 20 nt, Artificial Sequence
  Synthetic
caaagcugcagcaacgugca

SEQ ID NO: 1929 - RNA, 20 nt, Artificial Sequence
  Synthetic
aggcaggccagaagcagcag

SEQ ID NO: 1930 - RNA, 20 nt, Artificial Sequence
  Synthetic
acaucccacaccaggcaggc

SEQ ID NO: 1931 - RNA, 20 nt, Artificial Sequence
  Synthetic
uggucauuggccuuccugag

SEQ ID NO: 1932 - RNA, 20 nt, Artificial Sequence
  Synthetic
cacucuggucauuggccuuc

SEQ ID NO: 1933 - RNA, 20 nt, Artificial Sequence
  Synthetic
auucauugggacuggccaca

SEQ ID NO: 1934 - RNA, 20 nt, Artificial Sequence
  Synthetic
gcucugggcagcuggauuca

SEQ ID NO: 1935 - RNA, 20 nt, Artificial Sequence
  Synthetic
ccuggcucugcucugggcag

SEQ ID NO: 1936 - RNA, 20 nt, Artificial Sequence
  Synthetic
ugacauggccuggcucugcu

SEQ ID NO: 1937 - RNA, 20 nt, Artificial Sequence
  Synthetic
cugcugucucucuguaaguu

SEQ ID NO: 1938 - RNA, 20 nt, Artificial Sequence
  Synthetic
guggccuccaggucuaagcg

SEQ ID NO: 1939 - RNA, 20 nt, Artificial Sequence
  Synthetic
aggcucuccagggagcugag

SEQ ID NO: 1940 - RNA, 20 nt, Artificial Sequence
  Synthetic
ggaggaggcucuccagggag

SEQ ID NO: 1941 - RNA, 20 nt, Artificial Sequence
  Synthetic
aauugguggaggaggcucuc

SEQ ID NO: 1942 - RNA, 20 nt, Artificial Sequence
  Synthetic
ugguccaaggucaauuggug

SEQ ID NO: 1943 - RNA, 20 nt, Artificial Sequence
  Synthetic
gccugguccaaggucaauug

SEQ ID NO: 1944 - RNA, 20 nt, Artificial Sequence
  Synthetic
ugcagccccuccugggucuc

SEQ ID NO: 1945 - RNA, 20 nt, Artificial Sequence
  Synthetic
agcucccucugcagccccuc

SEQ ID NO: 1946 - RNA, 20 nt, Artificial Sequence
  Synthetic
agcuggucccgcucccgccu

SEQ ID NO: 1947 - RNA, 20 nt, Artificial Sequence
  Synthetic
gcagucuccaacucucuggu

SEQ ID NO: 1948 - RNA, 20 nt, Artificial Sequence
  Synthetic
uccagaacugacuugucucg

SEQ ID NO: 1949 - RNA, 20 nt, Artificial Sequence
  Synthetic
uccuccagaacugacuuguc

SEQ ID NO: 1950 - RNA, 20 nt, Artificial Sequence
  Synthetic
agucgcuucuucucuuccuc

SEQ ID NO: 1951 - RNA, 20 nt, Artificial Sequence
  Synthetic
gcccgagcagugucucgggu

SEQ ID NO: 1952 - RNA, 20 nt, Artificial Sequence
  Synthetic
ggcacagcccgagcaguguc

SEQ ID NO: 1953 - RNA, 20 nt, Artificial Sequence
  Synthetic
cuggagccugguggcacagc

SEQ ID NO: 1954 - RNA, 17 nt, Artificial Sequence
  Synthetic
cucaccaagccucugca

SEQ ID NO: 1955 - RNA, 17 nt, Artificial Sequence
  Synthetic
ugcacguugcugcagcu

SEQ ID NO: 1956 - RNA, 17 nt, Artificial Sequence
  Synthetic
uugcugcagcuuugggc

SEQ ID NO: 1957 - RNA, 17 nt, Artificial Sequence
  Synthetic
cuucuggccugccuggu

SEQ ID NO: 1958 - RNA, 17 nt, Artificial Sequence
  Synthetic
ccugccuggugugggau

SEQ ID NO: 1959 - RNA, 17 nt, Artificial Sequence
  Synthetic
gugugggaugugggggc

SEQ ID NO: 1960 - RNA, 17 nt, Artificial Sequence
  Synthetic
gccaggacagcucagcu

SEQ ID NO: 1961 - RNA, 17 nt, Artificial Sequence
  Synthetic
ucaggaaggccaaugac

SEQ ID NO: 1962 - RNA, 17 nt, Artificial Sequence
  Synthetic
caguguggccaguccca

SEQ ID NO: 1963 - RNA, 17 nt, Artificial Sequence
  Synthetic
caaugaauccagcugcc

SEQ ID NO: 1964 - RNA, 17 nt, Artificial Sequence
  Synthetic
aauccagcugcccagag

SEQ ID NO: 1965 - RNA, 17 nt, Artificial Sequence
  Synthetic
cagucauccauaacuua

SEQ ID NO: 1966 - RNA, 17 nt, Artificial Sequence
  Synthetic
gucauccauaacuuaca

SEQ ID NO: 1967 - RNA, 17 nt, Artificial Sequence
  Synthetic
gcacccaacgcuuagac

SEQ ID NO: 1968 - RNA, 17 nt, Artificial Sequence
  Synthetic
aagcucgacucagcucc

SEQ ID NO: 1969 - RNA, 17 nt, Artificial Sequence
  Synthetic
cucgacucagcucccug

SEQ ID NO: 1970 - RNA, 17 nt, Artificial Sequence
  Synthetic
uccuccaccaauugacc

SEQ ID NO: 1971 - RNA, 17 nt, Artificial Sequence
  Synthetic
accaggcugccaggccc

SEQ ID NO: 1972 - RNA, 17 nt, Artificial Sequence
  Synthetic
ccaggccccaggagacc

SEQ ID NO: 1973 - RNA, 17 nt, Artificial Sequence
  Synthetic
ggccccaggagacccag

SEQ ID NO: 1974 - RNA, 17 nt, Artificial Sequence
  Synthetic
agacccaggaggggcug

SEQ ID NO: 1975 - RNA, 17 nt, Artificial Sequence
  Synthetic
acccaggaggggcugca

SEQ ID NO: 1976 - RNA, 17 nt, Artificial Sequence
  Synthetic
aggggcugcagagggag

SEQ ID NO: 1977 - RNA, 17 nt, Artificial Sequence
  Synthetic
agagggagcugggcacc

SEQ ID NO: 1978 - RNA, 17 nt, Artificial Sequence
  Synthetic
gagcugggcacccugag

SEQ ID NO: 1979 - RNA, 17 nt, Artificial Sequence
  Synthetic
ggcacccugaggcggga

SEQ ID NO: 1980 - RNA, 17 nt, Artificial Sequence
  Synthetic
ggcgggagcgggaccag

SEQ ID NO: 1981 - RNA, 17 nt, Artificial Sequence
  Synthetic
cagcuggaaacccaaac

SEQ ID NO: 1982 - RNA, 17 nt, Artificial Sequence
  Synthetic
gcuggaaacccaaacca

SEQ ID NO: 1983 - RNA, 17 nt, Artificial Sequence
  Synthetic
aaacccaaaccagagag

SEQ ID NO: 1984 - RNA, 17 nt, Artificial Sequence
  Synthetic
gccuacagcaaccuccu

SEQ ID NO: 1985 - RNA, 17 nt, Artificial Sequence
  Synthetic
uccgagacaagucaguu

SEQ ID NO: 1986 - RNA, 17 nt, Artificial Sequence
  Synthetic
gagacaagucaguucug

SEQ ID NO: 1987 - RNA, 17 nt, Artificial Sequence
  Synthetic
caagucaguucuggagg

SEQ ID NO: 1988 - RNA, 17 nt, Artificial Sequence
  Synthetic
agucaguucuggaggaa

SEQ ID NO: 1989 - RNA, 17 nt, Artificial Sequence
  Synthetic
caguucuggaggaagag

SEQ ID NO: 1990 - RNA, 17 nt, Artificial Sequence
  Synthetic
gaagaagcgacuaaggc

SEQ ID NO: 1991 - RNA, 17 nt, Artificial Sequence
  Synthetic
gcgacuaaggcaagaaa

SEQ ID NO: 1992 - RNA, 17 nt, Artificial Sequence
  Synthetic
gacuaaggcaagaaaau

SEQ ID NO: 1993 - RNA, 17 nt, Artificial Sequence
  Synthetic
gaaaaugagaaucuggc

SEQ ID NO: 1994 - RNA, 17 nt, Artificial Sequence
  Synthetic
agaaucuggccaggagg

SEQ ID NO: 1995 - RNA, 17 nt, Artificial Sequence
  Synthetic
gguuggaaagcagcagc

SEQ ID NO: 1996 - RNA, 17 nt, Artificial Sequence
  Synthetic
gccaggagguagcaagg

SEQ ID NO: 1997 - RNA, 17 nt, Artificial Sequence
  Synthetic
caggagguagcaaggcu

SEQ ID NO: 1998 - RNA, 17 nt, Artificial Sequence
  Synthetic
gagguagcaaggcugag

SEQ ID NO: 1999 - RNA, 17 nt, Artificial Sequence
  Synthetic
ggccaguguccccagac

SEQ ID NO: 2000 - RNA, 17 nt, Artificial Sequence
  Synthetic
cagacccgagacacugc

SEQ ID NO: 2001 - RNA, 17 nt, Artificial Sequence
  Synthetic
gcugugccaccaggcuc

SEQ ID NO: 2002 - RNA, 17 nt, Artificial Sequence
  Synthetic
ugugccaccaggcucca

SEQ ID NO: 2003 - RNA, 17 nt, Artificial Sequence
  Synthetic
cucauugcagaggcuug

SEQ ID NO: 2004 - RNA, 17 nt, Artificial Sequence
  Synthetic
acagaagaaccucauug

SEQ ID NO: 2005 - RNA, 17 nt, Artificial Sequence
  Synthetic
ugcagcaacgugcacag

SEQ ID NO: 2006 - RNA, 17 nt, Artificial Sequence
  Synthetic
agcugcagcaacgugca

SEQ ID NO: 2007 - RNA, 17 nt, Artificial Sequence
  Synthetic
caggccagaagcagcag

SEQ ID NO: 2008 - RNA, 17 nt, Artificial Sequence
  Synthetic
ucccacaccaggcaggc

SEQ ID NO: 2009 - RNA, 17 nt, Artificial Sequence
  Synthetic
ucauuggccuuccugag

SEQ ID NO: 2010 - RNA, 17 nt, Artificial Sequence
  Synthetic
ucuggucauuggccuuc

SEQ ID NO: 2011 - RNA, 17 nt, Artificial Sequence
  Synthetic
cauugggacuggccaca

SEQ ID NO: 2012 - RNA, 17 nt, Artificial Sequence
  Synthetic
cugggcagcuggauuca

SEQ ID NO: 2013 - RNA, 17 nt, Artificial Sequence
  Synthetic
ggcucugcucugggcag

SEQ ID NO: 2014 - RNA, 17 nt, Artificial Sequence
  Synthetic
cauggccuggcucugcu

SEQ ID NO: 2015 - RNA, 17 nt, Artificial Sequence
  Synthetic
cugucucucuguaaguu

SEQ ID NO: 2016 - RNA, 17 nt, Artificial Sequence
  Synthetic
gccuccaggucuaagcg

SEQ ID NO: 2017 - RNA, 17 nt, Artificial Sequence
  Synthetic
cucuccagggagcugag

SEQ ID NO: 2018 - RNA, 17 nt, Artificial Sequence
  Synthetic
ggaggcucuccagggag

SEQ ID NO: 2019 - RNA, 17 nt, Artificial Sequence
  Synthetic
ugguggaggaggcucuc

SEQ ID NO: 2020 - RNA, 17 nt, Artificial Sequence
  Synthetic
uccaaggucaauuggug

SEQ ID NO: 2021 - RNA, 17 nt, Artificial Sequence
  Synthetic
ugguccaaggucaauug

SEQ ID NO: 2022 - RNA, 17 nt, Artificial Sequence
  Synthetic
agccccuccugggucuc

SEQ ID NO: 2023 - RNA, 17 nt, Artificial Sequence
  Synthetic
ucccucugcagccccuc

SEQ ID NO: 2024 - RNA, 17 nt, Artificial Sequence
  Synthetic
uggucccgcucccgccu

SEQ ID NO: 2025 - RNA, 17 nt, Artificial Sequence
  Synthetic
gucuccaacucucuggu

SEQ ID NO: 2026 - RNA, 17 nt, Artificial Sequence
  Synthetic
agaacugacuugucucg

SEQ ID NO: 2027 - RNA, 17 nt, Artificial Sequence
  Synthetic
uccagaacugacuuguc

SEQ ID NO: 2028 - RNA, 17 nt, Artificial Sequence
  Synthetic
cgcuucuucucuuccuc

SEQ ID NO: 2029 - RNA, 17 nt, Artificial Sequence
  Synthetic
cgagcagugucucgggu

SEQ ID NO: 2030 - RNA, 17 nt, Artificial Sequence
  Synthetic
acagcccgagcaguguc

SEQ ID NO: 2031 - RNA, 17 nt, Artificial Sequence
  Synthetic
gagccugguggcacagc

SEQ ID NO: 2032 - RNA, 20 nt, Artificial Sequence
  Synthetic
ggcagagguuuccucuccag

SEQ ID NO: 2033 - RNA, 20 nt, Artificial Sequence
  Synthetic
ugggggagcccugcaagcac

SEQ ID NO: 2034 - RNA, 20 nt, Artificial Sequence
  Synthetic
cccugcaagcacccgggguc

SEQ ID NO: 2035 - RNA, 20 nt, Artificial Sequence
  Synthetic
cacccgggguccuggguguc

SEQ ID NO: 2036 - RNA, 20 nt, Artificial Sequence
  Synthetic
guuguuuuguuaucacucuc

SEQ ID NO: 2037 - RNA, 20 nt, Artificial Sequence
  Synthetic
aggcauucauugacaauuua

SEQ ID NO: 2038 - RNA, 20 nt, Artificial Sequence
  Synthetic
uacuuauaucugccagacac

SEQ ID NO: 2039 - RNA, 20 nt, Artificial Sequence
  Synthetic
cagacaccagagacaaaaug

SEQ ID NO: 2040 - RNA, 20 nt, Artificial Sequence
  Synthetic
gcagucacugcccuaccuuc

SEQ ID NO: 2041 - RNA, 20 nt, Artificial Sequence
  Synthetic
cguggaggugacaguuucuc

SEQ ID NO: 2042 - RNA, 20 nt, Artificial Sequence
  Synthetic
aguuucucauggaagacgug

SEQ ID NO: 2043 - RNA, 20 nt, Artificial Sequence
  Synthetic
uucucauggaagacgugcag

SEQ ID NO: 2044 - RNA, 20 nt, Artificial Sequence
  Synthetic
cagccaacuuaaacccagug

SEQ ID NO: 2045 - RNA, 20 nt, Artificial Sequence
  Synthetic
caacuuaaacccagugcuga

SEQ ID NO: 2046 - RNA, 20 nt, Artificial Sequence
  Synthetic
uuaaacccagugcugaaaga

SEQ ID NO: 2047 - RNA, 20 nt, Artificial Sequence
  Synthetic
gaaaggaaauaaacaccauc

SEQ ID NO: 2048 - RNA, 20 nt, Artificial Sequence
  Synthetic
aggaaauaaacaccaucuug

SEQ ID NO: 2049 - RNA, 20 nt, Artificial Sequence
  Synthetic
cccugcugccuccaucgugc

SEQ ID NO: 2050 - RNA, 20 nt, Artificial Sequence
  Synthetic
gugcccggaggcccccaagc

SEQ ID NO: 2051 - RNA, 20 nt, Artificial Sequence
  Synthetic
gcuggccugccucgcuuccc

SEQ ID NO: 2052 - RNA, 20 nt, Artificial Sequence
  Synthetic
cgugaaucguccuggugcau

SEQ ID NO: 2053 - RNA, 20 nt, Artificial Sequence
  Synthetic
aucguccuggugcaucugag

SEQ ID NO: 2054 - RNA, 20 nt, Artificial Sequence
  Synthetic
ucguccuggugcaucugagc

SEQ ID NO: 2055 - RNA, 20 nt, Artificial Sequence
  Synthetic
gacuccuuggcuccaggcuc

SEQ ID NO: 2056 - RNA, 20 nt, Artificial Sequence
  Synthetic
ccuuggcuccaggcuccaga

SEQ ID NO: 2057 - RNA, 20 nt, Artificial Sequence
  Synthetic
cuccaggcuccagaaaggaa

SEQ ID NO: 2058 - RNA, 20 nt, Artificial Sequence
  Synthetic
caggcuccagaaaggaaaug

SEQ ID NO: 2059 - RNA, 20 nt, Artificial Sequence
  Synthetic
ggcuccagaaaggaaaugga

SEQ ID NO: 2060 - RNA, 20 nt, Artificial Sequence
  Synthetic
uggagagggaaacuagucua

SEQ ID NO: 2061 - RNA, 20 nt, Artificial Sequence
  Synthetic
agagggaaacuagucuaacg

SEQ ID NO: 2062 - RNA, 20 nt, Artificial Sequence
  Synthetic
aaacuagucuaacggagaau

SEQ ID NO: 2063 - RNA, 20 nt, Artificial Sequence
  Synthetic
cuagucuaacggagaaucug

SEQ ID NO: 2064 - RNA, 20 nt, Artificial Sequence
  Synthetic
uggaggggacaguguuuccu

SEQ ID NO: 2065 - RNA, 20 nt, Artificial Sequence
  Synthetic
gaggggacaguguuuccuca

SEQ ID NO: 2066 - RNA, 20 nt, Artificial Sequence
  Synthetic
acaguguuuccucagaggga

SEQ ID NO: 2067 - RNA, 20 nt, Artificial Sequence
  Synthetic
gggaaaggggccuccacguc

SEQ ID NO: 2068 - RNA, 20 nt, Artificial Sequence
  Synthetic
aaaggggccuccacguccag

SEQ ID NO: 2069 - RNA, 20 nt, Artificial Sequence
  Synthetic
cuccacguccaggagaauuc

SEQ ID NO: 2070 - RNA, 20 nt, Artificial Sequence
  Synthetic
guccaggagaauuccaggag

SEQ ID NO: 2071 - RNA, 20 nt, Artificial Sequence
  Synthetic
auuccaggagguggggacug

SEQ ID NO: 2072 - RNA, 20 nt, Artificial Sequence
  Synthetic
ggagguggggacugcaggga

SEQ ID NO: 2073 - RNA, 20 nt, Artificial Sequence
  Synthetic
gacugcagggaguggggacg

SEQ ID NO: 2074 - RNA, 20 nt, Artificial Sequence
  Synthetic
agggaguggggacgcugggg

SEQ ID NO: 2075 - RNA, 20 nt, Artificial Sequence
  Synthetic
aguggggacgcuggggcuga

SEQ ID NO: 2076 - RNA, 20 nt, Artificial Sequence
  Synthetic
acgcuggggcugagcgggug

SEQ ID NO: 2077 - RNA, 20 nt, Artificial Sequence
  Synthetic
gcugagcgggugcugaaagg

SEQ ID NO: 2078 - RNA, 20 nt, Artificial Sequence
  Synthetic
gggugcugaaaggcaggaag

SEQ ID NO: 2079 - RNA, 20 nt, Artificial Sequence
  Synthetic
cugaaaggcaggaaggugaa

SEQ ID NO: 2080 - RNA, 20 nt, Artificial Sequence
  Synthetic
ggaaggugaaaagggcaagg

SEQ ID NO: 2081 - RNA, 20 nt, Artificial Sequence
  Synthetic
ccagauguucaguguuguuc

SEQ ID NO: 2082 - RNA, 20 nt, Artificial Sequence
  Synthetic
guucaguguuguucacgggg

SEQ ID NO: 2083 - RNA, 20 nt, Artificial Sequence
  Synthetic
ggaguuuuccguugcuuccu

SEQ ID NO: 2084 - RNA, 20 nt, Artificial Sequence
  Synthetic
ccuuuuuaucuuuucucugc

SEQ ID NO: 2085 - RNA, 20 nt, Artificial Sequence
  Synthetic
uuuuaucuuuucucugcuug

SEQ ID NO: 2086 - RNA, 20 nt, Artificial Sequence
  Synthetic
uaucuuuucucugcuuggag

SEQ ID NO: 2087 - RNA, 20 nt, Artificial Sequence
  Synthetic
cuuuucucugcuuggaggag

SEQ ID NO: 2088 - RNA, 20 nt, Artificial Sequence
  Synthetic
gaggagaagaagucuauuuc

SEQ ID NO: 2089 - RNA, 20 nt, Artificial Sequence
  Synthetic
gagaagaagucuauuucaug

SEQ ID NO: 2090 - RNA, 20 nt, Artificial Sequence
  Synthetic
aaagucagcuguuaaaauuc

SEQ ID NO: 2091 - RNA, 20 nt, Artificial Sequence
  Synthetic
guuaaaauuccagggugugc

SEQ ID NO: 2092 - RNA, 20 nt, Artificial Sequence
  Synthetic
gugugcauggguuuuccuuc

SEQ ID NO: 2093 - RNA, 20 nt, Artificial Sequence
  Synthetic
uucacgaaggccuuuauuua

SEQ ID NO: 2094 - RNA, 20 nt, Artificial Sequence
  Synthetic
gccuuuauuuaaugggaaua

SEQ ID NO: 2095 - RNA, 20 nt, Artificial Sequence
  Synthetic
auuuaaugggaauauaggaa

SEQ ID NO: 2096 - RNA, 20 nt, Artificial Sequence
  Synthetic
auuuccuaggccguuaauuc

SEQ ID NO: 2097 - RNA, 20 nt, Artificial Sequence
  Synthetic
ccuaggccguuaauucacgg

SEQ ID NO: 2098 - RNA, 20 nt, Artificial Sequence
  Synthetic
uuaauucacggaagaaguga

SEQ ID NO: 2099 - RNA, 20 nt, Artificial Sequence
  Synthetic
agucuuuucuuucaugucuu

SEQ ID NO: 2100 - RNA, 20 nt, Artificial Sequence
  Synthetic
ggcaacuacucagcccugug

SEQ ID NO: 2101 - RNA, 20 nt, Artificial Sequence
  Synthetic
acuuggcuuaugcaagacgg

SEQ ID NO: 2102 - RNA, 20 nt, Artificial Sequence
  Synthetic
augcaagacggucgaaaacc

SEQ ID NO: 2103 - RNA, 20 nt, Artificial Sequence
  Synthetic
acggucgaaaaccuuggaau

SEQ ID NO: 2104 - RNA, 20 nt, Artificial Sequence
  Synthetic
cauugguuggcugugcgacc

SEQ ID NO: 2105 - RNA, 20 nt, Artificial Sequence
  Synthetic
gggcaagugucucuccuucc

SEQ ID NO: 2106 - RNA, 20 nt, Artificial Sequence
  Synthetic
ccuugcagcucucguguucu

SEQ ID NO: 2107 - RNA, 20 nt, Artificial Sequence
  Synthetic
acacuucccugugauucucu

SEQ ID NO: 2108 - RNA, 20 nt, Artificial Sequence
  Synthetic
acuucccugugauucucugu

SEQ ID NO: 2109 - RNA, 20 nt, Artificial Sequence
  Synthetic
auucucugugaggggggaug

SEQ ID NO: 2110 - RNA, 20 nt, Artificial Sequence
  Synthetic
ucucugugaggggggauguu

SEQ ID NO: 2111 - RNA, 20 nt, Artificial Sequence
  Synthetic
ucugugaggggggauguuga

SEQ ID NO: 2112 - RNA, 20 nt, Artificial Sequence
  Synthetic
aggggggauguugagagggg

SEQ ID NO: 2113 - RNA, 20 nt, Artificial Sequence
  Synthetic
auguugagaggggaaggagg

SEQ ID NO: 2114 - RNA, 20 nt, Artificial Sequence
  Synthetic
gagaggggaaggaggcagag

SEQ ID NO: 2115 - RNA, 20 nt, Artificial Sequence
  Synthetic
aggaggcagagcuggagcag

SEQ ID NO: 2116 - RNA, 20 nt, Artificial Sequence
  Synthetic
gagcuggagcagcugagcca

SEQ ID NO: 2117 - RNA, 20 nt, Artificial Sequence
  Synthetic
gcagcugagccacaggggag

SEQ ID NO: 2118 - RNA, 20 nt, Artificial Sequence
  Synthetic
gcugagccacaggggaggug

SEQ ID NO: 2119 - RNA, 20 nt, Artificial Sequence
  Synthetic
acaggggagguggaggggga

SEQ ID NO: 2120 - RNA, 20 nt, Artificial Sequence
  Synthetic
gagggggacaggaaggcagg

SEQ ID NO: 2121 - RNA, 20 nt, Artificial Sequence
  Synthetic
gacaggaaggcaggcagaag

SEQ ID NO: 2122 - RNA, 20 nt, Artificial Sequence
  Synthetic
ucacugaucacgucagacuc

SEQ ID NO: 2123 - RNA, 20 nt, Artificial Sequence
  Synthetic
gaucacgucagacuccagga

SEQ ID NO: 2124 - RNA, 20 nt, Artificial Sequence
  Synthetic
ucacgucagacuccaggacc

SEQ ID NO: 2125 - RNA, 20 nt, Artificial Sequence
  Synthetic
gaccgagagccacaaugcuu

SEQ ID NO: 2126 - RNA, 20 nt, Artificial Sequence
  Synthetic
caaugcuucaggaaagcuca

SEQ ID NO: 2127 - RNA, 20 nt, Artificial Sequence
  Synthetic
ggcauuugccaauaaccaaa

SEQ ID NO: 2128 - RNA, 20 nt, Artificial Sequence
  Synthetic
gccaauaaccaaaaagaaug

SEQ ID NO: 2129 - RNA, 20 nt, Artificial Sequence
  Synthetic
uuuugccuggcauucaaaaa

SEQ ID NO: 2130 - RNA, 20 nt, Artificial Sequence
  Synthetic
cuggcauucaaaaacugggc

SEQ ID NO: 2131 - RNA, 20 nt, Artificial Sequence
  Synthetic
caaaaacugggccagagcaa

SEQ ID NO: 2132 - RNA, 20 nt, Artificial Sequence
  Synthetic
ccagagcaaguggaaaaugc

SEQ ID NO: 2133 - RNA, 20 nt, Artificial Sequence
  Synthetic
cagcagugacugcugacagc

SEQ ID NO: 2134 - RNA, 20 nt, Artificial Sequence
  Synthetic
gcacggagugaccugcagcg

SEQ ID NO: 2135 - RNA, 20 nt, Artificial Sequence
  Synthetic
gagugaccugcagcgcaggg

SEQ ID NO: 2136 - RNA, 20 nt, Artificial Sequence
  Synthetic
ugaccugcagcgcaggggag

SEQ ID NO: 2137 - RNA, 20 nt, Artificial Sequence
  Synthetic
ccugcagcgcaggggaggag

SEQ ID NO: 2138 - RNA, 20 nt, Artificial Sequence
  Synthetic
gcgcaggggaggagaagaaa

SEQ ID NO: 2139 - RNA, 20 nt, Artificial Sequence
  Synthetic
gcaggggaggagaagaaaaa

SEQ ID NO: 2140 - RNA, 20 nt, Artificial Sequence
  Synthetic
aggggaggagaagaaaaaga

SEQ ID NO: 2141 - RNA, 20 nt, Artificial Sequence
  Synthetic
gaaaaagagagggauagugu

SEQ ID NO: 2142 - RNA, 20 nt, Artificial Sequence
  Synthetic
gagagggauaguguaugagc

SEQ ID NO: 2143 - RNA, 20 nt, Artificial Sequence
  Synthetic
caagaaagacagauucauuc

SEQ ID NO: 2144 - RNA, 20 nt, Artificial Sequence
  Synthetic
gacagauucauucaagggca

SEQ ID NO: 2145 - RNA, 20 nt, Artificial Sequence
  Synthetic
agggcagugggaauugacca

SEQ ID NO: 2146 - RNA, 20 nt, Artificial Sequence
  Synthetic
ggauuauaguccacgugauc

SEQ ID NO: 2147 - RNA, 20 nt, Artificial Sequence
  Synthetic
guccacgugauccuggguuc

SEQ ID NO: 2148 - RNA, 20 nt, Artificial Sequence
  Synthetic
ugauccuggguucuaggagg

SEQ ID NO: 2149 - RNA, 20 nt, Artificial Sequence
  Synthetic
cuaggaggcagggcuauauu

SEQ ID NO: 2150 - RNA, 20 nt, Artificial Sequence
  Synthetic
uggggggaaaaaaucaguuc

SEQ ID NO: 2151 - RNA, 20 nt, Artificial Sequence
  Synthetic
aaaaaucaguucaagggaag

SEQ ID NO: 2152 - RNA, 20 nt, Artificial Sequence
  Synthetic
cuauauuuuuccuuuacaag

SEQ ID NO: 2153 - RNA, 20 nt, Artificial Sequence
  Synthetic
ccuuuacaagcugaguaauu

SEQ ID NO: 2154 - RNA, 20 nt, Artificial Sequence
  Synthetic
agcaagucacaagguaguaa

SEQ ID NO: 2155 - RNA, 20 nt, Artificial Sequence
  Synthetic
auuacuuaguuucuccuuau

SEQ ID NO: 2156 - RNA, 20 nt, Artificial Sequence
  Synthetic
auuaggaacucuuuuucucu

SEQ ID NO: 2157 - RNA, 20 nt, Artificial Sequence
  Synthetic
cucuguggaguuagcagcac

SEQ ID NO: 2158 - RNA, 20 nt, Artificial Sequence
  Synthetic
ggcaaucccguuucuuuuaa

SEQ ID NO: 2159 - RNA, 20 nt, Artificial Sequence
  Synthetic
aucccguuucuuuuaacagg

SEQ ID NO: 2160 - RNA, 20 nt, Artificial Sequence
  Synthetic
aacaggaagaaaacauuccu

SEQ ID NO: 2161 - RNA, 20 nt, Artificial Sequence
  Synthetic
cugacuauaugauugguuuu

SEQ ID NO: 2162 - RNA, 20 nt, Artificial Sequence
  Synthetic
gcgauguuuacuaucugauu

SEQ ID NO: 2163 - RNA, 20 nt, Artificial Sequence
  Synthetic
uuuacuaucugauucagaaa

SEQ ID NO: 2164 - RNA, 20 nt, Artificial Sequence
  Synthetic
cucaaguucaggcuuaacug

SEQ ID NO: 2165 - RNA, 20 nt, Artificial Sequence
  Synthetic
aacugcagaaccaaucaaau

SEQ ID NO: 2166 - RNA, 20 nt, Artificial Sequence
  Synthetic
cagaaccaaucaaauaagaa

SEQ ID NO: 2167 - RNA, 20 nt, Artificial Sequence
  Synthetic
ucaaauaagaauagaaucuu

SEQ ID NO: 2168 - RNA, 20 nt, Artificial Sequence
  Synthetic
gcaaacuguguuucuccacu

SEQ ID NO: 2169 - RNA, 20 nt, Artificial Sequence
  Synthetic
uguguuucuccacucuggag

SEQ ID NO: 2170 - RNA, 20 nt, Artificial Sequence
  Synthetic
cacucuggaggugagucugc

SEQ ID NO: 2171 - RNA, 20 nt, Artificial Sequence
  Synthetic
ggugagucugccagggcagu

SEQ ID NO: 2172 - RNA, 20 nt, Artificial Sequence
  Synthetic
uugcuuuuuguuuuuucucu

SEQ ID NO: 2173 - RNA, 20 nt, Artificial Sequence
  Synthetic
uuggguuuauuaauguaaag

SEQ ID NO: 2174 - RNA, 20 nt, Artificial Sequence
  Synthetic
gggauuauuaaccuacaguc

SEQ ID NO: 2175 - RNA, 20 nt, Artificial Sequence
  Synthetic
accuacaguccagaaagccu

SEQ ID NO: 2176 - RNA, 20 nt, Artificial Sequence
  Synthetic
aguccagaaagccugugaau

SEQ ID NO: 2177 - RNA, 20 nt, Artificial Sequence
  Synthetic
cagaaagccugugaauuuga

SEQ ID NO: 2178 - RNA, 20 nt, Artificial Sequence
  Synthetic
gaaagccugugaauuugaau

SEQ ID NO: 2179 - RNA, 20 nt, Artificial Sequence
  Synthetic
auuuaacauuuuauuccauu

SEQ ID NO: 2180 - RNA, 20 nt, Artificial Sequence
  Synthetic
acauuuuauuccauugcgaa

SEQ ID NO: 2181 - RNA, 20 nt, Artificial Sequence
  Synthetic
ugugauuuugucauuaccaa

SEQ ID NO: 2182 - RNA, 20 nt, Artificial Sequence
  Synthetic
uuguugcagauacguuguaa

SEQ ID NO: 2183 - RNA, 20 nt, Artificial Sequence
  Synthetic
uauuuauacucaaaacuacu

SEQ ID NO: 2184 - RNA, 20 nt, Artificial Sequence
  Synthetic
cuuugaaauuagaccuccug

SEQ ID NO: 2185 - RNA, 20 nt, Artificial Sequence
  Synthetic
guaaucuauauuuuauauau

SEQ ID NO: 2186 - RNA, 20 nt, Artificial Sequence
  Synthetic
auauauuugaaaacaucuuu

SEQ ID NO: 2187 - RNA, 20 nt, Artificial Sequence
  Synthetic
auauuugaaaacaucuuucu

SEQ ID NO: 2188 - RNA, 20 nt, Artificial Sequence
  Synthetic
uuugaaaacaucuuucugag

SEQ ID NO: 2189 - RNA, 20 nt, Artificial Sequence
  Synthetic
gaguuccccagauuucacca

SEQ ID NO: 2190 - RNA, 20 nt, Artificial Sequence
  Synthetic
guucuuggcaugcacacaca

SEQ ID NO: 2191 - RNA, 20 nt, Artificial Sequence
  Synthetic
ggcaugcacacacacagagu

SEQ ID NO: 2192 - RNA, 20 nt, Artificial Sequence
  Synthetic
acacagaguaagaacugauu

SEQ ID NO: 2193 - RNA, 20 nt, Artificial Sequence
  Synthetic
gcuaacauugacauuggugc

SEQ ID NO: 2194 - RNA, 20 nt, Artificial Sequence
  Synthetic
uuggugccugagaugcaaga

SEQ ID NO: 2195 - RNA, 20 nt, Artificial Sequence
  Synthetic
cugagaugcaagacugaaau

SEQ ID NO: 2196 - RNA, 20 nt, Artificial Sequence
  Synthetic
auacacaguuguuuuaaagc

SEQ ID NO: 2197 - RNA, 20 nt, Artificial Sequence
  Synthetic
uacacaguuguuuuaaagcu

SEQ ID NO: 2198 - RNA, 20 nt, Artificial Sequence
  Synthetic
caguuguuuuaaagcuaggg

SEQ ID NO: 2199 - RNA, 20 nt, Artificial Sequence
  Synthetic
guuguuuuaaagcuaggggu

SEQ ID NO: 2200 - RNA, 20 nt, Artificial Sequence
  Synthetic
uuguuuuaaagcuaggggug

SEQ ID NO: 2201 - RNA, 20 nt, Artificial Sequence
  Synthetic
uguuuuaaagcuagggguga

SEQ ID NO: 2202 - RNA, 20 nt, Artificial Sequence
  Synthetic
guuuuaaagcuaggggugag

SEQ ID NO: 2203 - RNA, 20 nt, Artificial Sequence
  Synthetic
uuuuaaagcuaggggugagg

SEQ ID NO: 2204 - RNA, 20 nt, Artificial Sequence
  Synthetic
uuuaaagcuaggggugaggg

SEQ ID NO: 2205 - RNA, 20 nt, Artificial Sequence
  Synthetic
ggggaaaucugccgcuucua

SEQ ID NO: 2206 - RNA, 20 nt, Artificial Sequence
  Synthetic
cuucuauaggaaugcucucc

SEQ ID NO: 2207 - RNA, 20 nt, Artificial Sequence
  Synthetic
augcucucccuggagccugg

SEQ ID NO: 2208 - RNA, 20 nt, Artificial Sequence
  Synthetic
ucugucccugcuacgucuua

SEQ ID NO: 2209 - RNA, 20 nt, Artificial Sequence
  Synthetic
cuacgucuuaaaggacuugu

SEQ ID NO: 2210 - RNA, 20 nt, Artificial Sequence
  Synthetic
uggcacagugcagguucuca

SEQ ID NO: 2211 - RNA, 20 nt, Artificial Sequence
  Synthetic
gcagguucucaaugaguuug

SEQ ID NO: 2212 - RNA, 20 nt, Artificial Sequence
  Synthetic
guucucaaugaguuugcaga

SEQ ID NO: 2213 - RNA, 20 nt, Artificial Sequence
  Synthetic
ucaaugaguuugcagaguga

SEQ ID NO: 2214 - RNA, 20 nt, Artificial Sequence
  Synthetic
gagugaauggaaauauaaac

SEQ ID NO: 2215 - RNA, 20 nt, Artificial Sequence
  Synthetic
aaacuagaaauauauccuug

SEQ ID NO: 2216 - RNA, 20 nt, Artificial Sequence
  Synthetic
guguguguguguaaaaccag

SEQ ID NO: 2217 - RNA, 20 nt, Artificial Sequence
  Synthetic
uguaaaaccagguggagaua

SEQ ID NO: 2218 - RNA, 20 nt, Artificial Sequence
  Synthetic
uggagauauaggaacuauua

SEQ ID NO: 2219 - RNA, 20 nt, Artificial Sequence
  Synthetic
auaggaacuauuauuggggu

SEQ ID NO: 2220 - RNA, 20 nt, Artificial Sequence
  Synthetic
uugggguaugggugcauaaa

SEQ ID NO: 2221 - RNA, 20 nt, Artificial Sequence
  Synthetic
auugggauguucuuuuuaaa

SEQ ID NO: 2222 - RNA, 20 nt, Artificial Sequence
  Synthetic
aagaaacuccaaacagacuu

SEQ ID NO: 2223 - RNA, 20 nt, Artificial Sequence
  Synthetic
cuucuggaagguuauuuucu

SEQ ID NO: 2224 - RNA, 20 nt, Artificial Sequence
  Synthetic
cuaagaaucuugcuggcagc

SEQ ID NO: 2225 - RNA, 20 nt, Artificial Sequence
  Synthetic
ggccaccucugucuuccccc

SEQ ID NO: 2226 - RNA, 20 nt, Artificial Sequence
  Synthetic
caccucugucuucccccaug

SEQ ID NO: 2227 - RNA, 20 nt, Artificial Sequence
  Synthetic
cccaguauauauaaaccucu

SEQ ID NO: 2228 - RNA, 20 nt, Artificial Sequence
  Synthetic
uauauaaaccucucuggagc

SEQ ID NO: 2229 - RNA, 20 nt, Artificial Sequence
  Synthetic
aaccucucuggagcucgggc

SEQ ID NO: 2230 - RNA, 20 nt, Artificial Sequence
  Synthetic
ccaggcaccucucagcacag

SEQ ID NO: 2231 - RNA, 20 nt, Artificial Sequence
  Synthetic
cucagcacagcagagcuuuc

SEQ ID NO: 2232 - RNA, 20 nt, Artificial Sequence
  Synthetic
cagcacagcagagcuuucca

SEQ ID NO: 2233 - RNA, 20 nt, Artificial Sequence
  Synthetic
agcacagcagagcuuuccag

SEQ ID NO: 2234 - RNA, 20 nt, Artificial Sequence
  Synthetic
agcuggagaggaaaccucug

SEQ ID NO: 2235 - RNA, 20 nt, Artificial Sequence
  Synthetic
gcagggcucccccagcugga

SEQ ID NO: 2236 - RNA, 20 nt, Artificial Sequence
  Synthetic
uugcagggcucccccagcug

SEQ ID NO: 2237 - RNA, 20 nt, Artificial Sequence
  Synthetic
ugcuugcagggcucccccag

SEQ ID NO: 2238 - RNA, 20 nt, Artificial Sequence
  Synthetic
cccaggaccccgggugcuug

SEQ ID NO: 2239 - RNA, 20 nt, Artificial Sequence
  Synthetic
ugcucaggacacccaggacc

SEQ ID NO: 2240 - RNA, 20 nt, Artificial Sequence
  Synthetic
ggcagguugcucaggacacc

SEQ ID NO: 2241 - RNA, 20 nt, Artificial Sequence
  Synthetic
gcacgggcuggcagguugcu

SEQ ID NO: 2242 - RNA, 20 nt, Artificial Sequence
  Synthetic
auaacaaaacaaccaguggc

SEQ ID NO: 2243 - RNA, 20 nt, Artificial Sequence
  Synthetic
uagaaagcaacaggucccua

SEQ ID NO: 2244 - RNA, 20 nt, Artificial Sequence
  Synthetic
aauagaaagcaacagguccc

SEQ ID NO: 2245 - RNA, 20 nt, Artificial Sequence
  Synthetic
augaacgagucacacagaaa

SEQ ID NO: 2246 - RNA, 20 nt, Artificial Sequence
  Synthetic
ggaugaaugaacgagucaca

SEQ ID NO: 2247 - RNA, 20 nt, Artificial Sequence
  Synthetic
augaaugccuggaugaauga

SEQ ID NO: 2248 - RNA, 20 nt, Artificial Sequence
  Synthetic
gucaaugaaugccuggauga

SEQ ID NO: 2249 - RNA, 20 nt, Artificial Sequence
  Synthetic
aauugucaaugaaugccugg

SEQ ID NO: 2250 - RNA, 20 nt, Artificial Sequence
  Synthetic
aauaaauugucaaugaaugc

SEQ ID NO: 2251 - RNA, 20 nt, Artificial Sequence
  Synthetic
aaguacucaauaaauuguca

SEQ ID NO: 2252 - RNA, 20 nt, Artificial Sequence
  Synthetic
aacugucaccuccacgaagg

SEQ ID NO: 2253 - RNA, 20 nt, Artificial Sequence
  Synthetic
caugagaaacugucaccucc

SEQ ID NO: 2254 - RNA, 20 nt, Artificial Sequence
  Synthetic
uucuucugcacgucuuccau

SEQ ID NO: 2255 - RNA, 20 nt, Artificial Sequence
  Synthetic
uuuucuucugcacgucuucc

SEQ ID NO: 2256 - RNA, 20 nt, Artificial Sequence
  Synthetic
uuauuuccuuucuuucagca

SEQ ID NO: 2257 - RNA, 20 nt, Artificial Sequence
  Synthetic
gcuagggagguggccuuguu

SEQ ID NO: 2258 - RNA, 20 nt, Artificial Sequence
  Synthetic
auggaggcagcagggggcgc

SEQ ID NO: 2259 - RNA, 20 nt, Artificial Sequence
  Synthetic
uccgggcacgauggaggcag

SEQ ID NO: 2260 - RNA, 20 nt, Artificial Sequence
  Synthetic
cuugggggccuccgggcacg

SEQ ID NO: 2261 - RNA, 20 nt, Artificial Sequence
  Synthetic
agacucgggcuugggggccu

SEQ ID NO: 2262 - RNA, 20 nt, Artificial Sequence
  Synthetic
gaggcuuggaagacucgggc

SEQ ID NO: 2263 - RNA, 20 nt, Artificial Sequence
  Synthetic
gaggaggaggcuuggaagac

SEQ ID NO: 2264 - RNA, 20 nt, Artificial Sequence
  Synthetic
ugacugauggaggaggaggc

SEQ ID NO: 2265 - RNA, 20 nt, Artificial Sequence
  Synthetic
cagcgcugugacugauggag

SEQ ID NO: 2266 - RNA, 20 nt, Artificial Sequence
  Synthetic
cugcagcgcugugacugaug

SEQ ID NO: 2267 - RNA, 20 nt, Artificial Sequence
  Synthetic
cagcugcagcgcugugacug

SEQ ID NO: 2268 - RNA, 20 nt, Artificial Sequence
  Synthetic
accaggacgauucacgggaa

SEQ ID NO: 2269 - RNA, 20 nt, Artificial Sequence
  Synthetic
gaugcaccaggacgauucac

SEQ ID NO: 2270 - RNA, 20 nt, Artificial Sequence
  Synthetic
agaugcaccaggacgauuca

SEQ ID NO: 2271 - RNA, 20 nt, Artificial Sequence
  Synthetic
cagaugcaccaggacgauuc

SEQ ID NO: 2272 - RNA, 20 nt, Artificial Sequence
  Synthetic
agucuccagcucagaugcac

SEQ ID NO: 2273 - RNA, 20 nt, Artificial Sequence
  Synthetic
ccuuucuggagccuggagcc

SEQ ID NO: 2274 - RNA, 20 nt, Artificial Sequence
  Synthetic
cuccauuuccuuucuggagc

SEQ ID NO: 2275 - RNA, 20 nt, Artificial Sequence
  Synthetic
uuucccucuccauuuccuuu

SEQ ID NO: 2276 - RNA, 20 nt, Artificial Sequence
  Synthetic
guggaggccccuuucccucu

SEQ ID NO: 2277 - RNA, 20 nt, Artificial Sequence
  Synthetic
acguggaggccccuuucccu

SEQ ID NO: 2278 - RNA, 20 nt, Artificial Sequence
  Synthetic
cuccuggaauucuccuggac

SEQ ID NO: 2279 - RNA, 20 nt, Artificial Sequence
  Synthetic
ccccaccuccuggaauucuc

SEQ ID NO: 2280 - RNA, 20 nt, Artificial Sequence
  Synthetic
cucccugcaguccccaccuc

SEQ ID NO: 2281 - RNA, 20 nt, Artificial Sequence
  Synthetic
ccgugaacaacacugaacau

SEQ ID NO: 2282 - RNA, 20 nt, Artificial Sequence
  Synthetic
ucccagccccgugaacaaca

SEQ ID NO: 2283 - RNA, 20 nt, Artificial Sequence
  Synthetic
aacggaaaacucccagcccc

SEQ ID NO: 2284 - RNA, 20 nt, Artificial Sequence
  Synthetic
aaaaaggcucacaggaagca

SEQ ID NO: 2285 - RNA, 20 nt, Artificial Sequence
  Synthetic
agaaaagauaaaaaggcuca

SEQ ID NO: 2286 - RNA, 20 nt, Artificial Sequence
  Synthetic
gacuucuucuccuccaagca

SEQ ID NO: 2287 - RNA, 20 nt, Artificial Sequence
  Synthetic
uagacuucuucuccuccaag

SEQ ID NO: 2288 - RNA, 20 nt, Artificial Sequence
  Synthetic
uuaugaaacugcaucccuuc

SEQ ID NO: 2289 - RNA, 20 nt, Artificial Sequence
  Synthetic
gaauuuuaacagcugacuuu

SEQ ID NO: 2290 - RNA, 20 nt, Artificial Sequence
  Synthetic
aaggaaaacccaugcacacc

SEQ ID NO: 2291 - RNA, 20 nt, Artificial Sequence
  Synthetic
auuaaauaaaggccuucgug

SEQ ID NO: 2292 - RNA, 20 nt, Artificial Sequence
  Synthetic
cccauuaaauaaaggccuuc

SEQ ID NO: 2293 - RNA, 20 nt, Artificial Sequence
  Synthetic
gugaauuaacggccuaggaa

SEQ ID NO: 2294 - RNA, 20 nt, Artificial Sequence
  Synthetic
ucuuccgugaauuaacggcc

SEQ ID NO: 2295 - RNA, 20 nt, Artificial Sequence
  Synthetic
agacuccagucacuucuucc

SEQ ID NO: 2296 - RNA, 20 nt, Artificial Sequence
  Synthetic
uaguugcccagaagacauga

SEQ ID NO: 2297 - RNA, 20 nt, Artificial Sequence
  Synthetic
ugaguaguugcccagaagac

SEQ ID NO: 2298 - RNA, 20 nt, Artificial Sequence
  Synthetic
cacagggcugaguaguugcc

SEQ ID NO: 2299 - RNA, 20 nt, Artificial Sequence
  Synthetic
aagccaaguccaccacaggg

SEQ ID NO: 2300 - RNA, 20 nt, Artificial Sequence
  Synthetic
ugcauaagccaaguccacca

SEQ ID NO: 2301 - RNA, 20 nt, Artificial Sequence
  Synthetic
uggcagaaccagaaagaaaa

SEQ ID NO: 2302 - RNA, 20 nt, Artificial Sequence
  Synthetic
caaccaauggcagaaccaga

SEQ ID NO: 2303 - RNA, 20 nt, Artificial Sequence
  Synthetic
cagccaaccaauggcagaac

SEQ ID NO: 2304 - RNA, 20 nt, Artificial Sequence
  Synthetic
gucgcacagccaaccaaugg

SEQ ID NO: 2305 - RNA, 20 nt, Artificial Sequence
  Synthetic
aagacuauggcccagggaag

SEQ ID NO: 2306 - RNA, 20 nt, Artificial Sequence
  Synthetic
gagaagacuauggcccaggg

SEQ ID NO: 2307 - RNA, 20 nt, Artificial Sequence
  Synthetic
uagcagagaagacuauggcc

SEQ ID NO: 2308 - RNA, 20 nt, Artificial Sequence
  Synthetic
cugcaagggucuuuauagca

SEQ ID NO: 2309 - RNA, 20 nt, Artificial Sequence
  Synthetic
agcugcaagggucuuuauag

SEQ ID NO: 2310 - RNA, 20 nt, Artificial Sequence
  Synthetic
ucacagaacacgagagcugc

SEQ ID NO: 2311 - RNA, 20 nt, Artificial Sequence
  Synthetic
gggaaguguucacagaacac

SEQ ID NO: 2312 - RNA, 20 nt, Artificial Sequence
  Synthetic
cagggaaguguucacagaac

SEQ ID NO: 2313 - RNA, 20 nt, Artificial Sequence
  Synthetic
gaaucacagggaaguguuca

SEQ ID NO: 2314 - RNA, 20 nt, Artificial Sequence
  Synthetic
uccccccucacagagaauca

SEQ ID NO: 2315 - RNA, 20 nt, Artificial Sequence
  Synthetic
ucucaacauccccccucaca

SEQ ID NO: 2316 - RNA, 20 nt, Artificial Sequence
  Synthetic
ccucucaacauccccccuca

SEQ ID NO: 2317 - RNA, 20 nt, Artificial Sequence
  Synthetic
gacgugaucagugaggacug

SEQ ID NO: 2318 - RNA, 20 nt, Artificial Sequence
  Synthetic
uggagucugacgugaucagu

SEQ ID NO: 2319 - RNA, 20 nt, Artificial Sequence
  Synthetic
ccuggagucugacgugauca

SEQ ID NO: 2320 - RNA, 20 nt, Artificial Sequence
  Synthetic
aagcauuguggcucucgguc

SEQ ID NO: 2321 - RNA, 20 nt, Artificial Sequence
  Synthetic
guuggguucauugagcuuuc

SEQ ID NO: 2322 - RNA, 20 nt, Artificial Sequence
  Synthetic
aaauguggcuguuggguuca

SEQ ID NO: 2323 - RNA, 20 nt, Artificial Sequence
  Synthetic
agggaaggaaaauguggcug

SEQ ID NO: 2324 - RNA, 20 nt, Artificial Sequence
  Synthetic
gccauugucuaugcuuaggg

SEQ ID NO: 2325 - RNA, 20 nt, Artificial Sequence
  Synthetic
caaaugccauugucuaugcu

SEQ ID NO: 2326 - RNA, 20 nt, Artificial Sequence
  Synthetic
cacuugcucuggcccaguuu

SEQ ID NO: 2327 - RNA, 20 nt, Artificial Sequence
  Synthetic
ugcguggggugcuggucagg

SEQ ID NO: 2328 - RNA, 20 nt, Artificial Sequence
  Synthetic
gagcugcguggggugcuggu

SEQ ID NO: 2329 - RNA, 20 nt, Artificial Sequence
  Synthetic
agcagucacugcugagcugc

SEQ ID NO: 2330 - RNA, 20 nt, Artificial Sequence
  Synthetic
cgugcugucagcagucacug

SEQ ID NO: 2331 - RNA, 20 nt, Artificial Sequence
  Synthetic
ucaauucccacugcccuuga

SEQ ID NO: 2332 - RNA, 20 nt, Artificial Sequence
  Synthetic
guggucaauucccacugccc

SEQ ID NO: 2333 - RNA, 20 nt, Artificial Sequence
  Synthetic
cuccuagaacccaggaucac

SEQ ID NO: 2334 - RNA, 20 nt, Artificial Sequence
  Synthetic
uagcccugccuccuagaacc

SEQ ID NO: 2335 - RNA, 20 nt, Artificial Sequence
  Synthetic
cacaauauagcccugccucc

SEQ ID NO: 2336 - RNA, 20 nt, Artificial Sequence
  Synthetic
aucaggucucccgacuuccc

SEQ ID NO: 2337 - RNA, 20 nt, Artificial Sequence
  Synthetic
guaaaggaaaaauauaguau

SEQ ID NO: 2338 - RNA, 20 nt, Artificial Sequence
  Synthetic
ucagaauuacucagcuugua

SEQ ID NO: 2339 - RNA, 20 nt, Artificial Sequence
  Synthetic
uuacuaccuugugacuugcu

SEQ ID NO: 2340 - RNA, 20 nt, Artificial Sequence
  Synthetic
gaaaaagaguuccuaauaag

SEQ ID NO: 2341 - RNA, 20 nt, Artificial Sequence
  Synthetic
agagaaaaagaguuccuaau

SEQ ID NO: 2342 - RNA, 20 nt, Artificial Sequence
  Synthetic
cugcuaacuccacagagaaa

SEQ ID NO: 2343 - RNA, 20 nt, Artificial Sequence
  Synthetic
cuugugcugcuaacuccaca

SEQ ID NO: 2344 - RNA, 20 nt, Artificial Sequence
  Synthetic
cccuugugcugcuaacucca

SEQ ID NO: 2345 - RNA, 20 nt, Artificial Sequence
  Synthetic
uuuucuuccuguuaaaagaa

SEQ ID NO: 2346 - RNA, 20 nt, Artificial Sequence
  Synthetic
gaauguuuucuuccuguuaa

SEQ ID NO: 2347 - RNA, 20 nt, Artificial Sequence
  Synthetic
aaucuguuuggcuuuacucu

SEQ ID NO: 2348 - RNA, 20 nt, Artificial Sequence
  Synthetic
auagucagcaagaccuaggc

SEQ ID NO: 2349 - RNA, 20 nt, Artificial Sequence
  Synthetic
gaaucagauaguaaacaucg

SEQ ID NO: 2350 - RNA, 20 nt, Artificial Sequence
  Synthetic
aaggguacuagucucauuuu

SEQ ID NO: 2351 - RNA, 20 nt, Artificial Sequence
  Synthetic
uguuuguuuacagcugacca

SEQ ID NO: 2352 - RNA, 20 nt, Artificial Sequence
  Synthetic
ugaacuugagacauuuacaa

SEQ ID NO: 2353 - RNA, 20 nt, Artificial Sequence
  Synthetic
uucugcaguuaagccugaac

SEQ ID NO: 2354 - RNA, 20 nt, Artificial Sequence
  Synthetic
gauugguucugcaguuaagc

SEQ ID NO: 2355 - RNA, 20 nt, Artificial Sequence
  Synthetic
gcagacucaccuccagagug

SEQ ID NO: 2356 - RNA, 20 nt, Artificial Sequence
  Synthetic
cuggcagacucaccuccaga

SEQ ID NO: 2357 - RNA, 20 nt, Artificial Sequence
  Synthetic
ugcccuggcagacucaccuc

SEQ ID NO: 2358 - RNA, 20 nt, Artificial Sequence
  Synthetic
caacaacagugucaauacuu

SEQ ID NO: 2359 - RNA, 20 nt, Artificial Sequence
  Synthetic
acuugaaauaaugauugccu

SEQ ID NO: 2360 - RNA, 20 nt, Artificial Sequence
  Synthetic
cagaaguaacuuuaagccac

SEQ ID NO: 2361 - RNA, 20 nt, Artificial Sequence
  Synthetic
aauaaauauaccaaaacugu

SEQ ID NO: 2362 - RNA, 20 nt, Artificial Sequence
  Synthetic
uuuacauuaauaaacccaaa

SEQ ID NO: 2363 - RNA, 20 nt, Artificial Sequence
  Synthetic
gcuuuacauuaauaaaccca

SEQ ID NO: 2364 - RNA, 20 nt, Artificial Sequence
  Synthetic
cauucaaauucacaggcuuu

SEQ ID NO: 2365 - RNA, 20 nt, Artificial Sequence
  Synthetic
aauaaaauguuaaauuuagu

SEQ ID NO: 2366 - RNA, 20 nt, Artificial Sequence
  Synthetic
aguuuauggcucuauucgca

SEQ ID NO: 2367 - RNA, 20 nt, Artificial Sequence
  Synthetic
cagguacuguuauuaccacu

SEQ ID NO: 2368 - RNA, 20 nt, Artificial Sequence
  Synthetic
ggucuaauuucaaaguaguu

SEQ ID NO: 2369 - RNA, 20 nt, Artificial Sequence
  Synthetic
auguuaaaaacaagauccag

SEQ ID NO: 2370 - RNA, 20 nt, Artificial Sequence
  Synthetic
uacaaaggaaacaaaugaua

SEQ ID NO: 2371 - RNA, 20 nt, Artificial Sequence
  Synthetic
uauauaaaauauagauuaca

SEQ ID NO: 2372 - RNA, 20 nt, Artificial Sequence
  Synthetic
gaaaucuggggaacucuucu

SEQ ID NO: 2373 - RNA, 20 nt, Artificial Sequence
  Synthetic
aagaaccucauuggugaaau

SEQ ID NO: 2374 - RNA, 20 nt, Artificial Sequence
  Synthetic
gcaugccaagaaccucauug

SEQ ID NO: 2375 - RNA, 20 nt, Artificial Sequence
  Synthetic
acucugugugugugcaugcc

SEQ ID NO: 2376 - RNA, 20 nt, Artificial Sequence
  Synthetic
aaacaacuguguaucuuugg

SEQ ID NO: 2377 - RNA, 20 nt, Artificial Sequence
  Synthetic
uuuaaaacaacuguguaucu

SEQ ID NO: 2378 - RNA, 20 nt, Artificial Sequence
  Synthetic
cuccagggagagcauuccua

SEQ ID NO: 2379 - RNA, 20 nt, Artificial Sequence
  Synthetic
gcacccuaccaggcuccagg

SEQ ID NO: 2380 - RNA, 20 nt, Artificial Sequence
  Synthetic
gacagcacccuaccaggcuc

SEQ ID NO: 2381 - RNA, 20 nt, Artificial Sequence
  Synthetic
auaacagccagccagaacac

SEQ ID NO: 2382 - RNA, 20 nt, Artificial Sequence
  Synthetic
agagaaaaauaacagccagc

SEQ ID NO: 2383 - RNA, 20 nt, Artificial Sequence
  Synthetic
uuuaagacguagcagggaca

SEQ ID NO: 2384 - RNA, 20 nt, Artificial Sequence
  Synthetic
ccuuuaagacguagcaggga

SEQ ID NO: 2385 - RNA, 20 nt, Artificial Sequence
  Synthetic
acaaguccuuuaagacguag

SEQ ID NO: 2386 - RNA, 20 nt, Artificial Sequence
  Synthetic
gccaggcacuaugcuaggaa

SEQ ID NO: 2387 - RNA, 20 nt, Artificial Sequence
  Synthetic
cacugugccaggcacuaugc

SEQ ID NO: 2388 - RNA, 20 nt, Artificial Sequence
  Synthetic
auucacucugcaaacucauu

SEQ ID NO: 2389 - RNA, 20 nt, Artificial Sequence
  Synthetic
ccauucacucugcaaacuca

SEQ ID NO: 2390 - RNA, 20 nt, Artificial Sequence
  Synthetic
acuggugugcugauuucaac

SEQ ID NO: 2391 - RNA, 20 nt, Artificial Sequence
  Synthetic
acacguacacacacuuacac

SEQ ID NO: 2392 - RNA, 20 nt, Artificial Sequence
  Synthetic
guuuggaguuucuuuuuaaa

SEQ ID NO: 2393 - RNA, 20 nt, Artificial Sequence
  Synthetic
auaaccuuccagaagucugu

SEQ ID NO: 2394 - RNA, 20 nt, Artificial Sequence
  Synthetic
auucuuagaaaauaaccuuc

SEQ ID NO: 2395 - RNA, 20 nt, Artificial Sequence
  Synthetic
cacgcugccagcaagauucu

SEQ ID NO: 2396 - RNA, 20 nt, Artificial Sequence
  Synthetic
aggcuggguggggcugugca

SEQ ID NO: 2397 - RNA, 20 nt, Artificial Sequence
  Synthetic
agguggccacgugaggcugg

SEQ ID NO: 2398 - RNA, 20 nt, Artificial Sequence
  Synthetic
acagagguggccacgugagg

SEQ ID NO: 2399 - RNA, 20 nt, Artificial Sequence
  Synthetic
gggaagacagagguggccac

SEQ ID NO: 2400 - RNA, 20 nt, Artificial Sequence
  Synthetic
cagcccuucaugggggaaga

SEQ ID NO: 2401 - RNA, 20 nt, Artificial Sequence
  Synthetic
uacuggggagccagcccuuc

SEQ ID NO: 2402 - RNA, 20 nt, Artificial Sequence
  Synthetic
uccagagagguuuauauaua

SEQ ID NO: 2403 - RNA, 20 nt, Artificial Sequence
  Synthetic
uggcucaugcccgagcucca

SEQ ID NO: 2404 - RNA, 20 nt, Artificial Sequence
  Synthetic
gcuggcucaugcccgagcuc

SEQ ID NO: 2405 - RNA, 20 nt, Artificial Sequence
  Synthetic
guggccuugcuggcucaugc

SEQ ID NO: 2406 - RNA, 20 nt, Artificial Sequence
  Synthetic
cugugcugagaggugccugg

SEQ ID NO: 2407 - RNA, 20 nt, Artificial Sequence
  Synthetic
ucugcugugcugagaggugc

SEQ ID NO: 2408 - RNA, 20 nt, Artificial Sequence
  Synthetic
cuggaaagcucugcugugcu

SEQ ID NO: 2409 - RNA, 20 nt, Artificial Sequence
  Synthetic
cucuggaaagcucugcugug

SEQ ID NO: 2410 - RNA, 20 nt, Artificial Sequence
  Synthetic
aggcuuggugaggcuuccuc

SEQ ID NO: 2411 - RNA, 20 nt, Artificial Sequence
  Synthetic
gaggcuuggugaggcuuccu

SEQ ID NO: 2412 - RNA, 17 nt, Artificial Sequence
  Synthetic
agagguuuccucuccag

SEQ ID NO: 2413 - RNA, 17 nt, Artificial Sequence
  Synthetic
gggagcccugcaagcac

SEQ ID NO: 2414 - RNA, 17 nt, Artificial Sequence
  Synthetic
ugcaagcacccgggguc

SEQ ID NO: 2415 - RNA, 17 nt, Artificial Sequence
  Synthetic
ccgggguccuggguguc

SEQ ID NO: 2416 - RNA, 17 nt, Artificial Sequence
  Synthetic
guuuuguuaucacucuc

SEQ ID NO: 2417 - RNA, 17 nt, Artificial Sequence
  Synthetic
cauucauugacaauuua

SEQ ID NO: 2418 - RNA, 17 nt, Artificial Sequence
  Synthetic
uuauaucugccagacac

SEQ ID NO: 2419 - RNA, 17 nt, Artificial Sequence
  Synthetic
acaccagagacaaaaug

SEQ ID NO: 2420 - RNA, 17 nt, Artificial Sequence
  Synthetic
gucacugcccuaccuuc

SEQ ID NO: 2421 - RNA, 17 nt, Artificial Sequence
  Synthetic
ggaggugacaguuucuc

SEQ ID NO: 2422 - RNA, 17 nt, Artificial Sequence
  Synthetic
uucucauggaagacgug

SEQ ID NO: 2423 - RNA, 17 nt, Artificial Sequence
  Synthetic
ucauggaagacgugcag

SEQ ID NO: 2424 - RNA, 17 nt, Artificial Sequence
  Synthetic
ccaacuuaaacccagug

SEQ ID NO: 2425 - RNA, 17 nt, Artificial Sequence
  Synthetic
cuuaaacccagugcuga

SEQ ID NO: 2426 - RNA, 17 nt, Artificial Sequence
  Synthetic
aacccagugcugaaaga

SEQ ID NO: 2427 - RNA, 17 nt, Artificial Sequence
  Synthetic
aggaaauaaacaccauc

SEQ ID NO: 2428 - RNA, 17 nt, Artificial Sequence
  Synthetic
aaauaaacaccaucuug

SEQ ID NO: 2429 - RNA, 17 nt, Artificial Sequence
  Synthetic
ugcugccuccaucgugc

SEQ ID NO: 2430 - RNA, 17 nt, Artificial Sequence
  Synthetic
cccggaggcccccaagc

SEQ ID NO: 2431 - RNA, 17 nt, Artificial Sequence
  Synthetic
ggccugccucgcuuccc

SEQ ID NO: 2432 - RNA, 17 nt, Artificial Sequence
  Synthetic
gaaucguccuggugcau

SEQ ID NO: 2433 - RNA, 17 nt, Artificial Sequence
  Synthetic
guccuggugcaucugag

SEQ ID NO: 2434 - RNA, 17 nt, Artificial Sequence
  Synthetic
uccuggugcaucugagc

SEQ ID NO: 2435 - RNA, 17 nt, Artificial Sequence
  Synthetic
uccuuggcuccaggcuc

SEQ ID NO: 2436 - RNA, 17 nt, Artificial Sequence
  Synthetic
uggcuccaggcuccaga

SEQ ID NO: 2437 - RNA, 17 nt, Artificial Sequence
  Synthetic
caggcuccagaaaggaa

SEQ ID NO: 2438 - RNA, 17 nt, Artificial Sequence
  Synthetic
gcuccagaaaggaaaug

SEQ ID NO: 2439 - RNA, 17 nt, Artificial Sequence
  Synthetic
uccagaaaggaaaugga

SEQ ID NO: 2440 - RNA, 17 nt, Artificial Sequence
  Synthetic
agagggaaacuagucua

SEQ ID NO: 2441 - RNA, 17 nt, Artificial Sequence
  Synthetic
gggaaacuagucuaacg

SEQ ID NO: 2442 - RNA, 17 nt, Artificial Sequence
  Synthetic
cuagucuaacggagaau

SEQ ID NO: 2443 - RNA, 17 nt, Artificial Sequence
  Synthetic
gucuaacggagaaucug

SEQ ID NO: 2444 - RNA, 17 nt, Artificial Sequence
  Synthetic
aggggacaguguuuccu

SEQ ID NO: 2445 - RNA, 17 nt, Artificial Sequence
  Synthetic
gggacaguguuuccuca

SEQ ID NO: 2446 - RNA, 17 nt, Artificial Sequence
  Synthetic
guguuuccucagaggga

SEQ ID NO: 2447 - RNA, 17 nt, Artificial Sequence
  Synthetic
aaaggggccuccacguc

SEQ ID NO: 2448 - RNA, 17 nt, Artificial Sequence
  Synthetic
ggggccuccacguccag

SEQ ID NO: 2449 - RNA, 17 nt, Artificial Sequence
  Synthetic
cacguccaggagaauuc

SEQ ID NO: 2450 - RNA, 17 nt, Artificial Sequence
  Synthetic
caggagaauuccaggag

SEQ ID NO: 2451 - RNA, 17 nt, Artificial Sequence
  Synthetic
ccaggagguggggacug

SEQ ID NO: 2452 - RNA, 17 nt, Artificial Sequence
  Synthetic
gguggggacugcaggga

SEQ ID NO: 2453 - RNA, 17 nt, Artificial Sequence
  Synthetic
ugcagggaguggggacg

SEQ ID NO: 2454 - RNA, 17 nt, Artificial Sequence
  Synthetic
gaguggggacgcugggg

SEQ ID NO: 2455 - RNA, 17 nt, Artificial Sequence
  Synthetic
ggggacgcuggggcuga

SEQ ID NO: 2456 - RNA, 17 nt, Artificial Sequence
  Synthetic
cuggggcugagcgggug

SEQ ID NO: 2457 - RNA, 17 nt, Artificial Sequence
  Synthetic
gagcgggugcugaaagg

SEQ ID NO: 2458 - RNA, 17 nt, Artificial Sequence
  Synthetic
ugcugaaaggcaggaag

SEQ ID NO: 2459 - RNA, 17 nt, Artificial Sequence
  Synthetic
aaaggcaggaaggugaa

SEQ ID NO: 2460 - RNA, 17 nt, Artificial Sequence
  Synthetic
aggugaaaagggcaagg

SEQ ID NO: 2461 - RNA, 17 nt, Artificial Sequence
  Synthetic
gauguucaguguuguuc

SEQ ID NO: 2462 - RNA, 17 nt, Artificial Sequence
  Synthetic
caguguuguucacgggg

SEQ ID NO: 2463 - RNA, 17 nt, Artificial Sequence
  Synthetic
guuuuccguugcuuccu

SEQ ID NO: 2464 - RNA, 17 nt, Artificial Sequence
  Synthetic
uuuuaucuuuucucugc

SEQ ID NO: 2465 - RNA, 17 nt, Artificial Sequence
  Synthetic
uaucuuuucucugcuug

SEQ ID NO: 2466 - RNA, 17 nt, Artificial Sequence
  Synthetic
cuuuucucugcuuggag

SEQ ID NO: 2467 - RNA, 17 nt, Artificial Sequence
  Synthetic
uucucugcuuggaggag

SEQ ID NO: 2468 - RNA, 17 nt, Artificial Sequence
  Synthetic
gagaagaagucuauuuc

SEQ ID NO: 2469 - RNA, 17 nt, Artificial Sequence
  Synthetic
aagaagucuauuucaug

SEQ ID NO: 2470 - RNA, 17 nt, Artificial Sequence
  Synthetic
gucagcuguuaaaauuc

SEQ ID NO: 2471 - RNA, 17 nt, Artificial Sequence
  Synthetic
aaaauuccagggugugc

SEQ ID NO: 2472 - RNA, 17 nt, Artificial Sequence
  Synthetic
ugcauggguuuuccuuc

SEQ ID NO: 2473 - RNA, 17 nt, Artificial Sequence
  Synthetic
acgaaggccuuuauuua

SEQ ID NO: 2474 - RNA, 17 nt, Artificial Sequence
  Synthetic
uuuauuuaaugggaaua

SEQ ID NO: 2475 - RNA, 17 nt, Artificial Sequence
  Synthetic
uaaugggaauauaggaa

SEQ ID NO: 2476 - RNA, 17 nt, Artificial Sequence
  Synthetic
uccuaggccguuaauuc

SEQ ID NO: 2477 - RNA, 17 nt, Artificial Sequence
  Synthetic
aggccguuaauucacgg

SEQ ID NO: 2478 - RNA, 17 nt, Artificial Sequence
  Synthetic
auucacggaagaaguga

SEQ ID NO: 2479 - RNA, 17 nt, Artificial Sequence
  Synthetic
cuuuucuuucaugucuu

SEQ ID NO: 2480 - RNA, 17 nt, Artificial Sequence
  Synthetic
aacuacucagcccugug

SEQ ID NO: 2481 - RNA, 17 nt, Artificial Sequence
  Synthetic
uggcuuaugcaagacgg

SEQ ID NO: 2482 - RNA, 17 nt, Artificial Sequence
  Synthetic
caagacggucgaaaacc

SEQ ID NO: 2483 - RNA, 17 nt, Artificial Sequence
  Synthetic
gucgaaaaccuuggaau

SEQ ID NO: 2484 - RNA, 17 nt, Artificial Sequence
  Synthetic
ugguuggcugugcgacc

SEQ ID NO: 2485 - RNA, 17 nt, Artificial Sequence
  Synthetic
caagugucucuccuucc

SEQ ID NO: 2486 - RNA, 17 nt, Artificial Sequence
  Synthetic
ugcagcucucguguucu

SEQ ID NO: 2487 - RNA, 17 nt, Artificial Sequence
  Synthetic
cuucccugugauucucu

SEQ ID NO: 2488 - RNA, 17 nt, Artificial Sequence
  Synthetic
ucccugugauucucugu

SEQ ID NO: 2489 - RNA, 17 nt, Artificial Sequence
  Synthetic
cucugugaggggggaug

SEQ ID NO: 2490 - RNA, 17 nt, Artificial Sequence
  Synthetic
cugugaggggggauguu

SEQ ID NO: 2491 - RNA, 17 nt, Artificial Sequence
  Synthetic
gugaggggggauguuga

SEQ ID NO: 2492 - RNA, 17 nt, Artificial Sequence
  Synthetic
ggggauguugagagggg

SEQ ID NO: 2493 - RNA, 17 nt, Artificial Sequence
  Synthetic
uugagaggggaaggagg

SEQ ID NO: 2494 - RNA, 17 nt, Artificial Sequence
  Synthetic
aggggaaggaggcagag

SEQ ID NO: 2495 - RNA, 17 nt, Artificial Sequence
  Synthetic
aggcagagcuggagcag

SEQ ID NO: 2496 - RNA, 17 nt, Artificial Sequence
  Synthetic
cuggagcagcugagcca

SEQ ID NO: 2497 - RNA, 17 nt, Artificial Sequence
  Synthetic
gcugagccacaggggag

SEQ ID NO: 2498 - RNA, 17 nt, Artificial Sequence
  Synthetic
gagccacaggggaggug

SEQ ID NO: 2499 - RNA, 17 nt, Artificial Sequence
  Synthetic
ggggagguggaggggga

SEQ ID NO: 2500 - RNA, 17 nt, Artificial Sequence
  Synthetic
ggggacaggaaggcagg

SEQ ID NO: 2501 - RNA, 17 nt, Artificial Sequence
  Synthetic
aggaaggcaggcagaag

SEQ ID NO: 2502 - RNA, 17 nt, Artificial Sequence
  Synthetic
cugaucacgucagacuc

SEQ ID NO: 2503 - RNA, 17 nt, Artificial Sequence
  Synthetic
cacgucagacuccagga

SEQ ID NO: 2504 - RNA, 17 nt, Artificial Sequence
  Synthetic
cgucagacuccaggacc

SEQ ID NO: 2505 - RNA, 17 nt, Artificial Sequence
  Synthetic
cgagagccacaaugcuu

SEQ ID NO: 2506 - RNA, 17 nt, Artificial Sequence
  Synthetic
ugcuucaggaaagcuca

SEQ ID NO: 2507 - RNA, 17 nt, Artificial Sequence
  Synthetic
auuugccaauaaccaaa

SEQ ID NO: 2508 - RNA, 17 nt, Artificial Sequence
  Synthetic
aauaaccaaaaagaaug

SEQ ID NO: 2509 - RNA, 17 nt, Artificial Sequence
  Synthetic
ugccuggcauucaaaaa

SEQ ID NO: 2510 - RNA, 17 nt, Artificial Sequence
  Synthetic
gcauucaaaaacugggc

SEQ ID NO: 2511 - RNA, 17 nt, Artificial Sequence
  Synthetic
aaacugggccagagcaa

SEQ ID NO: 2512 - RNA, 17 nt, Artificial Sequence
  Synthetic
gagcaaguggaaaaugc

SEQ ID NO: 2513 - RNA, 17 nt, Artificial Sequence
  Synthetic
cagugacugcugacagc

SEQ ID NO: 2514 - RNA, 17 nt, Artificial Sequence
  Synthetic
cggagugaccugcagcg

SEQ ID NO: 2515 - RNA, 17 nt, Artificial Sequence
  Synthetic
ugaccugcagcgcaggg

SEQ ID NO: 2516 - RNA, 17 nt, Artificial Sequence
  Synthetic
ccugcagcgcaggggag

SEQ ID NO: 2517 - RNA, 17 nt, Artificial Sequence
  Synthetic
gcagcgcaggggaggag

SEQ ID NO: 2518 - RNA, 17 nt, Artificial Sequence
  Synthetic
caggggaggagaagaaa

SEQ ID NO: 2519 - RNA, 17 nt, Artificial Sequence
  Synthetic
ggggaggagaagaaaaa

SEQ ID NO: 2520 - RNA, 17 nt, Artificial Sequence
  Synthetic
ggaggagaagaaaaaga

SEQ ID NO: 2521 - RNA, 17 nt, Artificial Sequence
  Synthetic
aaagagagggauagugu

SEQ ID NO: 2522 - RNA, 17 nt, Artificial Sequence
  Synthetic
agggauaguguaugagc

SEQ ID NO: 2523 - RNA, 17 nt, Artificial Sequence
  Synthetic
gaaagacagauucauuc

SEQ ID NO: 2524 - RNA, 17 nt, Artificial Sequence
  Synthetic
agauucauucaagggca

SEQ ID NO: 2525 - RNA, 17 nt, Artificial Sequence
  Synthetic
gcagugggaauugacca

SEQ ID NO: 2526 - RNA, 17 nt, Artificial Sequence
  Synthetic
uuauaguccacgugauc

SEQ ID NO: 2527 - RNA, 17 nt, Artificial Sequence
  Synthetic
cacgugauccuggguuc

SEQ ID NO: 2528 - RNA, 17 nt, Artificial Sequence
  Synthetic
uccuggguucuaggagg

SEQ ID NO: 2529 - RNA, 17 nt, Artificial Sequence
  Synthetic
ggaggcagggcuauauu

SEQ ID NO: 2530 - RNA, 17 nt, Artificial Sequence
  Synthetic
ggggaaaaaaucaguuc

SEQ ID NO: 2531 - RNA, 17 nt, Artificial Sequence
  Synthetic
aaucaguucaagggaag

SEQ ID NO: 2532 - RNA, 17 nt, Artificial Sequence
  Synthetic
uauuuuuccuuuacaag

SEQ ID NO: 2533 - RNA, 17 nt, Artificial Sequence
  Synthetic
uuacaagcugaguaauu

SEQ ID NO: 2534 - RNA, 17 nt, Artificial Sequence
  Synthetic
aagucacaagguaguaa

SEQ ID NO: 2535 - RNA, 17 nt, Artificial Sequence
  Synthetic
acuuaguuucuccuuau

SEQ ID NO: 2536 - RNA, 17 nt, Artificial Sequence
  Synthetic
aggaacucuuuuucucu

SEQ ID NO: 2537 - RNA, 17 nt, Artificial Sequence
  Synthetic
uguggaguuagcagcac

SEQ ID NO: 2538 - RNA, 17 nt, Artificial Sequence
  Synthetic
aaucccguuucuuuuaa

SEQ ID NO: 2539 - RNA, 17 nt, Artificial Sequence
  Synthetic
ccguuucuuuuaacagg

SEQ ID NO: 2540 - RNA, 17 nt, Artificial Sequence
  Synthetic
aggaagaaaacauuccu

SEQ ID NO: 2541 - RNA, 17 nt, Artificial Sequence
  Synthetic
acuauaugauugguuuu

SEQ ID NO: 2542 - RNA, 17 nt, Artificial Sequence
  Synthetic
auguuuacuaucugauu

SEQ ID NO: 2543 - RNA, 17 nt, Artificial Sequence
  Synthetic
acuaucugauucagaaa

SEQ ID NO: 2544 - RNA, 17 nt, Artificial Sequence
  Synthetic
aaguucaggcuuaacug

SEQ ID NO: 2545 - RNA, 17 nt, Artificial Sequence
  Synthetic
ugcagaaccaaucaaau

SEQ ID NO: 2546 - RNA, 17 nt, Artificial Sequence
  Synthetic
aaccaaucaaauaagaa

SEQ ID NO: 2547 - RNA, 17 nt, Artificial Sequence
  Synthetic
aauaagaauagaaucuu

SEQ ID NO: 2548 - RNA, 17 nt, Artificial Sequence
  Synthetic
aacuguguuucuccacu

SEQ ID NO: 2549 - RNA, 17 nt, Artificial Sequence
  Synthetic
guuucuccacucuggag

SEQ ID NO: 2550 - RNA, 17 nt, Artificial Sequence
  Synthetic
ucuggaggugagucugc

SEQ ID NO: 2551 - RNA, 17 nt, Artificial Sequence
  Synthetic
gagucugccagggcagu

SEQ ID NO: 2552 - RNA, 17 nt, Artificial Sequence
  Synthetic
cuuuuuguuuuuucucu

SEQ ID NO: 2553 - RNA, 17 nt, Artificial Sequence
  Synthetic
gguuuauuaauguaaag

SEQ ID NO: 2554 - RNA, 17 nt, Artificial Sequence
  Synthetic
auuauuaaccuacaguc

SEQ ID NO: 2555 - RNA, 17 nt, Artificial Sequence
  Synthetic
uacaguccagaaagccu

SEQ ID NO: 2556 - RNA, 17 nt, Artificial Sequence
  Synthetic
ccagaaagccugugaau

SEQ ID NO: 2557 - RNA, 17 nt, Artificial Sequence
  Synthetic
aaagccugugaauuuga

SEQ ID NO: 2558 - RNA, 17 nt, Artificial Sequence
  Synthetic
agccugugaauuugaau

SEQ ID NO: 2559 - RNA, 17 nt, Artificial Sequence
  Synthetic
uaacauuuuauuccauu

SEQ ID NO: 2560 - RNA, 17 nt, Artificial Sequence
  Synthetic
uuuuauuccauugcgaa

SEQ ID NO: 2561 - RNA, 17 nt, Artificial Sequence
  Synthetic
gauuuugucauuaccaa

SEQ ID NO: 2562 - RNA, 17 nt, Artificial Sequence
  Synthetic
uugcagauacguuguaa

SEQ ID NO: 2563 - RNA, 17 nt, Artificial Sequence
  Synthetic
uuauacucaaaacuacu

SEQ ID NO: 2564 - RNA, 17 nt, Artificial Sequence
  Synthetic
ugaaauuagaccuccug

SEQ ID NO: 2565 - RNA, 17 nt, Artificial Sequence
  Synthetic
aucuauauuuuauauau

SEQ ID NO: 2566 - RNA, 17 nt, Artificial Sequence
  Synthetic
uauuugaaaacaucuuu

SEQ ID NO: 2567 - RNA, 17 nt, Artificial Sequence
  Synthetic
uuugaaaacaucuuucu

SEQ ID NO: 2568 - RNA, 17 nt, Artificial Sequence
  Synthetic
gaaaacaucuuucugag

SEQ ID NO: 2569 - RNA, 17 nt, Artificial Sequence
  Synthetic
uuccccagauuucacca

SEQ ID NO: 2570 - RNA, 17 nt, Artificial Sequence
  Synthetic
cuuggcaugcacacaca

SEQ ID NO: 2571 - RNA, 17 nt, Artificial Sequence
  Synthetic
augcacacacacagagu

SEQ ID NO: 2572 - RNA, 17 nt, Artificial Sequence
  Synthetic
cagaguaagaacugauu

SEQ ID NO: 2573 - RNA, 17 nt, Artificial Sequence
  Synthetic
aacauugacauuggugc

SEQ ID NO: 2574 - RNA, 17 nt, Artificial Sequence
  Synthetic
gugccugagaugcaaga

SEQ ID NO: 2575 - RNA, 17 nt, Artificial Sequence
  Synthetic
agaugcaagacugaaau

SEQ ID NO: 2576 - RNA, 17 nt, Artificial Sequence
  Synthetic
cacaguuguuuuaaagc

SEQ ID NO: 2577 - RNA, 17 nt, Artificial Sequence
  Synthetic
acaguuguuuuaaagcu

SEQ ID NO: 2578 - RNA, 17 nt, Artificial Sequence
  Synthetic
uuguuuuaaagcuaggg

SEQ ID NO: 2579 - RNA, 17 nt, Artificial Sequence
  Synthetic
guuuuaaagcuaggggu

SEQ ID NO: 2580 - RNA, 17 nt, Artificial Sequence
  Synthetic
uuuuaaagcuaggggug

SEQ ID NO: 2581 - RNA, 17 nt, Artificial Sequence
  Synthetic
uuuaaagcuagggguga

SEQ ID NO: 2582 - RNA, 17 nt, Artificial Sequence
  Synthetic
uuaaagcuaggggugag

SEQ ID NO: 2583 - RNA, 17 nt, Artificial Sequence
  Synthetic
uaaagcuaggggugagg

SEQ ID NO: 2584 - RNA, 17 nt, Artificial Sequence
  Synthetic
aaagcuaggggugaggg

SEQ ID NO: 2585 - RNA, 17 nt, Artificial Sequence
  Synthetic
gaaaucugccgcuucua

SEQ ID NO: 2586 - RNA, 17 nt, Artificial Sequence
  Synthetic
cuauaggaaugcucucc

SEQ ID NO: 2587 - RNA, 17 nt, Artificial Sequence
  Synthetic
cucucccuggagccugg

SEQ ID NO: 2588 - RNA, 17 nt, Artificial Sequence
  Synthetic
gucccugcuacgucuua

SEQ ID NO: 2589 - RNA, 17 nt, Artificial Sequence
  Synthetic
cgucuuaaaggacuugu

SEQ ID NO: 2590 - RNA, 17 nt, Artificial Sequence
  Synthetic
cacagugcagguucuca

SEQ ID NO: 2591 - RNA, 17 nt, Artificial Sequence
  Synthetic
gguucucaaugaguuug

SEQ ID NO: 2592 - RNA, 17 nt, Artificial Sequence
  Synthetic
cucaaugaguuugcaga

SEQ ID NO: 2593 - RNA, 17 nt, Artificial Sequence
  Synthetic
augaguuugcagaguga

SEQ ID NO: 2594 - RNA, 17 nt, Artificial Sequence
  Synthetic
ugaauggaaauauaaac

SEQ ID NO: 2595 - RNA, 17 nt, Artificial Sequence
  Synthetic
cuagaaauauauccuug

SEQ ID NO: 2596 - RNA, 17 nt, Artificial Sequence
  Synthetic
uguguguguaaaaccag

SEQ ID NO: 2597 - RNA, 17 nt, Artificial Sequence
  Synthetic
aaaaccagguggagaua

SEQ ID NO: 2598 - RNA, 17 nt, Artificial Sequence
  Synthetic
agauauaggaacuauua

SEQ ID NO: 2599 - RNA, 17 nt, Artificial Sequence
  Synthetic
ggaacuauuauuggggu

SEQ ID NO: 2600 - RNA, 17 nt, Artificial Sequence
  Synthetic
ggguaugggugcauaaa

SEQ ID NO: 2601 - RNA, 17 nt, Artificial Sequence
  Synthetic
gggauguucuuuuuaaa

SEQ ID NO: 2602 - RNA, 17 nt, Artificial Sequence
  Synthetic
aaacuccaaacagacuu

SEQ ID NO: 2603 - RNA, 17 nt, Artificial Sequence
  Synthetic
cuggaagguuauuuucu

SEQ ID NO: 2604 - RNA, 17 nt, Artificial Sequence
  Synthetic
agaaucuugcuggcagc

SEQ ID NO: 2605 - RNA, 17 nt, Artificial Sequence
  Synthetic
caccucugucuuccccc

SEQ ID NO: 2606 - RNA, 17 nt, Artificial Sequence
  Synthetic
cucugucuucccccaug

SEQ ID NO: 2607 - RNA, 17 nt, Artificial Sequence
  Synthetic
aguauauauaaaccucu

SEQ ID NO: 2608 - RNA, 17 nt, Artificial Sequence
  Synthetic
auaaaccucucuggagc

SEQ ID NO: 2609 - RNA, 17 nt, Artificial Sequence
  Synthetic
cucucuggagcucgggc

SEQ ID NO: 2610 - RNA, 17 nt, Artificial Sequence
  Synthetic
ggcaccucucagcacag

SEQ ID NO: 2611 - RNA, 17 nt, Artificial Sequence
  Synthetic
agcacagcagagcuuuc

SEQ ID NO: 2612 - RNA, 17 nt, Artificial Sequence
  Synthetic
cacagcagagcuuucca

SEQ ID NO: 2613 - RNA, 17 nt, Artificial Sequence
  Synthetic
acagcagagcuuuccag

SEQ ID NO: 2614 - RNA, 17 nt, Artificial Sequence
  Synthetic
uggagaggaaaccucug

SEQ ID NO: 2615 - RNA, 17 nt, Artificial Sequence
  Synthetic
gggcucccccagcugga

SEQ ID NO: 2616 - RNA, 17 nt, Artificial Sequence
  Synthetic
cagggcucccccagcug

SEQ ID NO: 2617 - RNA, 17 nt, Artificial Sequence
  Synthetic
uugcagggcucccccag

SEQ ID NO: 2618 - RNA, 17 nt, Artificial Sequence
  Synthetic
aggaccccgggugcuug

SEQ ID NO: 2619 - RNA, 17 nt, Artificial Sequence
  Synthetic
ucaggacacccaggacc

SEQ ID NO: 2620 - RNA, 17 nt, Artificial Sequence
  Synthetic
agguugcucaggacacc

SEQ ID NO: 2621 - RNA, 17 nt, Artificial Sequence
  Synthetic
cgggcuggcagguugcu

SEQ ID NO: 2622 - RNA, 17 nt, Artificial Sequence
  Synthetic
acaaaacaaccaguggc

SEQ ID NO: 2623 - RNA, 17 nt, Artificial Sequence
  Synthetic
aaagcaacaggucccua

SEQ ID NO: 2624 - RNA, 17 nt, Artificial Sequence
  Synthetic
agaaagcaacagguccc

SEQ ID NO: 2625 - RNA, 17 nt, Artificial Sequence
  Synthetic
aacgagucacacagaaa

SEQ ID NO: 2626 - RNA, 17 nt, Artificial Sequence
  Synthetic
ugaaugaacgagucaca

SEQ ID NO: 2627 - RNA, 17 nt, Artificial Sequence
  Synthetic
aaugccuggaugaauga

SEQ ID NO: 2628 - RNA, 17 nt, Artificial Sequence
  Synthetic
aaugaaugccuggauga

SEQ ID NO: 2629 - RNA, 17 nt, Artificial Sequence
  Synthetic
ugucaaugaaugccugg

SEQ ID NO: 2630 - RNA, 17 nt, Artificial Sequence
  Synthetic
aaauugucaaugaaugc

SEQ ID NO: 2631 - RNA, 17 nt, Artificial Sequence
  Synthetic
uacucaauaaauuguca

SEQ ID NO: 2632 - RNA, 17 nt, Artificial Sequence
  Synthetic
ugucaccuccacgaagg

SEQ ID NO: 2633 - RNA, 17 nt, Artificial Sequence
  Synthetic
gagaaacugucaccucc

SEQ ID NO: 2634 - RNA, 17 nt, Artificial Sequence
  Synthetic
uucugcacgucuuccau

SEQ ID NO: 2635 - RNA, 17 nt, Artificial Sequence
  Synthetic
ucuucugcacgucuucc

SEQ ID NO: 2636 - RNA, 17 nt, Artificial Sequence
  Synthetic
uuuccuuucuuucagca

SEQ ID NO: 2637 - RNA, 17 nt, Artificial Sequence
  Synthetic
agggagguggccuuguu

SEQ ID NO: 2638 - RNA, 17 nt, Artificial Sequence
  Synthetic
gaggcagcagggggcgc

SEQ ID NO: 2639 - RNA, 17 nt, Artificial Sequence
  Synthetic
gggcacgauggaggcag

SEQ ID NO: 2640 - RNA, 17 nt, Artificial Sequence
  Synthetic
gggggccuccgggcacg

SEQ ID NO: 2641 - RNA, 17 nt, Artificial Sequence
  Synthetic
cucgggcuugggggccu

SEQ ID NO: 2642 - RNA, 17 nt, Artificial Sequence
  Synthetic
gcuuggaagacucgggc

SEQ ID NO: 2643 - RNA, 17 nt, Artificial Sequence
  Synthetic
gaggaggcuuggaagac

SEQ ID NO: 2644 - RNA, 17 nt, Artificial Sequence
  Synthetic
cugauggaggaggaggc

SEQ ID NO: 2645 - RNA, 17 nt, Artificial Sequence
  Synthetic
cgcugugacugauggag

SEQ ID NO: 2646 - RNA, 17 nt, Artificial Sequence
  Synthetic
cagcgcugugacugaug

SEQ ID NO: 2647 - RNA, 17 nt, Artificial Sequence
  Synthetic
cugcagcgcugugacug

SEQ ID NO: 2648 - RNA, 17 nt, Artificial Sequence
  Synthetic
aggacgauucacgggaa

SEQ ID NO: 2649 - RNA, 17 nt, Artificial Sequence
  Synthetic
gcaccaggacgauucac

SEQ ID NO: 2650 - RNA, 17 nt, Artificial Sequence
  Synthetic
ugcaccaggacgauuca

SEQ ID NO: 2651 - RNA, 17 nt, Artificial Sequence
  Synthetic
augcaccaggacgauuc

SEQ ID NO: 2652 - RNA, 17 nt, Artificial Sequence
  Synthetic
cuccagcucagaugcac

SEQ ID NO: 2653 - RNA, 17 nt, Artificial Sequence
  Synthetic
uucuggagccuggagcc

SEQ ID NO: 2654 - RNA, 17 nt, Artificial Sequence
  Synthetic
cauuuccuuucuggagc

SEQ ID NO: 2655 - RNA, 17 nt, Artificial Sequence
  Synthetic
cccucuccauuuccuuu

SEQ ID NO: 2656 - RNA, 17 nt, Artificial Sequence
  Synthetic
gaggccccuuucccucu

SEQ ID NO: 2657 - RNA, 17 nt, Artificial Sequence
  Synthetic
uggaggccccuuucccu

SEQ ID NO: 2658 - RNA, 17 nt, Artificial Sequence
  Synthetic
cuggaauucuccuggac

SEQ ID NO: 2659 - RNA, 17 nt, Artificial Sequence
  Synthetic
caccuccuggaauucuc

SEQ ID NO: 2660 - RNA, 17 nt, Artificial Sequence
  Synthetic
ccugcaguccccaccuc

SEQ ID NO: 2661 - RNA, 17 nt, Artificial Sequence
  Synthetic
ugaacaacacugaacau

SEQ ID NO: 2662 - RNA, 17 nt, Artificial Sequence
  Synthetic
cagccccgugaacaaca

SEQ ID NO: 2663 - RNA, 17 nt, Artificial Sequence
  Synthetic
ggaaaacucccagcccc

SEQ ID NO: 2664 - RNA, 17 nt, Artificial Sequence
  Synthetic
aaggcucacaggaagca

SEQ ID NO: 2665 - RNA, 17 nt, Artificial Sequence
  Synthetic
aaagauaaaaaggcuca

SEQ ID NO: 2666 - RNA, 17 nt, Artificial Sequence
  Synthetic
uucuucuccuccaagca

SEQ ID NO: 2667 - RNA, 17 nt, Artificial Sequence
  Synthetic
acuucuucuccuccaag

SEQ ID NO: 2668 - RNA, 17 nt, Artificial Sequence
  Synthetic
ugaaacugcaucccuuc

SEQ ID NO: 2669 - RNA, 17 nt, Artificial Sequence
  Synthetic
uuuuaacagcugacuuu

SEQ ID NO: 2670 - RNA, 17 nt, Artificial Sequence
  Synthetic
gaaaacccaugcacacc

SEQ ID NO: 2671 - RNA, 17 nt, Artificial Sequence
  Synthetic
aaauaaaggccuucgug

SEQ ID NO: 2672 - RNA, 17 nt, Artificial Sequence
  Synthetic
auuaaauaaaggccuuc

SEQ ID NO: 2673 - RNA, 17 nt, Artificial Sequence
  Synthetic
aauuaacggccuaggaa

SEQ ID NO: 2674 - RNA, 17 nt, Artificial Sequence
  Synthetic
uccgugaauuaacggcc

SEQ ID NO: 2675 - RNA, 17 nt, Artificial Sequence
  Synthetic
cuccagucacuucuucc

SEQ ID NO: 2676 - RNA, 17 nt, Artificial Sequence
  Synthetic
uugcccagaagacauga

SEQ ID NO: 2677 - RNA, 17 nt, Artificial Sequence
  Synthetic
guaguugcccagaagac

SEQ ID NO: 2678 - RNA, 17 nt, Artificial Sequence
  Synthetic
agggcugaguaguugcc

SEQ ID NO: 2679 - RNA, 17 nt, Artificial Sequence
  Synthetic
ccaaguccaccacaggg

SEQ ID NO: 2680 - RNA, 17 nt, Artificial Sequence
  Synthetic
auaagccaaguccacca

SEQ ID NO: 2681 - RNA, 17 nt, Artificial Sequence
  Synthetic
cagaaccagaaagaaaa

SEQ ID NO: 2682 - RNA, 17 nt, Artificial Sequence
  Synthetic
ccaauggcagaaccaga

SEQ ID NO: 2683 - RNA, 17 nt, Artificial Sequence
  Synthetic
ccaaccaauggcagaac

SEQ ID NO: 2684 - RNA, 17 nt, Artificial Sequence
  Synthetic
gcacagccaaccaaugg

SEQ ID NO: 2685 - RNA, 17 nt, Artificial Sequence
  Synthetic
acuauggcccagggaag

SEQ ID NO: 2686 - RNA, 17 nt, Artificial Sequence
  Synthetic
aagacuauggcccaggg

SEQ ID NO: 2687 - RNA, 17 nt, Artificial Sequence
  Synthetic
cagagaagacuauggcc

SEQ ID NO: 2688 - RNA, 17 nt, Artificial Sequence
  Synthetic
caagggucuuuauagca

SEQ ID NO: 2689 - RNA, 17 nt, Artificial Sequence
  Synthetic
ugcaagggucuuuauag

SEQ ID NO: 2690 - RNA, 17 nt, Artificial Sequence
  Synthetic
cagaacacgagagcugc

SEQ ID NO: 2691 - RNA, 17 nt, Artificial Sequence
  Synthetic
aaguguucacagaacac

SEQ ID NO: 2692 - RNA, 17 nt, Artificial Sequence
  Synthetic
ggaaguguucacagaac

SEQ ID NO: 2693 - RNA, 17 nt, Artificial Sequence
  Synthetic
ucacagggaaguguuca

SEQ ID NO: 2694 - RNA, 17 nt, Artificial Sequence
  Synthetic
ccccucacagagaauca

SEQ ID NO: 2695 - RNA, 17 nt, Artificial Sequence
  Synthetic
caacauccccccucaca

SEQ ID NO: 2696 - RNA, 17 nt, Artificial Sequence
  Synthetic
cucaacauccccccuca

SEQ ID NO: 2697 - RNA, 17 nt, Artificial Sequence
  Synthetic
gugaucagugaggacug

SEQ ID NO: 2698 - RNA, 17 nt, Artificial Sequence
  Synthetic
agucugacgugaucagu

SEQ ID NO: 2699 - RNA, 17 nt, Artificial Sequence
  Synthetic
ggagucugacgugauca

SEQ ID NO: 2700 - RNA, 17 nt, Artificial Sequence
  Synthetic
cauuguggcucucgguc

SEQ ID NO: 2701 - RNA, 17 nt, Artificial Sequence
  Synthetic
ggguucauugagcuuuc

SEQ ID NO: 2702 - RNA, 17 nt, Artificial Sequence
  Synthetic
uguggcuguuggguuca

SEQ ID NO: 2703 - RNA, 17 nt, Artificial Sequence
  Synthetic
gaaggaaaauguggcug

SEQ ID NO: 2704 - RNA, 17 nt, Artificial Sequence
  Synthetic
auugucuaugcuuaggg

SEQ ID NO: 2705 - RNA, 17 nt, Artificial Sequence
  Synthetic
augccauugucuaugcu

SEQ ID NO: 2706 - RNA, 17 nt, Artificial Sequence
  Synthetic
uugcucuggcccaguuu

SEQ ID NO: 2707 - RNA, 17 nt, Artificial Sequence
  Synthetic
guggggugcuggucagg

SEQ ID NO: 2708 - RNA, 17 nt, Artificial Sequence
  Synthetic
cugcguggggugcuggu

SEQ ID NO: 2709 - RNA, 17 nt, Artificial Sequence
  Synthetic
agucacugcugagcugc

SEQ ID NO: 2710 - RNA, 17 nt, Artificial Sequence
  Synthetic
gcugucagcagucacug

SEQ ID NO: 2711 - RNA, 17 nt, Artificial Sequence
  Synthetic
auucccacugcccuuga

SEQ ID NO: 2712 - RNA, 17 nt, Artificial Sequence
  Synthetic
gucaauucccacugccc

SEQ ID NO: 2713 - RNA, 17 nt, Artificial Sequence
  Synthetic
cuagaacccaggaucac

SEQ ID NO: 2714 - RNA, 17 nt, Artificial Sequence
  Synthetic
cccugccuccuagaacc

SEQ ID NO: 2715 - RNA, 17 nt, Artificial Sequence
  Synthetic
aauauagcccugccucc

SEQ ID NO: 2716 - RNA, 17 nt, Artificial Sequence
  Synthetic
aggucucccgacuuccc

SEQ ID NO: 2717 - RNA, 17 nt, Artificial Sequence
  Synthetic
aaggaaaaauauaguau

SEQ ID NO: 2718 - RNA, 17 nt, Artificial Sequence
  Synthetic
gaauuacucagcuugua

SEQ ID NO: 2719 - RNA, 17 nt, Artificial Sequence
  Synthetic
cuaccuugugacuugcu

SEQ ID NO: 2720 - RNA, 17 nt, Artificial Sequence
  Synthetic
aaagaguuccuaauaag

SEQ ID NO: 2721 - RNA, 17 nt, Artificial Sequence
  Synthetic
gaaaaagaguuccuaau

SEQ ID NO: 2722 - RNA, 17 nt, Artificial Sequence
  Synthetic
cuaacuccacagagaaa

SEQ ID NO: 2723 - RNA, 17 nt, Artificial Sequence
  Synthetic
gugcugcuaacuccaca

SEQ ID NO: 2724 - RNA, 17 nt, Artificial Sequence
  Synthetic
uugugcugcuaacucca

SEQ ID NO: 2725 - RNA, 17 nt, Artificial Sequence
  Synthetic
ucuuccuguuaaaagaa

SEQ ID NO: 2726 - RNA, 17 nt, Artificial Sequence
  Synthetic
uguuuucuuccuguuaa

SEQ ID NO: 2727 - RNA, 17 nt, Artificial Sequence
  Synthetic
cuguuuggcuuuacucu

SEQ ID NO: 2728 - RNA, 17 nt, Artificial Sequence
  Synthetic
gucagcaagaccuaggc

SEQ ID NO: 2729 - RNA, 17 nt, Artificial Sequence
  Synthetic
ucagauaguaaacaucg

SEQ ID NO: 2730 - RNA, 17 nt, Artificial Sequence
  Synthetic
gguacuagucucauuuu

SEQ ID NO: 2731 - RNA, 17 nt, Artificial Sequence
  Synthetic
uuguuuacagcugacca

SEQ ID NO: 2732 - RNA, 17 nt, Artificial Sequence
  Synthetic
acuugagacauuuacaa

SEQ ID NO: 2733 - RNA, 17 nt, Artificial Sequence
  Synthetic
ugcaguuaagccugaac

SEQ ID NO: 2734 - RNA, 17 nt, Artificial Sequence
  Synthetic
ugguucugcaguuaagc

SEQ ID NO: 2735 - RNA, 17 nt, Artificial Sequence
  Synthetic
gacucaccuccagagug

SEQ ID NO: 2736 - RNA, 17 nt, Artificial Sequence
  Synthetic
gcagacucaccuccaga

SEQ ID NO: 2737 - RNA, 17 nt, Artificial Sequence
  Synthetic
ccuggcagacucaccuc

SEQ ID NO: 2738 - RNA, 17 nt, Artificial Sequence
  Synthetic
caacagugucaauacuu

SEQ ID NO: 2739 - RNA, 17 nt, Artificial Sequence
  Synthetic
ugaaauaaugauugccu

SEQ ID NO: 2740 - RNA, 17 nt, Artificial Sequence
  Synthetic
aaguaacuuuaagccac

SEQ ID NO: 2741 - RNA, 17 nt, Artificial Sequence
  Synthetic
aaauauaccaaaacugu

SEQ ID NO: 2742 - RNA, 17 nt, Artificial Sequence
  Synthetic
acauuaauaaacccaaa

SEQ ID NO: 2743 - RNA, 17 nt, Artificial Sequence
  Synthetic
uuacauuaauaaaccca

SEQ ID NO: 2744 - RNA, 17 nt, Artificial Sequence
  Synthetic
ucaaauucacaggcuuu

SEQ ID NO: 2745 - RNA, 17 nt, Artificial Sequence
  Synthetic
aaaauguuaaauuuagu

SEQ ID NO: 2746 - RNA, 17 nt, Artificial Sequence
  Synthetic
uuauggcucuauucgca

SEQ ID NO: 2747 - RNA, 17 nt, Artificial Sequence
  Synthetic
guacuguuauuaccacu

SEQ ID NO: 2748 - RNA, 17 nt, Artificial Sequence
  Synthetic
cuaauuucaaaguaguu

SEQ ID NO: 2749 - RNA, 17 nt, Artificial Sequence
  Synthetic
uuaaaaacaagauccag

SEQ ID NO: 2750 - RNA, 17 nt, Artificial Sequence
  Synthetic
aaaggaaacaaaugaua

SEQ ID NO: 2751 - RNA, 17 nt, Artificial Sequence
  Synthetic
auaaaauauagauuaca

SEQ ID NO: 2752 - RNA, 17 nt, Artificial Sequence
  Synthetic
aucuggggaacucuucu

SEQ ID NO: 2753 - RNA, 17 nt, Artificial Sequence
  Synthetic
aaccucauuggugaaau

SEQ ID NO: 2754 - RNA, 17 nt, Artificial Sequence
  Synthetic
ugccaagaaccucauug

SEQ ID NO: 2755 - RNA, 17 nt, Artificial Sequence
  Synthetic
cugugugugugcaugcc

SEQ ID NO: 2756 - RNA, 17 nt, Artificial Sequence
  Synthetic
caacuguguaucuuugg

SEQ ID NO: 2757 - RNA, 17 nt, Artificial Sequence
  Synthetic
aaaacaacuguguaucu

SEQ ID NO: 2758 - RNA, 17 nt, Artificial Sequence
  Synthetic
cagggagagcauuccua

SEQ ID NO: 2759 - RNA, 17 nt, Artificial Sequence
  Synthetic
cccuaccaggcuccagg

SEQ ID NO: 2760 - RNA, 17 nt, Artificial Sequence
  Synthetic
agcacccuaccaggcuc

SEQ ID NO: 2761 - RNA, 17 nt, Artificial Sequence
  Synthetic
acagccagccagaacac

SEQ ID NO: 2762 - RNA, 17 nt, Artificial Sequence
  Synthetic
gaaaaauaacagccagc

SEQ ID NO: 2763 - RNA, 17 nt, Artificial Sequence
  Synthetic
aagacguagcagggaca

SEQ ID NO: 2764 - RNA, 17 nt, Artificial Sequence
  Synthetic
uuaagacguagcaggga

SEQ ID NO: 2765 - RNA, 17 nt, Artificial Sequence
  Synthetic
aguccuuuaagacguag

SEQ ID NO: 2766 - RNA, 17 nt, Artificial Sequence
  Synthetic
aggcacuaugcuaggaa

SEQ ID NO: 2767 - RNA, 17 nt, Artificial Sequence
  Synthetic
ugugccaggcacuaugc

SEQ ID NO: 2768 - RNA, 17 nt, Artificial Sequence
  Synthetic
cacucugcaaacucauu

SEQ ID NO: 2769 - RNA, 17 nt, Artificial Sequence
  Synthetic
uucacucugcaaacuca

SEQ ID NO: 2770 - RNA, 17 nt, Artificial Sequence
  Synthetic
ggugugcugauuucaac

SEQ ID NO: 2771 - RNA, 17 nt, Artificial Sequence
  Synthetic
cguacacacacuuacac

SEQ ID NO: 2772 - RNA, 17 nt, Artificial Sequence
  Synthetic
uggaguuucuuuuuaaa

SEQ ID NO: 2773 - RNA, 17 nt, Artificial Sequence
  Synthetic
accuuccagaagucugu

SEQ ID NO: 2774 - RNA, 17 nt, Artificial Sequence
  Synthetic
cuuagaaaauaaccuuc

SEQ ID NO: 2775 - RNA, 17 nt, Artificial Sequence
  Synthetic
gcugccagcaagauucu

SEQ ID NO: 2776 - RNA, 17 nt, Artificial Sequence
  Synthetic
cuggguggggcugugca

SEQ ID NO: 2777 - RNA, 17 nt, Artificial Sequence
  Synthetic
uggccacgugaggcugg

SEQ ID NO: 2778 - RNA, 17 nt, Artificial Sequence
  Synthetic
gagguggccacgugagg

SEQ ID NO: 2779 - RNA, 17 nt, Artificial Sequence
  Synthetic
aagacagagguggccac

SEQ ID NO: 2780 - RNA, 17 nt, Artificial Sequence
  Synthetic
cccuucaugggggaaga

SEQ ID NO: 2781 - RNA, 17 nt, Artificial Sequence
  Synthetic
uggggagccagcccuuc

SEQ ID NO: 2782 - RNA, 17 nt, Artificial Sequence
  Synthetic
agagagguuuauauaua

SEQ ID NO: 2783 - RNA, 17 nt, Artificial Sequence
  Synthetic
cucaugcccgagcucca

SEQ ID NO: 2784 - RNA, 17 nt, Artificial Sequence
  Synthetic
ggcucaugcccgagcuc

SEQ ID NO: 2785 - RNA, 17 nt, Artificial Sequence
  Synthetic
gccuugcuggcucaugc

SEQ ID NO: 2786 - RNA, 17 nt, Artificial Sequence
  Synthetic
ugcugagaggugccugg

SEQ ID NO: 2787 - RNA, 17 nt, Artificial Sequence
  Synthetic
gcugugcugagaggugc

SEQ ID NO: 2788 - RNA, 17 nt, Artificial Sequence
  Synthetic
gaaagcucugcugugcu

SEQ ID NO: 2789 - RNA, 17 nt, Artificial Sequence
  Synthetic
uggaaagcucugcugug

SEQ ID NO: 2790 - RNA, 17 nt, Artificial Sequence
  Synthetic
cuuggugaggcuuccuc

SEQ ID NO: 2791 - RNA, 17 nt, Artificial Sequence
  Synthetic
gcuuggugaggcuuccu

SEQ ID NO: 2792 - RNA, 20 nt, Artificial Sequence
  Synthetic
uguuugucucccagguuugu

SEQ ID NO: 2793 - RNA, 20 nt, Artificial Sequence
  Synthetic
gcauuggcgacugacugcuu

SEQ ID NO: 2794 - RNA, 20 nt, Artificial Sequence
  Synthetic
uguacaaggugccacagaug

SEQ ID NO: 2795 - RNA, 20 nt, Artificial Sequence
  Synthetic
ccaagcuguacaggcaaugg

SEQ ID NO: 2796 - RNA, 20 nt, Artificial Sequence
  Synthetic
agcuguacaggcaauggcag

SEQ ID NO: 2797 - RNA, 20 nt, Artificial Sequence
  Synthetic
caauggcagaaggagaugcu

SEQ ID NO: 2798 - RNA, 20 nt, Artificial Sequence
  Synthetic
gaaggagaugcucagggcuc

SEQ ID NO: 2799 - RNA, 20 nt, Artificial Sequence
  Synthetic
gggcuccuggggggagcagg

SEQ ID NO: 2800 - RNA, 20 nt, Artificial Sequence
  Synthetic
cuccuggggggagcaggcug

SEQ ID NO: 2801 - RNA, 20 nt, Artificial Sequence
  Synthetic
uggggggagcaggcugaagg

SEQ ID NO: 2802 - RNA, 20 nt, Artificial Sequence
  Synthetic
ugaagggagagccagccagc

SEQ ID NO: 2803 - RNA, 20 nt, Artificial Sequence
  Synthetic
uuuccaaguuuucauuaauc

SEQ ID NO: 2804 - RNA, 20 nt, Artificial Sequence
  Synthetic
ccaaguuuucauuaauccag

SEQ ID NO: 2805 - RNA, 20 nt, Artificial Sequence
  Synthetic
guuuucauuaauccagaagg

SEQ ID NO: 2806 - RNA, 20 nt, Artificial Sequence
  Synthetic
auggucaccaucuaacuauu

SEQ ID NO: 2807 - RNA, 20 nt, Artificial Sequence
  Synthetic
aacuauucaggaauuguagu

SEQ ID NO: 2808 - RNA, 20 nt, Artificial Sequence
  Synthetic
cuauucaggaauuguagucu

SEQ ID NO: 2809 - RNA, 20 nt, Artificial Sequence
  Synthetic
ucugccauugccuguacagc

SEQ ID NO: 2810 - RNA, 20 nt, Artificial Sequence
  Synthetic
gccugcuccccccaggagcc

SEQ ID NO: 2811 - RNA, 20 nt, Artificial Sequence
  Synthetic
ucccuucagccugcuccccc

SEQ ID NO: 2812 - RNA, 20 nt, Artificial Sequence
  Synthetic
uggaaagcagucaaagcugc

SEQ ID NO: 2813 - RNA, 20 nt, Artificial Sequence
  Synthetic
ccuucuggauuaaugaaaac

SEQ ID NO: 2814 - RNA, 20 nt, Artificial Sequence
  Synthetic
auguucauccuucuggauua

SEQ ID NO: 2815 - RNA, 20 nt, Artificial Sequence
  Synthetic
uggugaccauguucauccuu

SEQ ID NO: 2816 - RNA, 20 nt, Artificial Sequence
  Synthetic
acgcccucagacuacaauuc

SEQ ID NO: 2817 - RNA, 17 nt, Artificial Sequence
  Synthetic
uugucucccagguuugu

SEQ ID NO: 2818 - RNA, 17 nt, Artificial Sequence
  Synthetic
uuggcgacugacugcuu

SEQ ID NO: 2819 - RNA, 17 nt, Artificial Sequence
  Synthetic
acaaggugccacagaug

SEQ ID NO: 2820 - RNA, 17 nt, Artificial Sequence
  Synthetic
agcuguacaggcaaugg

SEQ ID NO: 2821 - RNA, 17 nt, Artificial Sequence
  Synthetic
uguacaggcaauggcag

SEQ ID NO: 2822 - RNA, 17 nt, Artificial Sequence
  Synthetic
uggcagaaggagaugcu

SEQ ID NO: 2823 - RNA, 17 nt, Artificial Sequence
  Synthetic
ggagaugcucagggcuc

SEQ ID NO: 2824 - RNA, 17 nt, Artificial Sequence
  Synthetic
cuccuggggggagcagg

SEQ ID NO: 2825 - RNA, 17 nt, Artificial Sequence
  Synthetic
cuggggggagcaggcug

SEQ ID NO: 2826 - RNA, 17 nt, Artificial Sequence
  Synthetic
ggggagcaggcugaagg

SEQ ID NO: 2827 - RNA, 17 nt, Artificial Sequence
  Synthetic
agggagagccagccagc

SEQ ID NO: 2828 - RNA, 17 nt, Artificial Sequence
  Synthetic
ccaaguuuucauuaauc

SEQ ID NO: 2829 - RNA, 17 nt, Artificial Sequence
  Synthetic
aguuuucauuaauccag

SEQ ID NO: 2830 - RNA, 17 nt, Artificial Sequence
  Synthetic
uucauuaauccagaagg

SEQ ID NO: 2831 - RNA, 17 nt, Artificial Sequence
  Synthetic
gucaccaucuaacuauu

SEQ ID NO: 2832 - RNA, 17 nt, Artificial Sequence
  Synthetic
uauucaggaauuguagu

SEQ ID NO: 2833 - RNA, 17 nt, Artificial Sequence
  Synthetic
uucaggaauuguagucu

SEQ ID NO: 2834 - RNA, 17 nt, Artificial Sequence
  Synthetic
gccauugccuguacagc

SEQ ID NO: 2835 - RNA, 17 nt, Artificial Sequence
  Synthetic
ugcuccccccaggagcc

SEQ ID NO: 2836 - RNA, 17 nt, Artificial Sequence
  Synthetic
cuucagccugcuccccc

SEQ ID NO: 2837 - RNA, 17 nt, Artificial Sequence
  Synthetic
aaagcagucaaagcugc

SEQ ID NO: 2838 - RNA, 17 nt, Artificial Sequence
  Synthetic
ucuggauuaaugaaaac

SEQ ID NO: 2839 - RNA, 17 nt, Artificial Sequence
  Synthetic
uucauccuucuggauua

SEQ ID NO: 2840 - RNA, 17 nt, Artificial Sequence
  Synthetic
ugaccauguucauccuu

SEQ ID NO: 2841 - RNA, 17 nt, Artificial Sequence
  Synthetic
cccucagacuacaauuc

SEQ ID NO: 2842 - RNA, 20 nt, Artificial Sequence
  Synthetic
gaaccgcuauaaguacagca

SEQ ID NO: 2843 - RNA, 17 nt, Artificial Sequence
  Synthetic
ccgcuauaaguacagca

SEQ ID NO: 2844 - RNA, 20 nt, Artificial Sequence
  Synthetic
gccuggcucugcucugggca

SEQ ID NO: 2845 - RNA, 20 nt, Artificial Sequence
  Synthetic
ugcugcuuuccaaccuccug

SEQ ID NO: 2846 - RNA, 20 nt, Artificial Sequence
  Synthetic
augacauaguucaaguuuuc

SEQ ID NO: 2847 - RNA, 20 nt, Artificial Sequence
  Synthetic
gcggacauccgugccaacug

SEQ ID NO: 2848 - RNA, 20 nt, Artificial Sequence
  Synthetic
ucucccagguuuguucgagu

SEQ ID NO: 2849 - RNA, 20 nt, Artificial Sequence
  Synthetic
auggugaccauguucauccu

SEQ ID NO: 2850 - RNA, 17 nt, Artificial Sequence
  Synthetic
uggcucugcucugggca

SEQ ID NO: 2851 - RNA, 17 nt, Artificial Sequence
  Synthetic
ugcuuuccaaccuccug

SEQ ID NO: 2852 - RNA, 17 nt, Artificial Sequence
  Synthetic
acauaguucaaguuuuc

SEQ ID NO: 2853 - RNA, 17 nt, Artificial Sequence
  Synthetic
gacauccgugccaacug

SEQ ID NO: 2854 - RNA, 17 nt, Artificial Sequence
  Synthetic
cccagguuuguucgagu

SEQ ID NO: 2855 - RNA, 17 nt, Artificial Sequence
  Synthetic
gugaccauguucauccu

SEQ ID NO: 2856 - RNA, 20 nt, Artificial Sequence
  Synthetic
cguguucugugaacacuucc

SEQ ID NO: 2857 - RNA, 20 nt, Artificial Sequence
  Synthetic
gauaguguaugagcaagaaa

SEQ ID NO: 2858 - RNA, 20 nt, Artificial Sequence
  Synthetic
aguucaagggaagucgggag

SEQ ID NO: 2859 - RNA, 20 nt, Artificial Sequence
  Synthetic
acaagguaguaacugaggcu

SEQ ID NO: 2860 - RNA, 20 nt, Artificial Sequence
  Synthetic
cauuccuaagaguaaagcca

SEQ ID NO: 2861 - RNA, 20 nt, Artificial Sequence
  Synthetic
aagccuaggucuugcugacu

SEQ ID NO: 2862 - RNA, 20 nt, Artificial Sequence
  Synthetic
ucauuucagcgauguuuacu

SEQ ID NO: 2863 - RNA, 20 nt, Artificial Sequence
  Synthetic
caaagugguaauaacaguac

SEQ ID NO: 2864 - RNA, 20 nt, Artificial Sequence
  Synthetic
caucuuucugagaagaguuc

SEQ ID NO: 2865 - RNA, 20 nt, Artificial Sequence
  Synthetic
augcacacacacagaguaag

SEQ ID NO: 2866 - RNA, 20 nt, Artificial Sequence
  Synthetic
ucuccagcucagaugcacca

SEQ ID NO: 2867 - RNA, 20 nt, Artificial Sequence
  Synthetic
ucugaggaaacacugucccc

SEQ ID NO: 2868 - RNA, 20 nt, Artificial Sequence
  Synthetic
accagaaagaaaaccgaguc

SEQ ID NO: 2869 - RNA, 20 nt, Artificial Sequence
  Synthetic
aggucucccgacuucccuug

SEQ ID NO: 2870 - RNA, 20 nt, Artificial Sequence
  Synthetic
ucagauaguaaacaucgcug

SEQ ID NO: 2871 - RNA, 20 nt, Artificial Sequence
  Synthetic
gcucuaaagauucuauucuu

SEQ ID NO: 2872 - RNA, 20 nt, Artificial Sequence
  Synthetic
uggagaaacacaguuugcuc

SEQ ID NO: 2873 - RNA, 20 nt, Artificial Sequence
  Synthetic
uaacuuuaagccacuugaaa

SEQ ID NO: 2874 - RNA, 20 nt, Artificial Sequence
  Synthetic
uguaauauaguauaaaaugu

SEQ ID NO: 2875 - RNA, 20 nt, Artificial Sequence
  Synthetic
aggaaacaaaugauaaugaa

SEQ ID NO: 2876 - RNA, 20 nt, Artificial Sequence
  Synthetic
auguuuucaaauauauaaaa

SEQ ID NO: 2877 - RNA, 20 nt, Artificial Sequence
  Synthetic
gagagcauuccuauagaagc

SEQ ID NO: 2878 - RNA, 20 nt, Artificial Sequence
  Synthetic
uuacaccaggacuacuggug

SEQ ID NO: 2879 - RNA, 20 nt, Artificial Sequence
  Synthetic
ggguugccuucacgcugcca

SEQ ID NO: 2880 - RNA, 17 nt, Artificial Sequence
  Synthetic
guucugugaacacuucc

SEQ ID NO: 2881 - RNA, 17 nt, Artificial Sequence
  Synthetic
aguguaugagcaagaaa

SEQ ID NO: 2882 - RNA, 17 nt, Artificial Sequence
  Synthetic
ucaagggaagucgggag

SEQ ID NO: 2883 - RNA, 17 nt, Artificial Sequence
  Synthetic
agguaguaacugaggcu

SEQ ID NO: 2884 - RNA, 17 nt, Artificial Sequence
  Synthetic
uccuaagaguaaagcca

SEQ ID NO: 2885 - RNA, 17 nt, Artificial Sequence
  Synthetic
ccuaggucuugcugacu

SEQ ID NO: 2886 - RNA, 17 nt, Artificial Sequence
  Synthetic
uuucagcgauguuuacu

SEQ ID NO: 2887 - RNA, 17 nt, Artificial Sequence
  Synthetic
agugguaauaacaguac

SEQ ID NO: 2888 - RNA, 17 nt, Artificial Sequence
  Synthetic
cuuucugagaagaguuc

SEQ ID NO: 2889 - RNA, 17 nt, Artificial Sequence
  Synthetic
cacacacacagaguaag

SEQ ID NO: 2890 - RNA, 17 nt, Artificial Sequence
  Synthetic
ccagcucagaugcacca

SEQ ID NO: 2891 - RNA, 17 nt, Artificial Sequence
  Synthetic
gaggaaacacugucccc

SEQ ID NO: 2892 - RNA, 17 nt, Artificial Sequence
  Synthetic
agaaagaaaaccgaguc

SEQ ID NO: 2893 - RNA, 17 nt, Artificial Sequence
  Synthetic
ucucccgacuucccuug

SEQ ID NO: 2894 - RNA, 17 nt, Artificial Sequence
  Synthetic
gauaguaaacaucgcug

SEQ ID NO: 2895 - RNA, 17 nt, Artificial Sequence
  Synthetic
cuaaagauucuauucuu

SEQ ID NO: 2896 - RNA, 17 nt, Artificial Sequence
  Synthetic
agaaacacaguuugcuc

SEQ ID NO: 2897 - RNA, 17 nt, Artificial Sequence
  Synthetic
cuuuaagccacuugaaa

SEQ ID NO: 2898 - RNA, 17 nt, Artificial Sequence
  Synthetic
aauauaguauaaaaugu

SEQ ID NO: 2899 - RNA, 17 nt, Artificial Sequence
  Synthetic
aaacaaaugauaaugaa

SEQ ID NO: 2900 - RNA, 17 nt, Artificial Sequence
  Synthetic
uuuucaaauauauaaaa

SEQ ID NO: 2901 - RNA, 17 nt, Artificial Sequence
  Synthetic
agcauuccuauagaagc

SEQ ID NO: 2902 - RNA, 17 nt, Artificial Sequence
  Synthetic
caccaggacuacuggug

SEQ ID NO: 2903 - RNA, 17 nt, Artificial Sequence
  Synthetic
uugccuucacgcugcca

SEQ ID NO: 2904 - RNA, 17 nt, Artificial Sequence
  Synthetic
accaagccucugcaaug

SEQ ID NO: 2905 - RNA, 20 nt, Artificial Sequence
  Synthetic
acagaagaaccucauugcag

SEQ ID NO: 2906 - RNA, 20 nt, Artificial Sequence
  Synthetic
cucaccaagccucugcaaug

SEQ ID NO: 2907 - RNA, 20 nt, Artificial Sequence
  Synthetic
cucauugcagaggcuuggug

SEQ ID NO: 2908 - RNA, 20 nt, Artificial Sequence
  Synthetic
agaaccucauugcagaggcu

SEQ ID NO: 2909 - RNA, 17 nt, Artificial Sequence
  Synthetic
gaagaaccucauugcag

SEQ ID NO: 2910 - RNA, 17 nt, Artificial Sequence
  Synthetic
auugcagaggcuuggug

SEQ ID NO: 2911 - RNA, 17 nt, Artificial Sequence
  Synthetic
accucauugcagaggcu

SEQ ID NO: 2912 - RNA, 17 nt, Artificial Sequence
  Synthetic
gauucccacaaaguuca

SEQ ID NO: 2913 - RNA, 17 nt, Artificial Sequence
  Synthetic
ccaccaggcuccagaga

SEQ ID NO: 2914 - RNA, 17 nt, Artificial Sequence
  Synthetic
ucuuuucugaauuuacc

SEQ ID NO: 2915 - RNA, 17 nt, Artificial Sequence
  Synthetic
uuaccuucucuggagcc

SEQ ID NO: 2916 - RNA, 17 nt, Artificial Sequence
  Synthetic
ugcauucuuaccuucuc

SEQ ID NO: 2917 - RNA, 17 nt, Artificial Sequence
  Synthetic
aagguaagaaugcagag

SEQ ID NO: 2918 - RNA, 17 nt, Artificial Sequence
  Synthetic
uaagaaugcagaguggg

SEQ ID NO: 2919 - RNA, 17 nt, Artificial Sequence
  Synthetic
ccuucucuggagccugg

SEQ ID NO: 2920 - RNA, 17 nt, Artificial Sequence
  Synthetic
guaagaaugcagagugg

SEQ ID NO: 2921 - RNA, 17 nt, Artificial Sequence
  Synthetic
gguaagaaugcagagug

SEQ ID NO: 2922 - RNA, 17 nt, Artificial Sequence
  Synthetic
cucuuccuugaacuuug

SEQ ID NO: 2923 - RNA, 17 nt, Artificial Sequence
  Synthetic
agguaagaaugcagagu

SEQ ID NO: 2924 - RNA, 17 nt, Artificial Sequence
  Synthetic
uucaaggaagagaacgu

SEQ ID NO: 2925 - RNA, 17 nt, Artificial Sequence
  Synthetic
ucuuccuugaacuuugu

SEQ ID NO: 2926 - RNA, 17 nt, Artificial Sequence
  Synthetic
ucaaggaagagaacguu

SEQ ID NO: 2927 - RNA, 20 nt, Artificial Sequence
  Synthetic
gugccaccaggcuccagaga

SEQ ID NO: 2928 - RNA, 20 nt, Artificial Sequence
  Synthetic
uuuucuuuucugaauuuacc

SEQ ID NO: 2929 - RNA, 20 nt, Artificial Sequence
  Synthetic
uucuuaccuucucuggagcc

SEQ ID NO: 2930 - RNA, 20 nt, Artificial Sequence
  Synthetic
cucugcauucuuaccuucuc

SEQ ID NO: 2931 - RNA, 20 nt, Artificial Sequence
  Synthetic
gagaagguaagaaugcagag

SEQ ID NO: 2932 - RNA, 20 nt, Artificial Sequence
  Synthetic
agguaagaaugcagaguggg

SEQ ID NO: 2933 - RNA, 20 nt, Artificial Sequence
  Synthetic
uuaccuucucuggagccugg

SEQ ID NO: 2934 - RNA, 20 nt, Artificial Sequence
  Synthetic
aagguaagaaugcagagugg

SEQ ID NO: 2935 - RNA, 20 nt, Artificial Sequence
  Synthetic
gaagguaagaaugcagagug

SEQ ID NO: 2936 - RNA, 20 nt, Artificial Sequence
  Synthetic
guucucuuccuugaacuuug

SEQ ID NO: 2937 - RNA, 20 nt, Artificial Sequence
  Synthetic
agaagguaagaaugcagagu

SEQ ID NO: 2938 - RNA, 20 nt, Artificial Sequence
  Synthetic
aaguucaaggaagagaacgu

SEQ ID NO: 2939 - RNA, 20 nt, Artificial Sequence
  Synthetic
uucucuuccuugaacuuugu

SEQ ID NO: 2940 - RNA, 20 nt, Artificial Sequence
  Synthetic
aguucaaggaagagaacguu

SEQ ID NO: 2941 - RNA, 18 nt, Artificial Sequence
  Synthetic
ggccuccaggucuaagcg

SEQ ID NO: 2942 - RNA, 21 nt, Artificial Sequence
  Synthetic
gguggccuccaggucuaagcg

SEQ ID NO: 2943 - RNA, 19 nt, Artificial Sequence
  Synthetic
gcuggucccgcucccgccu

SEQ ID NO: 2944 - RNA, 21 nt, Artificial Sequence
  Synthetic
ggcagucuccaacucucuggu

SEQ ID NO: 2945 - RNA, 24 nt, Artificial Sequence
  Synthetic
guaggcagucuccaacucucuggu

SEQ ID NO: 2946 - RNA, 18 nt, Artificial Sequence
  Synthetic
gcugucucucuguaaguu

SEQ ID NO: 2947 - RNA, 21 nt, Artificial Sequence
  Synthetic
gcugcugucucucuguaaguu

SEQ ID NO: 2948 - RNA, 23 nt, Artificial Sequence
  Synthetic
gugcugcugucucucuguaaguu

SEQ ID NO: 2949 - RNA, 24 nt, Artificial Sequence
  Synthetic
ggugcugcugucucucuguaaguu

SEQ ID NO: 2950 - RNA, 22 nt, Artificial Sequence
  Synthetic
gaccagcuggaaacccaaacca

SEQ ID NO: 2951 - RNA, 23 nt, Artificial Sequence
  Synthetic
ggaccagcuggaaacccaaacca

SEQ ID NO: 2952 - RNA, 24 nt, Artificial Sequence
  Synthetic
gggaccagcuggaaacccaaacca

SEQ ID NO: 2953 - RNA, 19 nt, Artificial Sequence
  Synthetic
gcucaggaaggccaaugac

SEQ ID NO: 2954 - RNA, 24 nt, Artificial Sequence
  Synthetic
gcucagcucaggaaggccaaugac

SEQ ID NO: 2955 - RNA, 19 nt, Artificial Sequence
  Synthetic
gcuucuggccugccuggug

SEQ ID NO: 2956 - RNA, 19 nt, Artificial Sequence
  Synthetic
gcgacuaaggcaagaaaau

SEQ ID NO: 2957 - RNA, 22 nt, Artificial Sequence
  Synthetic
gaagcgacuaaggcaagaaaau

SEQ ID NO: 2958 - RNA, 19 nt, Artificial Sequence
  Synthetic
uggccuccaggucuaagcg

SEQ ID NO: 2959 - RNA, 22 nt, Artificial Sequence
  Synthetic
ugguggccuccaggucuaagcg

SEQ ID NO: 2960 - RNA, 23 nt, Artificial Sequence
  Synthetic
uugguggccuccaggucuaagcg

SEQ ID NO: 2961 - RNA, 24 nt, Artificial Sequence
  Synthetic
uuugguggccuccaggucuaagcg

SEQ ID NO: 2962 - RNA, 18 nt, Artificial Sequence
  Synthetic
cuggucccgcucccgccu

SEQ ID NO: 2963 - RNA, 21 nt, Artificial Sequence
  Synthetic
cagcuggucccgcucccgccu

SEQ ID NO: 2964 - RNA, 22 nt, Artificial Sequence
  Synthetic
ccagcuggucccgcucccgccu

SEQ ID NO: 2965 - RNA, 23 nt, Artificial Sequence
  Synthetic
uccagcuggucccgcucccgccu

SEQ ID NO: 2966 - RNA, 24 nt, Artificial Sequence
  Synthetic
uuccagcuggucccgcucccgccu

SEQ ID NO: 2967 - RNA, 22 nt, Artificial Sequence
  Synthetic
aggcagucuccaacucucuggu

SEQ ID NO: 2968 - RNA, 23 nt, Artificial Sequence
  Synthetic
uaggcagucuccaacucucuggu

SEQ ID NO: 2969 - RNA, 19 nt, Artificial Sequence
  Synthetic
ugcugucucucuguaaguu

SEQ ID NO: 2970 - RNA, 22 nt, Artificial Sequence
  Synthetic
ugcugcugucucucuguaaguu

SEQ ID NO: 2971 - RNA, 18 nt, Artificial Sequence
  Synthetic
agcuggaaacccaaacca

SEQ ID NO: 2972 - RNA, 19 nt, Artificial Sequence
  Synthetic
cagcuggaaacccaaacca

SEQ ID NO: 2973 - RNA, 21 nt, Artificial Sequence
  Synthetic
accagcuggaaacccaaacca

SEQ ID NO: 2974 - RNA, 18 nt, Artificial Sequence
  Synthetic
ucaguguggccaguccca

SEQ ID NO: 2975 - RNA, 19 nt, Artificial Sequence
  Synthetic
uucaguguggccaguccca

SEQ ID NO: 2976 - RNA, 21 nt, Artificial Sequence
  Synthetic
ccuucaguguggccaguccca

SEQ ID NO: 2977 - RNA, 22 nt, Artificial Sequence
  Synthetic
accuucaguguggccaguccca

SEQ ID NO: 2978 - RNA, 23 nt, Artificial Sequence
  Synthetic
uaccuucaguguggccaguccca

SEQ ID NO: 2979 - RNA, 24 nt, Artificial Sequence
  Synthetic
auaccuucaguguggccaguccca

SEQ ID NO: 2980 - RNA, 18 nt, Artificial Sequence
  Synthetic
cucaggaaggccaaugac

SEQ ID NO: 2981 - RNA, 21 nt, Artificial Sequence
  Synthetic
cagcucaggaaggccaaugac

SEQ ID NO: 2982 - RNA, 22 nt, Artificial Sequence
  Synthetic
ucagcucaggaaggccaaugac

SEQ ID NO: 2983 - RNA, 23 nt, Artificial Sequence
  Synthetic
cucagcucaggaaggccaaugac

SEQ ID NO: 2984 - RNA, 18 nt, Artificial Sequence
  Synthetic
cuucuggccugccuggug

SEQ ID NO: 2985 - RNA, 18 nt, Artificial Sequence
  Synthetic
cgacuaaggcaagaaaau

SEQ ID NO: 2986 - RNA, 21 nt, Artificial Sequence
  Synthetic
aagcgacuaaggcaagaaaau

SEQ ID NO: 2987 - RNA, 23 nt, Artificial Sequence
  Synthetic
agaagcgacuaaggcaagaaaau

SEQ ID NO: 2988 - RNA, 24 nt, Artificial Sequence
  Synthetic
aagaagcgacuaaggcaagaaaau

SEQ ID NO: 2989 - RNA, 18 nt, Artificial Sequence
  Synthetic
cucccucugcagccccuc

SEQ ID NO: 2990 - RNA, 19 nt, Artificial Sequence
  Synthetic
gcucccucugcagccccuc

SEQ ID NO: 2991 - RNA, 21 nt, Artificial Sequence
  Synthetic
cagcucccucugcagccccuc

SEQ ID NO: 2992 - RNA, 22 nt, Artificial Sequence
  Synthetic
ccagcucccucugcagccccuc

SEQ ID NO: 2993 - RNA, 23 nt, Artificial Sequence
  Synthetic
cccagcucccucugcagccccuc

SEQ ID NO: 2994 - RNA, 24 nt, Artificial Sequence
  Synthetic
gcccagcucccucugcagccccuc

SEQ ID NO: 2995 - RNA, 18 nt, Artificial Sequence
  Synthetic
uggcucugcucugggcag

SEQ ID NO: 2996 - RNA, 19 nt, Artificial Sequence
  Synthetic
cuggcucugcucugggcag

SEQ ID NO: 2997 - RNA, 21 nt, Artificial Sequence
  Synthetic
gccuggcucugcucugggcag

SEQ ID NO: 2998 - RNA, 22 nt, Artificial Sequence
  Synthetic
ggccuggcucugcucugggcag

SEQ ID NO: 2999 - RNA, 23 nt, Artificial Sequence
  Synthetic
uggccuggcucugcucugggcag

SEQ ID NO: 3000 - RNA, 24 nt, Artificial Sequence
  Synthetic
auggccuggcucugcucugggcag

SEQ ID NO: 3001 - RNA, 18 nt, Artificial Sequence
  Synthetic
aggaggcucuccagggag

SEQ ID NO: 3002 - RNA, 19 nt, Artificial Sequence
  Synthetic
gaggaggcucuccagggag

SEQ ID NO: 3003 - RNA, 21 nt, Artificial Sequence
  Synthetic
uggaggaggcucuccagggag

SEQ ID NO: 3004 - RNA, 22 nt, Artificial Sequence
  Synthetic
guggaggaggcucuccagggag

SEQ ID NO: 3005 - RNA, 23 nt, Artificial Sequence
  Synthetic
gguggaggaggcucuccagggag

SEQ ID NO: 3006 - RNA, 24 nt, Artificial Sequence
  Synthetic
ugguggaggaggcucuccagggag

SEQ ID NO: 3007 - RNA, 18 nt, Artificial Sequence
  Synthetic
agucuccaacucucuggu

SEQ ID NO: 3008 - RNA, 19 nt, Artificial Sequence
  Synthetic
cagucuccaacucucuggu

SEQ ID NO: 3009 - RNA, 21 nt, Artificial Sequence
  Synthetic
cugcuucuggccugccuggug

SEQ ID NO: 3010 - RNA, 22 nt, Artificial Sequence
  Synthetic
gcugcuucuggccugccuggug

SEQ ID NO: 3011 - RNA, 23 nt, Artificial Sequence
  Synthetic
ugcugcuucuggccugccuggug

SEQ ID NO: 3012 - RNA, 24 nt, Artificial Sequence
  Synthetic
cugcugcuucuggccugccuggug

SEQ ID NO: 3013 - RNA, 18 nt, Artificial Sequence
  Synthetic
ucauugggacuggccaca

SEQ ID NO: 3014 - RNA, 19 nt, Artificial Sequence
  Synthetic
uucauugggacuggccaca

SEQ ID NO: 3015 - RNA, 21 nt, Artificial Sequence
  Synthetic
gauucauugggacuggccaca

SEQ ID NO: 3016 - RNA, 22 nt, Artificial Sequence
  Synthetic
ggauucauugggacuggccaca

SEQ ID NO: 3017 - RNA, 23 nt, Artificial Sequence
  Synthetic
uggauucauugggacuggccaca

SEQ ID NO: 3018 - RNA, 24 nt, Artificial Sequence
  Synthetic
cuggauucauugggacuggccaca

SEQ ID NO: 3019 - RNA, 18 nt, Artificial Sequence
  Synthetic
gguggaggaggcucucca

SEQ ID NO: 3020 - RNA, 19 nt, Artificial Sequence
  Synthetic
ugguggaggaggcucucca

SEQ ID NO: 3021 - RNA, 21 nt, Artificial Sequence
  Synthetic
auugguggaggaggcucucca

SEQ ID NO: 3022 - RNA, 22 nt, Artificial Sequence
  Synthetic
aauugguggaggaggcucucca

SEQ ID NO: 3023 - RNA, 23 nt, Artificial Sequence
  Synthetic
caauugguggaggaggcucucca

SEQ ID NO: 3024 - RNA, 24 nt, Artificial Sequence
  Synthetic
ucaauugguggaggaggcucucca

SEQ ID NO: 3025 - RNA, 18 nt, Artificial Sequence
  Synthetic
aagcugcagcaacgugca

SEQ ID NO: 3026 - RNA, 19 nt, Artificial Sequence
  Synthetic
aaagcugcagcaacgugca

SEQ ID NO: 3027 - RNA, 21 nt, Artificial Sequence
  Synthetic
ccaaagcugcagcaacgugca

SEQ ID NO: 3028 - RNA, 22 nt, Artificial Sequence
  Synthetic
cccaaagcugcagcaacgugca

SEQ ID NO: 3029 - RNA, 23 nt, Artificial Sequence
  Synthetic
gcccaaagcugcagcaacgugca

SEQ ID NO: 3030 - RNA, 24 nt, Artificial Sequence
  Synthetic
ggcccaaagcugcagcaacgugca

SEQ ID NO: 3031 - RNA, 18 nt, Artificial Sequence
  Synthetic
ucugggcagcuggauuca

SEQ ID NO: 3032 - RNA, 19 nt, Artificial Sequence
  Synthetic
cucugggcagcuggauuca

SEQ ID NO: 3033 - RNA, 21 nt, Artificial Sequence
  Synthetic
ugcucugggcagcuggauuca

SEQ ID NO: 3034 - RNA, 22 nt, Artificial Sequence
  Synthetic
cugcucugggcagcuggauuca

SEQ ID NO: 3035 - RNA, 23 nt, Artificial Sequence
  Synthetic
ucugcucugggcagcuggauuca

SEQ ID NO: 3036 - RNA, 24 nt, Artificial Sequence
  Synthetic
cucugcucugggcagcuggauuca

SEQ ID NO: 3037 - RNA, 18 nt, Artificial Sequence
  Synthetic
ugguggaggaggcucucc

SEQ ID NO: 3038 - RNA, 19 nt, Artificial Sequence
  Synthetic
uugguggaggaggcucucc

SEQ ID NO: 3039 - RNA, 21 nt, Artificial Sequence
  Synthetic
aauugguggaggaggcucucc

SEQ ID NO: 3040 - RNA, 22 nt, Artificial Sequence
  Synthetic
caauugguggaggaggcucucc

SEQ ID NO: 3041 - RNA, 23 nt, Artificial Sequence
  Synthetic
ucaauugguggaggaggcucucc

SEQ ID NO: 3042 - RNA, 24 nt, Artificial Sequence
  Synthetic
gucaauugguggaggaggcucucc

SEQ ID NO: 3043 - RNA, 18 nt, Artificial Sequence
  Synthetic
agccccuccugggucucc

SEQ ID NO: 3044 - RNA, 19 nt, Artificial Sequence
  Synthetic
cagccccuccugggucucc

SEQ ID NO: 3045 - RNA, 21 nt, Artificial Sequence
  Synthetic
ugcagccccuccugggucucc

SEQ ID NO: 3046 - RNA, 22 nt, Artificial Sequence
  Synthetic
cugcagccccuccugggucucc

SEQ ID NO: 3047 - RNA, 23 nt, Artificial Sequence
  Synthetic
ucugcagccccuccugggucucc

SEQ ID NO: 3048 - RNA, 24 nt, Artificial Sequence
  Synthetic
cucugcagccccuccugggucucc

SEQ ID NO: 3049 - RNA, 18 nt, Artificial Sequence
  Synthetic
aucccacaccaggcaggc

SEQ ID NO: 3050 - RNA, 19 nt, Artificial Sequence
  Synthetic
caucccacaccaggcaggc

SEQ ID NO: 3051 - RNA, 21 nt, Artificial Sequence
  Synthetic
cacaucccacaccaggcaggc

SEQ ID NO: 3052 - RNA, 22 nt, Artificial Sequence
  Synthetic
ccacaucccacaccaggcaggc

SEQ ID NO: 3053 - RNA, 23 nt, Artificial Sequence
  Synthetic
cccacaucccacaccaggcaggc

SEQ ID NO: 3054 - RNA, 24 nt, Artificial Sequence
  Synthetic
ccccacaucccacaccaggcaggc

SEQ ID NO: 3055 - RNA, 18 nt, Artificial Sequence
  Synthetic
gcuuggugaggcuuccuc

SEQ ID NO: 3056 - RNA, 19 nt, Artificial Sequence
  Synthetic
ggcuuggugaggcuuccuc

SEQ ID NO: 3057 - RNA, 21 nt, Artificial Sequence
  Synthetic
gaggcuuggugaggcuuccuc

SEQ ID NO: 3058 - RNA, 22 nt, Artificial Sequence
  Synthetic
agaggcuuggugaggcuuccuc

SEQ ID NO: 3059 - RNA, 23 nt, Artificial Sequence
  Synthetic
cagaggcuuggugaggcuuccuc

SEQ ID NO: 3060 - RNA, 24 nt, Artificial Sequence
  Synthetic
gcagaggcuuggugaggcuuccuc

SEQ ID NO: 3061 - RNA, 18 nt, Artificial Sequence
  Synthetic
ucgcuucuucucuuccuc

SEQ ID NO: 3062 - RNA, 19 nt, Artificial Sequence
  Synthetic
gucgcuucuucucuuccuc

SEQ ID NO: 3063 - RNA, 21 nt, Artificial Sequence
  Synthetic
uagucgcuucuucucuuccuc

SEQ ID NO: 3064 - RNA, 22 nt, Artificial Sequence
  Synthetic
uuagucgcuucuucucuuccuc

SEQ ID NO: 3065 - RNA, 23 nt, Artificial Sequence
  Synthetic
cuuagucgcuucuucucuuccuc

SEQ ID NO: 3066 - RNA, 24 nt, Artificial Sequence
  Synthetic
ccuuagucgcuucuucucuuccuc

SEQ ID NO: 3067 - RNA, 18 nt, Artificial Sequence
  Synthetic
uugguggaggaggcucuc

SEQ ID NO: 3068 - RNA, 19 nt, Artificial Sequence
  Synthetic
auugguggaggaggcucuc

SEQ ID NO: 3069 - RNA, 21 nt, Artificial Sequence
  Synthetic
caauugguggaggaggcucuc

SEQ ID NO: 3070 - RNA, 22 nt, Artificial Sequence
  Synthetic
ucaauugguggaggaggcucuc

SEQ ID NO: 3071 - RNA, 23 nt, Artificial Sequence
  Synthetic
gucaauugguggaggaggcucuc

SEQ ID NO: 3072 - RNA, 24 nt, Artificial Sequence
  Synthetic
ggucaauugguggaggaggcucuc

SEQ ID NO: 3073 - RNA, 18 nt, Artificial Sequence
  Synthetic
cagccccuccugggucuc

SEQ ID NO: 3074 - RNA, 19 nt, Artificial Sequence
  Synthetic
gcagccccuccugggucuc

SEQ ID NO: 3075 - RNA, 21 nt, Artificial Sequence
  Synthetic
cugcagccccuccugggucuc

SEQ ID NO: 3076 - RNA, 22 nt, Artificial Sequence
  Synthetic
ucugcagccccuccugggucuc

SEQ ID NO: 3077 - RNA, 23 nt, Artificial Sequence
  Synthetic
cucugcagccccuccugggucuc

SEQ ID NO: 3078 - RNA, 24 nt, Artificial Sequence
  Synthetic
ccucugcagccccuccugggucuc

SEQ ID NO: 3079 - RNA, 18 nt, Artificial Sequence
  Synthetic
cuccagaacugacuuguc

SEQ ID NO: 3080 - RNA, 19 nt, Artificial Sequence
  Synthetic
ccuccagaacugacuuguc

SEQ ID NO: 3081 - RNA, 21 nt, Artificial Sequence
  Synthetic
uuccuccagaacugacuuguc

SEQ ID NO: 3082 - RNA, 22 nt, Artificial Sequence
  Synthetic
cuuccuccagaacugacuuguc

SEQ ID NO: 3083 - RNA, 23 nt, Artificial Sequence
  Synthetic
ucuuccuccagaacugacuuguc

SEQ ID NO: 3084 - RNA, 24 nt, Artificial Sequence
  Synthetic
cucuuccuccagaacugacuuguc

SEQ ID NO: 3085 - RNA, 18 nt, Artificial Sequence
  Synthetic
cucuggucauuggccuuc

SEQ ID NO: 3086 - RNA, 19 nt, Artificial Sequence
  Synthetic
acucuggucauuggccuuc

SEQ ID NO: 3087 - RNA, 21 nt, Artificial Sequence
  Synthetic
ccacucuggucauuggccuuc

SEQ ID NO: 3088 - RNA, 22 nt, Artificial Sequence
  Synthetic
gccacucuggucauuggccuuc

SEQ ID NO: 3089 - RNA, 23 nt, Artificial Sequence
  Synthetic
ggccacucuggucauuggccuuc

SEQ ID NO: 3090 - RNA, 24 nt, Artificial Sequence
  Synthetic
cggccacucuggucauuggccuuc

SEQ ID NO: 3091 - RNA, 18 nt, Artificial Sequence
  Synthetic
cugcagcaacgugcacag

SEQ ID NO: 3092 - RNA, 19 nt, Artificial Sequence
  Synthetic
gcugcagcaacgugcacag

SEQ ID NO: 3093 - RNA, 21 nt, Artificial Sequence
  Synthetic
aagcugcagcaacgugcacag

SEQ ID NO: 3094 - RNA, 22 nt, Artificial Sequence
  Synthetic
aaagcugcagcaacgugcacag

SEQ ID NO: 3095 - RNA, 23 nt, Artificial Sequence
  Synthetic
caaagcugcagcaacgugcacag

SEQ ID NO: 3096 - RNA, 24 nt, Artificial Sequence
  Synthetic
ccaaagcugcagcaacgugcacag

SEQ ID NO: 3097 - RNA, 18 nt, Artificial Sequence
  Synthetic
gcaggccagaagcagcag

SEQ ID NO: 3098 - RNA, 19 nt, Artificial Sequence
  Synthetic
ggcaggccagaagcagcag

SEQ ID NO: 3099 - RNA, 21 nt, Artificial Sequence
  Synthetic
caggcaggccagaagcagcag

SEQ ID NO: 3100 - RNA, 22 nt, Artificial Sequence
  Synthetic
ccaggcaggccagaagcagcag

SEQ ID NO: 3101 - RNA, 23 nt, Artificial Sequence
  Synthetic
accaggcaggccagaagcagcag

SEQ ID NO: 3102 - RNA, 24 nt, Artificial Sequence
  Synthetic
caccaggcaggccagaagcagcag

SEQ ID NO: 3103 - RNA, 18 nt, Artificial Sequence
  Synthetic
gucauuggccuuccugag

SEQ ID NO: 3104 - RNA, 19 nt, Artificial Sequence
  Synthetic
ggucauuggccuuccugag

SEQ ID NO: 3105 - RNA, 21 nt, Artificial Sequence
  Synthetic
cuggucauuggccuuccugag

SEQ ID NO: 3106 - RNA, 22 nt, Artificial Sequence
  Synthetic
ucuggucauuggccuuccugag

SEQ ID NO: 3107 - RNA, 23 nt, Artificial Sequence
  Synthetic
cucuggucauuggccuuccugag

SEQ ID NO: 3108 - RNA, 24 nt, Artificial Sequence
  Synthetic
acucuggucauuggccuuccugag

SEQ ID NO: 3109 - RNA, 18 nt, Artificial Sequence
  Synthetic
gcucuccagggagcugag

SEQ ID NO: 3110 - RNA, 19 nt, Artificial Sequence
  Synthetic
ggcucuccagggagcugag

SEQ ID NO: 3111 - RNA, 21 nt, Artificial Sequence
  Synthetic
gaggcucuccagggagcugag

SEQ ID NO: 3112 - RNA, 22 nt, Artificial Sequence
  Synthetic
ggaggcucuccagggagcugag

SEQ ID NO: 3113 - RNA, 23 nt, Artificial Sequence
  Synthetic
aggaggcucuccagggagcugag

SEQ ID NO: 3114 - RNA, 24 nt, Artificial Sequence
  Synthetic
gaggaggcucuccagggagcugag

SEQ ID NO: 3115 - RNA, 18 nt, Artificial Sequence
  Synthetic
cagaacugacuugucucg

SEQ ID NO: 3116 - RNA, 19 nt, Artificial Sequence
  Synthetic
ccagaacugacuugucucg

SEQ ID NO: 3117 - RNA, 21 nt, Artificial Sequence
  Synthetic
cuccagaacugacuugucucg

SEQ ID NO: 3118 - RNA, 22 nt, Artificial Sequence
  Synthetic
ccuccagaacugacuugucucg

SEQ ID NO: 3119 - RNA, 23 nt, Artificial Sequence
  Synthetic
uccuccagaacugacuugucucg

SEQ ID NO: 3120 - RNA, 24 nt, Artificial Sequence
  Synthetic
uuccuccagaacugacuugucucg

SEQ ID NO: 3121 - RNA, 18 nt, Artificial Sequence
  Synthetic
agaacugacuugucucgg

SEQ ID NO: 3122 - RNA, 19 nt, Artificial Sequence
  Synthetic
cagaacugacuugucucgg

SEQ ID NO: 3123 - RNA, 21 nt, Artificial Sequence
  Synthetic
uccagaacugacuugucucgg

SEQ ID NO: 3124 - RNA, 22 nt, Artificial Sequence
  Synthetic
cuccagaacugacuugucucgg

SEQ ID NO: 3125 - RNA, 23 nt, Artificial Sequence
  Synthetic
ccuccagaacugacuugucucgg

SEQ ID NO: 3126 - RNA, 24 nt, Artificial Sequence
  Synthetic
uccuccagaacugacuugucucgg

SEQ ID NO: 3127 - RNA, 18 nt, Artificial Sequence
  Synthetic
uccaaggucaauuggugg

SEQ ID NO: 3128 - RNA, 19 nt, Artificial Sequence
  Synthetic
guccaaggucaauuggugg

SEQ ID NO: 3129 - RNA, 21 nt, Artificial Sequence
  Synthetic
ugguccaaggucaauuggugg

SEQ ID NO: 3130 - RNA, 22 nt, Artificial Sequence
  Synthetic
cugguccaaggucaauuggugg

SEQ ID NO: 3131 - RNA, 23 nt, Artificial Sequence
  Synthetic
ccugguccaaggucaauuggugg

SEQ ID NO: 3132 - RNA, 24 nt, Artificial Sequence
  Synthetic
gccugguccaaggucaauuggugg

SEQ ID NO: 3133 - RNA, 18 nt, Artificial Sequence
  Synthetic
ugguccaaggucaauugg

SEQ ID NO: 3134 - RNA, 19 nt, Artificial Sequence
  Synthetic
cugguccaaggucaauugg

SEQ ID NO: 3135 - RNA, 21 nt, Artificial Sequence
  Synthetic
gccugguccaaggucaauugg

SEQ ID NO: 3136 - RNA, 22 nt, Artificial Sequence
  Synthetic
agccugguccaaggucaauugg

SEQ ID NO: 3137 - RNA, 23 nt, Artificial Sequence
  Synthetic
cagccugguccaaggucaauugg

SEQ ID NO: 3138 - RNA, 24 nt, Artificial Sequence
  Synthetic
gcagccugguccaaggucaauugg

SEQ ID NO: 3139 - RNA, 18 nt, Artificial Sequence
  Synthetic
guccaaggucaauuggug

SEQ ID NO: 3140 - RNA, 19 nt, Artificial Sequence
  Synthetic
gguccaaggucaauuggug

SEQ ID NO: 3141 - RNA, 21 nt, Artificial Sequence
  Synthetic
cugguccaaggucaauuggug

SEQ ID NO: 3142 - RNA, 22 nt, Artificial Sequence
  Synthetic
ccugguccaaggucaauuggug

SEQ ID NO: 3143 - RNA, 23 nt, Artificial Sequence
  Synthetic
gccugguccaaggucaauuggug

SEQ ID NO: 3144 - RNA, 24 nt, Artificial Sequence
  Synthetic
agccugguccaaggucaauuggug

SEQ ID NO: 3145 - RNA, 18 nt, Artificial Sequence
  Synthetic
cugguccaaggucaauug

SEQ ID NO: 3146 - RNA, 19 nt, Artificial Sequence
  Synthetic
ccugguccaaggucaauug

SEQ ID NO: 3147 - RNA, 21 nt, Artificial Sequence
  Synthetic
agccugguccaaggucaauug

SEQ ID NO: 3148 - RNA, 22 nt, Artificial Sequence
  Synthetic
cagccugguccaaggucaauug

SEQ ID NO: 3149 - RNA, 23 nt, Artificial Sequence
  Synthetic
gcagccugguccaaggucaauug

SEQ ID NO: 3150 - RNA, 24 nt, Artificial Sequence
  Synthetic
ggcagccugguccaaggucaauug

SEQ ID NO: 3151 - RNA, 18 nt, Artificial Sequence
  Synthetic
cacagaagaaccucauug

SEQ ID NO: 3152 - RNA, 19 nt, Artificial Sequence
  Synthetic
gcacagaagaaccucauug

SEQ ID NO: 3153 - RNA, 21 nt, Artificial Sequence
  Synthetic
gugcacagaagaaccucauug

SEQ ID NO: 3154 - RNA, 22 nt, Artificial Sequence
  Synthetic
cgugcacagaagaaccucauug

SEQ ID NO: 3155 - RNA, 23 nt, Artificial Sequence
  Synthetic
acgugcacagaagaaccucauug

SEQ ID NO: 3156 - RNA, 24 nt, Artificial Sequence
  Synthetic
aacgugcacagaagaaccucauug

SEQ ID NO: 3157 - RNA, 18 nt, Artificial Sequence
  Synthetic
ccucauugcagaggcuug

SEQ ID NO: 3158 - RNA, 19 nt, Artificial Sequence
  Synthetic
accucauugcagaggcuug

SEQ ID NO: 3159 - RNA, 21 nt, Artificial Sequence
  Synthetic
gaaccucauugcagaggcuug

SEQ ID NO: 3160 - RNA, 22 nt, Artificial Sequence
  Synthetic
agaaccucauugcagaggcuug

SEQ ID NO: 3161 - RNA, 23 nt, Artificial Sequence
  Synthetic
aagaaccucauugcagaggcuug

SEQ ID NO: 3162 - RNA, 24 nt, Artificial Sequence
  Synthetic
gaagaaccucauugcagaggcuug

SEQ ID NO: 3163 - RNA, 18 nt, Artificial Sequence
  Synthetic
cugggcagcuggauucau

SEQ ID NO: 3164 - RNA, 19 nt, Artificial Sequence
  Synthetic
ucugggcagcuggauucau

SEQ ID NO: 3165 - RNA, 21 nt, Artificial Sequence
  Synthetic
gcucugggcagcuggauucau

SEQ ID NO: 3166 - RNA, 22 nt, Artificial Sequence
  Synthetic
ugcucugggcagcuggauucau

SEQ ID NO: 3167 - RNA, 23 nt, Artificial Sequence
  Synthetic
cugcucugggcagcuggauucau

SEQ ID NO: 3168 - RNA, 24 nt, Artificial Sequence
  Synthetic
ucugcucugggcagcuggauucau

SEQ ID NO: 3169 - RNA, 18 nt, Artificial Sequence
  Synthetic
ggcuuggugaggcuuccu

SEQ ID NO: 3170 - RNA, 19 nt, Artificial Sequence
  Synthetic
aggcuuggugaggcuuccu

SEQ ID NO: 3171 - RNA, 21 nt, Artificial Sequence
  Synthetic
agaggcuuggugaggcuuccu

SEQ ID NO: 3172 - RNA, 22 nt, Artificial Sequence
  Synthetic
cagaggcuuggugaggcuuccu

SEQ ID NO: 3173 - RNA, 23 nt, Artificial Sequence
  Synthetic
gcagaggcuuggugaggcuuccu

SEQ ID NO: 3174 - RNA, 24 nt, Artificial Sequence
  Synthetic
ugcagaggcuuggugaggcuuccu

SEQ ID NO: 3175 - RNA, 18 nt, Artificial Sequence
  Synthetic
acauggccuggcucugcu

SEQ ID NO: 3176 - RNA, 19 nt, Artificial Sequence
  Synthetic
gacauggccuggcucugcu

SEQ ID NO: 3177 - RNA, 21 nt, Artificial Sequence
  Synthetic
cugacauggccuggcucugcu

SEQ ID NO: 3178 - RNA, 22 nt, Artificial Sequence
  Synthetic
acugacauggccuggcucugcu

SEQ ID NO: 3179 - RNA, 23 nt, Artificial Sequence
  Synthetic
gacugacauggccuggcucugcu

SEQ ID NO: 3180 - RNA, 24 nt, Artificial Sequence
  Synthetic
ugacugacauggccuggcucugcu

SEQ ID NO: 3181 - RNA, 18 nt, Artificial Sequence
  Synthetic
uccagaacugacuugucu

SEQ ID NO: 3182 - RNA, 19 nt, Artificial Sequence
  Synthetic
cuccagaacugacuugucu

SEQ ID NO: 3183 - RNA, 21 nt, Artificial Sequence
  Synthetic
uccuccagaacugacuugucu

SEQ ID NO: 3184 - RNA, 22 nt, Artificial Sequence
  Synthetic
uuccuccagaacugacuugucu

SEQ ID NO: 3185 - RNA, 23 nt, Artificial Sequence
  Synthetic
cuuccuccagaacugacuugucu

SEQ ID NO: 3186 - RNA, 24 nt, Artificial Sequence
  Synthetic
ucuuccuccagaacugacuugucu

SEQ ID NO: 3187 - RNA, 18 nt, Artificial Sequence
  Synthetic
agcgacuaaggcaagaaa

SEQ ID NO: 3188 - RNA, 19 nt, Artificial Sequence
  Synthetic
aagcgacuaaggcaagaaa

SEQ ID NO: 3189 - RNA, 21 nt, Artificial Sequence
  Synthetic
agaagcgacuaaggcaagaaa

SEQ ID NO: 3190 - RNA, 22 nt, Artificial Sequence
  Synthetic
aagaagcgacuaaggcaagaaa

SEQ ID NO: 3191 - RNA, 23 nt, Artificial Sequence
  Synthetic
gaagaagcgacuaaggcaagaaa

SEQ ID NO: 3192 - RNA, 24 nt, Artificial Sequence
  Synthetic
agaagaagcgacuaaggcaagaaa

SEQ ID NO: 3193 - RNA, 18 nt, Artificial Sequence
  Synthetic
aagucaguucuggaggaa

SEQ ID NO: 3194 - RNA, 19 nt, Artificial Sequence
  Synthetic
caagucaguucuggaggaa

SEQ ID NO: 3195 - RNA, 21 nt, Artificial Sequence
  Synthetic
gacaagucaguucuggaggaa

SEQ ID NO: 3196 - RNA, 22 nt, Artificial Sequence
  Synthetic
agacaagucaguucuggaggaa

SEQ ID NO: 3197 - RNA, 23 nt, Artificial Sequence
  Synthetic
gagacaagucaguucuggaggaa

SEQ ID NO: 3198 - RNA, 24 nt, Artificial Sequence
  Synthetic
cgagacaagucaguucuggaggaa

SEQ ID NO: 3199 - RNA, 18 nt, Artificial Sequence
  Synthetic
agucauccauaacuuaca

SEQ ID NO: 3200 - RNA, 19 nt, Artificial Sequence
  Synthetic
cagucauccauaacuuaca

SEQ ID NO: 3201 - RNA, 21 nt, Artificial Sequence
  Synthetic
gucagucauccauaacuuaca

SEQ ID NO: 3202 - RNA, 22 nt, Artificial Sequence
  Synthetic
ugucagucauccauaacuuaca

SEQ ID NO: 3203 - RNA, 23 nt, Artificial Sequence
  Synthetic
augucagucauccauaacuuaca

SEQ ID NO: 3204 - RNA, 24 nt, Artificial Sequence
  Synthetic
caugucagucauccauaacuuaca

SEQ ID NO: 3205 - RNA, 18 nt, Artificial Sequence
  Synthetic
gacccaggaggggcugca

SEQ ID NO: 3206 - RNA, 19 nt, Artificial Sequence
  Synthetic
agacccaggaggggcugca

SEQ ID NO: 3207 - RNA, 21 nt, Artificial Sequence
  Synthetic
ggagacccaggaggggcugca

SEQ ID NO: 3208 - RNA, 22 nt, Artificial Sequence
  Synthetic
aggagacccaggaggggcugca

SEQ ID NO: 3209 - RNA, 23 nt, Artificial Sequence
  Synthetic
caggagacccaggaggggcugca

SEQ ID NO: 3210 - RNA, 24 nt, Artificial Sequence
  Synthetic
ccaggagacccaggaggggcugca

SEQ ID NO: 3211 - RNA, 18 nt, Artificial Sequence
  Synthetic
ccucaccaagccucugca

SEQ ID NO: 3212 - RNA, 19 nt, Artificial Sequence
  Synthetic
gccucaccaagccucugca

SEQ ID NO: 3213 - RNA, 21 nt, Artificial Sequence
  Synthetic
aagccucaccaagccucugca

SEQ ID NO: 3214 - RNA, 22 nt, Artificial Sequence
  Synthetic
gaagccucaccaagccucugca

SEQ ID NO: 3215 - RNA, 23 nt, Artificial Sequence
  Synthetic
ggaagccucaccaagccucugca

SEQ ID NO: 3216 - RNA, 24 nt, Artificial Sequence
  Synthetic
aggaagccucaccaagccucugca

SEQ ID NO: 3217 - RNA, 18 nt, Artificial Sequence
  Synthetic
cccaggaggggcugcaga

SEQ ID NO: 3218 - RNA, 19 nt, Artificial Sequence
  Synthetic
acccaggaggggcugcaga

SEQ ID NO: 3219 - RNA, 21 nt, Artificial Sequence
  Synthetic
agacccaggaggggcugcaga

SEQ ID NO: 3220 - RNA, 22 nt, Artificial Sequence
  Synthetic
gagacccaggaggggcugcaga

SEQ ID NO: 3221 - RNA, 23 nt, Artificial Sequence
  Synthetic
ggagacccaggaggggcugcaga

SEQ ID NO: 3222 - RNA, 24 nt, Artificial Sequence
  Synthetic
aggagacccaggaggggcugcaga

SEQ ID NO: 3223 - RNA, 18 nt, Artificial Sequence
  Synthetic
gggcacccugaggcggga

SEQ ID NO: 3224 - RNA, 19 nt, Artificial Sequence
  Synthetic
ugggcacccugaggcggga

SEQ ID NO: 3225 - RNA, 21 nt, Artificial Sequence
  Synthetic
gcugggcacccugaggcggga

SEQ ID NO: 3226 - RNA, 22 nt, Artificial Sequence
  Synthetic
agcugggcacccugaggcggga

SEQ ID NO: 3227 - RNA, 23 nt, Artificial Sequence
  Synthetic
gagcugggcacccugaggcggga

SEQ ID NO: 3228 - RNA, 24 nt, Artificial Sequence
  Synthetic
ggagcugggcacccugaggcggga

SEQ ID NO: 3229 - RNA, 18 nt, Artificial Sequence
  Synthetic
ucagucauccauaacuua

SEQ ID NO: 3230 - RNA, 19 nt, Artificial Sequence
  Synthetic
gucagucauccauaacuua

SEQ ID NO: 3231 - RNA, 21 nt, Artificial Sequence
  Synthetic
augucagucauccauaacuua

SEQ ID NO: 3232 - RNA, 22 nt, Artificial Sequence
  Synthetic
caugucagucauccauaacuua

SEQ ID NO: 3233 - RNA, 23 nt, Artificial Sequence
  Synthetic
ccaugucagucauccauaacuua

SEQ ID NO: 3234 - RNA, 24 nt, Artificial Sequence
  Synthetic
gccaugucagucauccauaacuua

SEQ ID NO: 3235 - RNA, 18 nt, Artificial Sequence
  Synthetic
ccagcuggaaacccaaac

SEQ ID NO: 3236 - RNA, 19 nt, Artificial Sequence
  Synthetic
accagcuggaaacccaaac

SEQ ID NO: 3237 - RNA, 21 nt, Artificial Sequence
  Synthetic
ggaccagcuggaaacccaaac

SEQ ID NO: 3238 - RNA, 22 nt, Artificial Sequence
  Synthetic
gggaccagcuggaaacccaaac

SEQ ID NO: 3239 - RNA, 23 nt, Artificial Sequence
  Synthetic
cgggaccagcuggaaacccaaac

SEQ ID NO: 3240 - RNA, 24 nt, Artificial Sequence
  Synthetic
gcgggaccagcuggaaacccaaac

SEQ ID NO: 3241 - RNA, 18 nt, Artificial Sequence
  Synthetic
agcacccaacgcuuagac

SEQ ID NO: 3242 - RNA, 19 nt, Artificial Sequence
  Synthetic
cagcacccaacgcuuagac

SEQ ID NO: 3243 - RNA, 21 nt, Artificial Sequence
  Synthetic
agcagcacccaacgcuuagac

SEQ ID NO: 3244 - RNA, 22 nt, Artificial Sequence
  Synthetic
cagcagcacccaacgcuuagac

SEQ ID NO: 3245 - RNA, 23 nt, Artificial Sequence
  Synthetic
acagcagcacccaacgcuuagac

SEQ ID NO: 3246 - RNA, 24 nt, Artificial Sequence
  Synthetic
gacagcagcacccaacgcuuagac

SEQ ID NO: 3247 - RNA, 18 nt, Artificial Sequence
  Synthetic
cagagggagcugggcacc

SEQ ID NO: 3248 - RNA, 19 nt, Artificial Sequence
  Synthetic
gcagagggagcugggcacc

SEQ ID NO: 3249 - RNA, 21 nt, Artificial Sequence
  Synthetic
cugcagagggagcugggcacc

SEQ ID NO: 3250 - RNA, 22 nt, Artificial Sequence
  Synthetic
gcugcagagggagcugggcacc

SEQ ID NO: 3251 - RNA, 23 nt, Artificial Sequence
  Synthetic
ggcugcagagggagcugggcacc

SEQ ID NO: 3252 - RNA, 24 nt, Artificial Sequence
  Synthetic
gggcugcagagggagcugggcacc

SEQ ID NO: 3253 - RNA, 18 nt, Artificial Sequence
  Synthetic
gccaggccccaggagacc

SEQ ID NO: 3254 - RNA, 19 nt, Artificial Sequence
  Synthetic
ugccaggccccaggagacc

SEQ ID NO: 3255 - RNA, 21 nt, Artificial Sequence
  Synthetic
gcugccaggccccaggagacc

SEQ ID NO: 3256 - RNA, 22 nt, Artificial Sequence
  Synthetic
ggcugccaggccccaggagacc

SEQ ID NO: 3257 - RNA, 23 nt, Artificial Sequence
  Synthetic
aggcugccaggccccaggagacc

SEQ ID NO: 3258 - RNA, 24 nt, Artificial Sequence
  Synthetic
caggcugccaggccccaggagacc

SEQ ID NO: 3259 - RNA, 18 nt, Artificial Sequence
  Synthetic
gcacccaacgcuuagacc

SEQ ID NO: 3260 - RNA, 19 nt, Artificial Sequence
  Synthetic
agcacccaacgcuuagacc

SEQ ID NO: 3261 - RNA, 21 nt, Artificial Sequence
  Synthetic
gcagcacccaacgcuuagacc

SEQ ID NO: 3262 - RNA, 22 nt, Artificial Sequence
  Synthetic
agcagcacccaacgcuuagacc

SEQ ID NO: 3263 - RNA, 23 nt, Artificial Sequence
  Synthetic
cagcagcacccaacgcuuagacc

SEQ ID NO: 3264 - RNA, 24 nt, Artificial Sequence
  Synthetic
acagcagcacccaacgcuuagacc

SEQ ID NO: 3265 - RNA, 18 nt, Artificial Sequence
  Synthetic
cuccuccaccaauugacc

SEQ ID NO: 3266 - RNA, 19 nt, Artificial Sequence
  Synthetic
ccuccuccaccaauugacc

SEQ ID NO: 3267 - RNA, 21 nt, Artificial Sequence
  Synthetic
agccuccuccaccaauugacc

SEQ ID NO: 3268 - RNA, 22 nt, Artificial Sequence
  Synthetic
gagccuccuccaccaauugacc

SEQ ID NO: 3269 - RNA, 23 nt, Artificial Sequence
  Synthetic
agagccuccuccaccaauugacc

SEQ ID NO: 3270 - RNA, 24 nt, Artificial Sequence
  Synthetic
gagagccuccuccaccaauugacc

SEQ ID NO: 3271 - RNA, 18 nt, Artificial Sequence
  Synthetic
ccaggccccaggagaccc

SEQ ID NO: 3272 - RNA, 19 nt, Artificial Sequence
  Synthetic
gccaggccccaggagaccc

SEQ ID NO: 3273 - RNA, 21 nt, Artificial Sequence
  Synthetic
cugccaggccccaggagaccc

SEQ ID NO: 3274 - RNA, 22 nt, Artificial Sequence
  Synthetic
gcugccaggccccaggagaccc

SEQ ID NO: 3275 - RNA, 23 nt, Artificial Sequence
  Synthetic
ggcugccaggccccaggagaccc

SEQ ID NO: 3276 - RNA, 24 nt, Artificial Sequence
  Synthetic
aggcugccaggccccaggagaccc

SEQ ID NO: 3277 - RNA, 18 nt, Artificial Sequence
  Synthetic
accaggcugccaggcccc

SEQ ID NO: 3278 - RNA, 19 nt, Artificial Sequence
  Synthetic
gaccaggcugccaggcccc

SEQ ID NO: 3279 - RNA, 21 nt, Artificial Sequence
  Synthetic
uggaccaggcugccaggcccc

SEQ ID NO: 3280 - RNA, 22 nt, Artificial Sequence
  Synthetic
uuggaccaggcugccaggcccc

SEQ ID NO: 3281 - RNA, 23 nt, Artificial Sequence
  Synthetic
cuuggaccaggcugccaggcccc

SEQ ID NO: 3282 - RNA, 24 nt, Artificial Sequence
  Synthetic
ccuuggaccaggcugccaggcccc

SEQ ID NO: 3283 - RNA, 18 nt, Artificial Sequence
  Synthetic
gaccaggcugccaggccc

SEQ ID NO: 3284 - RNA, 19 nt, Artificial Sequence
  Synthetic
ggaccaggcugccaggccc

SEQ ID NO: 3285 - RNA, 21 nt, Artificial Sequence
  Synthetic
uuggaccaggcugccaggccc

SEQ ID NO: 3286 - RNA, 22 nt, Artificial Sequence
  Synthetic
cuuggaccaggcugccaggccc

SEQ ID NO: 3287 - RNA, 23 nt, Artificial Sequence
  Synthetic
ccuuggaccaggcugccaggccc

SEQ ID NO: 3288 - RNA, 24 nt, Artificial Sequence
  Synthetic
accuuggaccaggcugccaggccc

SEQ ID NO: 3289 - RNA, 18 nt, Artificial Sequence
  Synthetic
aagcucgacucagcuccc

SEQ ID NO: 3290 - RNA, 19 nt, Artificial Sequence
  Synthetic
aaagcucgacucagcuccc

SEQ ID NO: 3291 - RNA, 21 nt, Artificial Sequence
  Synthetic
ccaaagcucgacucagcuccc

SEQ ID NO: 3292 - RNA, 22 nt, Artificial Sequence
  Synthetic
accaaagcucgacucagcuccc

SEQ ID NO: 3293 - RNA, 23 nt, Artificial Sequence
  Synthetic
caccaaagcucgacucagcuccc

SEQ ID NO: 3294 - RNA, 24 nt, Artificial Sequence
  Synthetic
ccaccaaagcucgacucagcuccc

SEQ ID NO: 3295 - RNA, 18 nt, Artificial Sequence
  Synthetic
gguuggaaagcagcagcc

SEQ ID NO: 3296 - RNA, 19 nt, Artificial Sequence
  Synthetic
agguuggaaagcagcagcc

SEQ ID NO: 3297 - RNA, 21 nt, Artificial Sequence
  Synthetic
ggagguuggaaagcagcagcc

SEQ ID NO: 3298 - RNA, 22 nt, Artificial Sequence
  Synthetic
aggagguuggaaagcagcagcc

SEQ ID NO: 3299 - RNA, 23 nt, Artificial Sequence
  Synthetic
caggagguuggaaagcagcagcc

SEQ ID NO: 3300 - RNA, 24 nt, Artificial Sequence
  Synthetic
ccaggagguuggaaagcagcagcc

SEQ ID NO: 3301 - RNA, 18 nt, Artificial Sequence
  Synthetic
gaaaaugagaaucuggcc

SEQ ID NO: 3302 - RNA, 19 nt, Artificial Sequence
  Synthetic
agaaaaugagaaucuggcc

SEQ ID NO: 3303 - RNA, 21 nt, Artificial Sequence
  Synthetic
caagaaaaugagaaucuggcc

SEQ ID NO: 3304 - RNA, 22 nt, Artificial Sequence
  Synthetic
gcaagaaaaugagaaucuggcc

SEQ ID NO: 3305 - RNA, 23 nt, Artificial Sequence
  Synthetic
ggcaagaaaaugagaaucuggcc

SEQ ID NO: 3306 - RNA, 24 nt, Artificial Sequence
  Synthetic
aggcaagaaaaugagaaucuggcc

SEQ ID NO: 3307 - RNA, 18 nt, Artificial Sequence
  Synthetic
ccaaugaauccagcugcc

SEQ ID NO: 3308 - RNA, 19 nt, Artificial Sequence
  Synthetic
cccaaugaauccagcugcc

SEQ ID NO: 3309 - RNA, 21 nt, Artificial Sequence
  Synthetic
gucccaaugaauccagcugcc

SEQ ID NO: 3310 - RNA, 22 nt, Artificial Sequence
  Synthetic
agucccaaugaauccagcugcc

SEQ ID NO: 3311 - RNA, 23 nt, Artificial Sequence
  Synthetic
cagucccaaugaauccagcugcc

SEQ ID NO: 3312 - RNA, 24 nt, Artificial Sequence
  Synthetic
ccagucccaaugaauccagcugcc

SEQ ID NO: 3313 - RNA, 18 nt, Artificial Sequence
  Synthetic
aaagcucgacucagcucc

SEQ ID NO: 3314 - RNA, 19 nt, Artificial Sequence
  Synthetic
caaagcucgacucagcucc

SEQ ID NO: 3315 - RNA, 21 nt, Artificial Sequence
  Synthetic
accaaagcucgacucagcucc

SEQ ID NO: 3316 - RNA, 22 nt, Artificial Sequence
  Synthetic
caccaaagcucgacucagcucc

SEQ ID NO: 3317 - RNA, 23 nt, Artificial Sequence
  Synthetic
ccaccaaagcucgacucagcucc

SEQ ID NO: 3318 - RNA, 24 nt, Artificial Sequence
  Synthetic
gccaccaaagcucgacucagcucc

SEQ ID NO: 3319 - RNA, 18 nt, Artificial Sequence
  Synthetic
ggcgggagcgggaccagc

SEQ ID NO: 3320 - RNA, 19 nt, Artificial Sequence
  Synthetic
aggcgggagcgggaccagc

SEQ ID NO: 3321 - RNA, 21 nt, Artificial Sequence
  Synthetic
ugaggcgggagcgggaccagc

SEQ ID NO: 3322 - RNA, 22 nt, Artificial Sequence
  Synthetic
cugaggcgggagcgggaccagc

SEQ ID NO: 3323 - RNA, 23 nt, Artificial Sequence
  Synthetic
ccugaggcgggagcgggaccagc

SEQ ID NO: 3324 - RNA, 24 nt, Artificial Sequence
  Synthetic
cccugaggcgggagcgggaccagc

SEQ ID NO: 3325 - RNA, 18 nt, Artificial Sequence
  Synthetic
agguuggaaagcagcagc

SEQ ID NO: 3326 - RNA, 19 nt, Artificial Sequence
  Synthetic
gagguuggaaagcagcagc

SEQ ID NO: 3327 - RNA, 21 nt, Artificial Sequence
  Synthetic
aggagguuggaaagcagcagc

SEQ ID NO: 3328 - RNA, 22 nt, Artificial Sequence
  Synthetic
caggagguuggaaagcagcagc

SEQ ID NO: 3329 - RNA, 23 nt, Artificial Sequence
  Synthetic
ccaggagguuggaaagcagcagc

SEQ ID NO: 3330 - RNA, 24 nt, Artificial Sequence
  Synthetic
gccaggagguuggaaagcagcagc

SEQ ID NO: 3331 - RNA, 18 nt, Artificial Sequence
  Synthetic
agaagaagcgacuaaggc

SEQ ID NO: 3332 - RNA, 19 nt, Artificial Sequence
  Synthetic
gagaagaagcgacuaaggc

SEQ ID NO: 3333 - RNA, 21 nt, Artificial Sequence
  Synthetic
aagagaagaagcgacuaaggc

SEQ ID NO: 3334 - RNA, 22 nt, Artificial Sequence
  Synthetic
gaagagaagaagcgacuaaggc

SEQ ID NO: 3335 - RNA, 23 nt, Artificial Sequence
  Synthetic
ggaagagaagaagcgacuaaggc

SEQ ID NO: 3336 - RNA, 24 nt, Artificial Sequence
  Synthetic
aggaagagaagaagcgacuaaggc

SEQ ID NO: 3337 - RNA, 18 nt, Artificial Sequence
  Synthetic
agcugggcacccugaggc

SEQ ID NO: 3338 - RNA, 19 nt, Artificial Sequence
  Synthetic
gagcugggcacccugaggc

SEQ ID NO: 3339 - RNA, 21 nt, Artificial Sequence
  Synthetic
gggagcugggcacccugaggc

SEQ ID NO: 3340 - RNA, 22 nt, Artificial Sequence
  Synthetic
agggagcugggcacccugaggc

SEQ ID NO: 3341 - RNA, 23 nt, Artificial Sequence
  Synthetic
gagggagcugggcacccugaggc

SEQ ID NO: 3342 - RNA, 24 nt, Artificial Sequence
  Synthetic
agagggagcugggcacccugaggc

SEQ ID NO: 3343 - RNA, 18 nt, Artificial Sequence
  Synthetic
ggugugggaugugggggc

SEQ ID NO: 3344 - RNA, 19 nt, Artificial Sequence
  Synthetic
uggugugggaugugggggc

SEQ ID NO: 3345 - RNA, 21 nt, Artificial Sequence
  Synthetic
ccuggugugggaugugggggc

SEQ ID NO: 3346 - RNA, 22 nt, Artificial Sequence
  Synthetic
gccuggugugggaugugggggc

SEQ ID NO: 3347 - RNA, 23 nt, Artificial Sequence
  Synthetic
ugccuggugugggaugugggggc

SEQ ID NO: 3348 - RNA, 24 nt, Artificial Sequence
  Synthetic
cugccuggugugggaugugggggc

SEQ ID NO: 3349 - RNA, 18 nt, Artificial Sequence
  Synthetic
guugcugcagcuuugggc

SEQ ID NO: 3350 - RNA, 19 nt, Artificial Sequence
  Synthetic
cguugcugcagcuuugggc

SEQ ID NO: 3351 - RNA, 21 nt, Artificial Sequence
  Synthetic
cacguugcugcagcuuugggc

SEQ ID NO: 3352 - RNA, 22 nt, Artificial Sequence
  Synthetic
gcacguugcugcagcuuugggc

SEQ ID NO: 3353 - RNA, 23 nt, Artificial Sequence
  Synthetic
ugcacguugcugcagcuuugggc

SEQ ID NO: 3354 - RNA, 24 nt, Artificial Sequence
  Synthetic
gugcacguugcugcagcuuugggc

SEQ ID NO: 3355 - RNA, 18 nt, Artificial Sequence
  Synthetic
agaaaaugagaaucuggc

SEQ ID NO: 3356 - RNA, 19 nt, Artificial Sequence
  Synthetic
aagaaaaugagaaucuggc

SEQ ID NO: 3357 - RNA, 21 nt, Artificial Sequence
  Synthetic
gcaagaaaaugagaaucuggc

SEQ ID NO: 3358 - RNA, 22 nt, Artificial Sequence
  Synthetic
ggcaagaaaaugagaaucuggc

SEQ ID NO: 3359 - RNA, 23 nt, Artificial Sequence
  Synthetic
aggcaagaaaaugagaaucuggc

SEQ ID NO: 3360 - RNA, 24 nt, Artificial Sequence
  Synthetic
aaggcaagaaaaugagaaucuggc

SEQ ID NO: 3361 - RNA, 18 nt, Artificial Sequence
  Synthetic
gccaggacagcucagcuc

SEQ ID NO: 3362 - RNA, 19 nt, Artificial Sequence
  Synthetic
ggccaggacagcucagcuc

SEQ ID NO: 3363 - RNA, 21 nt, Artificial Sequence
  Synthetic
ggggccaggacagcucagcuc

SEQ ID NO: 3364 - RNA, 22 nt, Artificial Sequence
  Synthetic
gggggccaggacagcucagcuc

SEQ ID NO: 3365 - RNA, 23 nt, Artificial Sequence
  Synthetic
ugggggccaggacagcucagcuc

SEQ ID NO: 3366 - RNA, 24 nt, Artificial Sequence
  Synthetic
gugggggccaggacagcucagcuc

SEQ ID NO: 3367 - RNA, 18 nt, Artificial Sequence
  Synthetic
uccgagacaagucaguuc

SEQ ID NO: 3368 - RNA, 19 nt, Artificial Sequence
  Synthetic
cuccgagacaagucaguuc

SEQ ID NO: 3369 - RNA, 21 nt, Artificial Sequence
  Synthetic
uccuccgagacaagucaguuc

SEQ ID NO: 3370 - RNA, 22 nt, Artificial Sequence
  Synthetic
cuccuccgagacaagucaguuc

SEQ ID NO: 3371 - RNA, 23 nt, Artificial Sequence
  Synthetic
ccuccuccgagacaagucaguuc

SEQ ID NO: 3372 - RNA, 24 nt, Artificial Sequence
  Synthetic
accuccuccgagacaagucaguuc

SEQ ID NO: 3373 - RNA, 18 nt, Artificial Sequence
  Synthetic
aggcgggagcgggaccag

SEQ ID NO: 3374 - RNA, 19 nt, Artificial Sequence
  Synthetic
gaggcgggagcgggaccag

SEQ ID NO: 3375 - RNA, 21 nt, Artificial Sequence
  Synthetic
cugaggcgggagcgggaccag

SEQ ID NO: 3376 - RNA, 22 nt, Artificial Sequence
  Synthetic
ccugaggcgggagcgggaccag

SEQ ID NO: 3377 - RNA, 23 nt, Artificial Sequence
  Synthetic
cccugaggcgggagcgggaccag

SEQ ID NO: 3378 - RNA, 24 nt, Artificial Sequence
  Synthetic
acccugaggcgggagcgggaccag

SEQ ID NO: 3379 - RNA, 18 nt, Artificial Sequence
  Synthetic
aggccccaggagacccag

SEQ ID NO: 3380 - RNA, 19 nt, Artificial Sequence
  Synthetic
caggccccaggagacccag

SEQ ID NO: 3381 - RNA, 21 nt, Artificial Sequence
  Synthetic
gccaggccccaggagacccag

SEQ ID NO: 3382 - RNA, 22 nt, Artificial Sequence
  Synthetic
ugccaggccccaggagacccag

SEQ ID NO: 3383 - RNA, 23 nt, Artificial Sequence
  Synthetic
cugccaggccccaggagacccag

SEQ ID NO: 3384 - RNA, 24 nt, Artificial Sequence
  Synthetic
gcugccaggccccaggagacccag

SEQ ID NO: 3385 - RNA, 18 nt, Artificial Sequence
  Synthetic
acccaggaggggcugcag

SEQ ID NO: 3386 - RNA, 19 nt, Artificial Sequence
  Synthetic
gacccaggaggggcugcag

SEQ ID NO: 3387 - RNA, 21 nt, Artificial Sequence
  Synthetic
gagacccaggaggggcugcag

SEQ ID NO: 3388 - RNA, 22 nt, Artificial Sequence
  Synthetic
ggagacccaggaggggcugcag

SEQ ID NO: 3389 - RNA, 23 nt, Artificial Sequence
  Synthetic
aggagacccaggaggggcugcag

SEQ ID NO: 3390 - RNA, 24 nt, Artificial Sequence
  Synthetic
caggagacccaggaggggcugcag

SEQ ID NO: 3391 - RNA, 18 nt, Artificial Sequence
  Synthetic
ucaguucuggaggaagag

SEQ ID NO: 3392 - RNA, 19 nt, Artificial Sequence
  Synthetic
gucaguucuggaggaagag

SEQ ID NO: 3393 - RNA, 21 nt, Artificial Sequence
  Synthetic
aagucaguucuggaggaagag

SEQ ID NO: 3394 - RNA, 22 nt, Artificial Sequence
  Synthetic
caagucaguucuggaggaagag

SEQ ID NO: 3395 - RNA, 23 nt, Artificial Sequence
  Synthetic
acaagucaguucuggaggaagag

SEQ ID NO: 3396 - RNA, 24 nt, Artificial Sequence
  Synthetic
gacaagucaguucuggaggaagag

SEQ ID NO: 3397 - RNA, 18 nt, Artificial Sequence
  Synthetic
gaauccagcugcccagag

SEQ ID NO: 3398 - RNA, 19 nt, Artificial Sequence
  Synthetic
ugaauccagcugcccagag

SEQ ID NO: 3399 - RNA, 21 nt, Artificial Sequence
  Synthetic
aaugaauccagcugcccagag

SEQ ID NO: 3400 - RNA, 22 nt, Artificial Sequence
  Synthetic
caaugaauccagcugcccagag

SEQ ID NO: 3401 - RNA, 23 nt, Artificial Sequence
  Synthetic
ccaaugaauccagcugcccagag

SEQ ID NO: 3402 - RNA, 24 nt, Artificial Sequence
  Synthetic
cccaaugaauccagcugcccagag

SEQ ID NO: 3403 - RNA, 18 nt, Artificial Sequence
  Synthetic
gaaacccaaaccagagag

SEQ ID NO: 3404 - RNA, 19 nt, Artificial Sequence
  Synthetic
ggaaacccaaaccagagag

SEQ ID NO: 3405 - RNA, 21 nt, Artificial Sequence
  Synthetic
cuggaaacccaaaccagagag

SEQ ID NO: 3406 - RNA, 22 nt, Artificial Sequence
  Synthetic
gcuggaaacccaaaccagagag

SEQ ID NO: 3407 - RNA, 23 nt, Artificial Sequence
  Synthetic
agcuggaaacccaaaccagagag

SEQ ID NO: 3408 - RNA, 24 nt, Artificial Sequence
  Synthetic
cagcuggaaacccaaaccagagag

SEQ ID NO: 3409 - RNA, 18 nt, Artificial Sequence
  Synthetic
gaggggcugcagagggag

SEQ ID NO: 3410 - RNA, 19 nt, Artificial Sequence
  Synthetic
ggaggggcugcagagggag

SEQ ID NO: 3411 - RNA, 21 nt, Artificial Sequence
  Synthetic
caggaggggcugcagagggag

SEQ ID NO: 3412 - RNA, 22 nt, Artificial Sequence
  Synthetic
ccaggaggggcugcagagggag

SEQ ID NO: 3413 - RNA, 23 nt, Artificial Sequence
  Synthetic
cccaggaggggcugcagagggag

SEQ ID NO: 3414 - RNA, 24 nt, Artificial Sequence
  Synthetic
acccaggaggggcugcagagggag

SEQ ID NO: 3415 - RNA, 18 nt, Artificial Sequence
  Synthetic
ggcacccugaggcgggag

SEQ ID NO: 3416 - RNA, 19 nt, Artificial Sequence
  Synthetic
gggcacccugaggcgggag

SEQ ID NO: 3417 - RNA, 21 nt, Artificial Sequence
  Synthetic
cugggcacccugaggcgggag

SEQ ID NO: 3418 - RNA, 22 nt, Artificial Sequence
  Synthetic
gcugggcacccugaggcgggag

SEQ ID NO: 3419 - RNA, 23 nt, Artificial Sequence
  Synthetic
agcugggcacccugaggcgggag

SEQ ID NO: 3420 - RNA, 24 nt, Artificial Sequence
  Synthetic
gagcugggcacccugaggcgggag

SEQ ID NO: 3421 - RNA, 18 nt, Artificial Sequence
  Synthetic
ggagcugggcacccugag

SEQ ID NO: 3422 - RNA, 19 nt, Artificial Sequence
  Synthetic
gggagcugggcacccugag

SEQ ID NO: 3423 - RNA, 21 nt, Artificial Sequence
  Synthetic
gagggagcugggcacccugag

SEQ ID NO: 3424 - RNA, 22 nt, Artificial Sequence
  Synthetic
agagggagcugggcacccugag

SEQ ID NO: 3425 - RNA, 23 nt, Artificial Sequence
  Synthetic
cagagggagcugggcacccugag

SEQ ID NO: 3426 - RNA, 24 nt, Artificial Sequence
  Synthetic
gcagagggagcugggcacccugag

SEQ ID NO: 3427 - RNA, 18 nt, Artificial Sequence
  Synthetic
ggccccaggagacccagg

SEQ ID NO: 3428 - RNA, 19 nt, Artificial Sequence
  Synthetic
aggccccaggagacccagg

SEQ ID NO: 3429 - RNA, 21 nt, Artificial Sequence
  Synthetic
ccaggccccaggagacccagg

SEQ ID NO: 3430 - RNA, 22 nt, Artificial Sequence
  Synthetic
gccaggccccaggagacccagg

SEQ ID NO: 3431 - RNA, 23 nt, Artificial Sequence
  Synthetic
ugccaggccccaggagacccagg

SEQ ID NO: 3432 - RNA, 24 nt, Artificial Sequence
  Synthetic
cugccaggccccaggagacccagg

SEQ ID NO: 3433 - RNA, 18 nt, Artificial Sequence
  Synthetic
gagaaucuggccaggagg

SEQ ID NO: 3434 - RNA, 19 nt, Artificial Sequence
  Synthetic
ugagaaucuggccaggagg

SEQ ID NO: 3435 - RNA, 21 nt, Artificial Sequence
  Synthetic
aaugagaaucuggccaggagg

SEQ ID NO: 3436 - RNA, 22 nt, Artificial Sequence
  Synthetic
aaaugagaaucuggccaggagg

SEQ ID NO: 3437 - RNA, 23 nt, Artificial Sequence
  Synthetic
aaaaugagaaucuggccaggagg

SEQ ID NO: 3438 - RNA, 24 nt, Artificial Sequence
  Synthetic
gaaaaugagaaucuggccaggagg

SEQ ID NO: 3439 - RNA, 18 nt, Artificial Sequence
  Synthetic
acaagucaguucuggagg

SEQ ID NO: 3440 - RNA, 19 nt, Artificial Sequence
  Synthetic
gacaagucaguucuggagg

SEQ ID NO: 3441 - RNA, 21 nt, Artificial Sequence
  Synthetic
gagacaagucaguucuggagg

SEQ ID NO: 3442 - RNA, 22 nt, Artificial Sequence
  Synthetic
cgagacaagucaguucuggagg

SEQ ID NO: 3443 - RNA, 23 nt, Artificial Sequence
  Synthetic
ccgagacaagucaguucuggagg

SEQ ID NO: 3444 - RNA, 24 nt, Artificial Sequence
  Synthetic
uccgagacaagucaguucuggagg

SEQ ID NO: 3445 - RNA, 18 nt, Artificial Sequence
  Synthetic
gagcugggcacccugagg

SEQ ID NO: 3446 - RNA, 19 nt, Artificial Sequence
  Synthetic
ggagcugggcacccugagg

SEQ ID NO: 3447 - RNA, 21 nt, Artificial Sequence
  Synthetic
agggagcugggcacccugagg

SEQ ID NO: 3448 - RNA, 22 nt, Artificial Sequence
  Synthetic
gagggagcugggcacccugagg

SEQ ID NO: 3449 - RNA, 23 nt, Artificial Sequence
  Synthetic
agagggagcugggcacccugagg

SEQ ID NO: 3450 - RNA, 24 nt, Artificial Sequence
  Synthetic
cagagggagcugggcacccugagg

SEQ ID NO: 3451 - RNA, 18 nt, Artificial Sequence
  Synthetic
gagacaagucaguucugg

SEQ ID NO: 3452 - RNA, 19 nt, Artificial Sequence
  Synthetic
cgagacaagucaguucugg

SEQ ID NO: 3453 - RNA, 21 nt, Artificial Sequence
  Synthetic
uccgagacaagucaguucugg

SEQ ID NO: 3454 - RNA, 22 nt, Artificial Sequence
  Synthetic
cuccgagacaagucaguucugg

SEQ ID NO: 3455 - RNA, 23 nt, Artificial Sequence
  Synthetic
ccuccgagacaagucaguucugg

SEQ ID NO: 3456 - RNA, 24 nt, Artificial Sequence
  Synthetic
uccuccgagacaagucaguucugg

SEQ ID NO: 3457 - RNA, 18 nt, Artificial Sequence
  Synthetic
ccugccuggugugggaug

SEQ ID NO: 3458 - RNA, 19 nt, Artificial Sequence
  Synthetic
gccugccuggugugggaug

SEQ ID NO: 3459 - RNA, 21 nt, Artificial Sequence
  Synthetic
uggccugccuggugugggaug

SEQ ID NO: 3460 - RNA, 22 nt, Artificial Sequence
  Synthetic
cuggccugccuggugugggaug

SEQ ID NO: 3461 - RNA, 23 nt, Artificial Sequence
  Synthetic
ucuggccugccuggugugggaug

SEQ ID NO: 3462 - RNA, 24 nt, Artificial Sequence
  Synthetic
uucuggccugccuggugugggaug

SEQ ID NO: 3463 - RNA, 18 nt, Artificial Sequence
  Synthetic
gcucgacucagcucccug

SEQ ID NO: 3464 - RNA, 19 nt, Artificial Sequence
  Synthetic
agcucgacucagcucccug

SEQ ID NO: 3465 - RNA, 21 nt, Artificial Sequence
  Synthetic
aaagcucgacucagcucccug

SEQ ID NO: 3466 - RNA, 22 nt, Artificial Sequence
  Synthetic
caaagcucgacucagcucccug

SEQ ID NO: 3467 - RNA, 23 nt, Artificial Sequence
  Synthetic
ccaaagcucgacucagcucccug

SEQ ID NO: 3468 - RNA, 24 nt, Artificial Sequence
  Synthetic
accaaagcucgacucagcucccug

SEQ ID NO: 3469 - RNA, 18 nt, Artificial Sequence
  Synthetic
gagacccaggaggggcug

SEQ ID NO: 3470 - RNA, 19 nt, Artificial Sequence
  Synthetic
ggagacccaggaggggcug

SEQ ID NO: 3471 - RNA, 21 nt, Artificial Sequence
  Synthetic
caggagacccaggaggggcug

SEQ ID NO: 3472 - RNA, 22 nt, Artificial Sequence
  Synthetic
ccaggagacccaggaggggcug

SEQ ID NO: 3473 - RNA, 23 nt, Artificial Sequence
  Synthetic
cccaggagacccaggaggggcug

SEQ ID NO: 3474 - RNA, 24 nt, Artificial Sequence
  Synthetic
ccccaggagacccaggaggggcug

SEQ ID NO: 3475 - RNA, 18 nt, Artificial Sequence
  Synthetic
cgagacaagucaguucug

SEQ ID NO: 3476 - RNA, 19 nt, Artificial Sequence
  Synthetic
ccgagacaagucaguucug

SEQ ID NO: 3477 - RNA, 21 nt, Artificial Sequence
  Synthetic
cuccgagacaagucaguucug

SEQ ID NO: 3478 - RNA, 22 nt, Artificial Sequence
  Synthetic
ccuccgagacaagucaguucug

SEQ ID NO: 3479 - RNA, 23 nt, Artificial Sequence
  Synthetic
uccuccgagacaagucaguucug

SEQ ID NO: 3480 - RNA, 24 nt, Artificial Sequence
  Synthetic
cuccuccgagacaagucaguucug

SEQ ID NO: 3481 - RNA, 18 nt, Artificial Sequence
  Synthetic
gccugccuggugugggau

SEQ ID NO: 3482 - RNA, 19 nt, Artificial Sequence
  Synthetic
ggccugccuggugugggau

SEQ ID NO: 3483 - RNA, 21 nt, Artificial Sequence
  Synthetic
cuggccugccuggugugggau

SEQ ID NO: 3484 - RNA, 22 nt, Artificial Sequence
  Synthetic
ucuggccugccuggugugggau

SEQ ID NO: 3485 - RNA, 23 nt, Artificial Sequence
  Synthetic
uucuggccugccuggugugggau

SEQ ID NO: 3486 - RNA, 24 nt, Artificial Sequence
  Synthetic
cuucuggccugccuggugugggau

SEQ ID NO: 3487 - RNA, 18 nt, Artificial Sequence
  Synthetic
ugccuacagcaaccuccu

SEQ ID NO: 3488 - RNA, 19 nt, Artificial Sequence
  Synthetic
cugccuacagcaaccuccu

SEQ ID NO: 3489 - RNA, 21 nt, Artificial Sequence
  Synthetic
gacugccuacagcaaccuccu

SEQ ID NO: 3490 - RNA, 22 nt, Artificial Sequence
  Synthetic
agacugccuacagcaaccuccu

SEQ ID NO: 3491 - RNA, 23 nt, Artificial Sequence
  Synthetic
gagacugccuacagcaaccuccu

SEQ ID NO: 3492 - RNA, 24 nt, Artificial Sequence
  Synthetic
ggagacugccuacagcaaccuccu

SEQ ID NO: 3493 - RNA, 18 nt, Artificial Sequence
  Synthetic
gugcacguugcugcagcu

SEQ ID NO: 3494 - RNA, 19 nt, Artificial Sequence
  Synthetic
ugugcacguugcugcagcu

SEQ ID NO: 3495 - RNA, 21 nt, Artificial Sequence
  Synthetic
ucugugcacguugcugcagcu

SEQ ID NO: 3496 - RNA, 22 nt, Artificial Sequence
  Synthetic
uucugugcacguugcugcagcu

SEQ ID NO: 3497 - RNA, 23 nt, Artificial Sequence
  Synthetic
cuucugugcacguugcugcagcu

SEQ ID NO: 3498 - RNA, 24 nt, Artificial Sequence
  Synthetic
ucuucugugcacguugcugcagcu

SEQ ID NO: 3499 - RNA, 18 nt, Artificial Sequence
  Synthetic
ggccaggacagcucagcu

SEQ ID NO: 3500 - RNA, 19 nt, Artificial Sequence
  Synthetic
gggccaggacagcucagcu

SEQ ID NO: 3501 - RNA, 21 nt, Artificial Sequence
  Synthetic
gggggccaggacagcucagcu

SEQ ID NO: 3502 - RNA, 22 nt, Artificial Sequence
  Synthetic
ugggggccaggacagcucagcu

SEQ ID NO: 3503 - RNA, 23 nt, Artificial Sequence
  Synthetic
gugggggccaggacagcucagcu

SEQ ID NO: 3504 - RNA, 24 nt, Artificial Sequence
  Synthetic
ugugggggccaggacagcucagcu

SEQ ID NO: 3505 - RNA, 18 nt, Artificial Sequence
  Synthetic
aaacccaaaccagagagu

SEQ ID NO: 3506 - RNA, 19 nt, Artificial Sequence
  Synthetic
gaaacccaaaccagagagu

SEQ ID NO: 3507 - RNA, 21 nt, Artificial Sequence
  Synthetic
uggaaacccaaaccagagagu

SEQ ID NO: 3508 - RNA, 22 nt, Artificial Sequence
  Synthetic
cuggaaacccaaaccagagagu

SEQ ID NO: 3509 - RNA, 23 nt, Artificial Sequence
  Synthetic
gcuggaaacccaaaccagagagu

SEQ ID NO: 3510 - RNA, 24 nt, Artificial Sequence
  Synthetic
agcuggaaacccaaaccagagagu

SEQ ID NO: 3511 - RNA, 18 nt, Artificial Sequence
  Synthetic
agaaucuggccaggaggu

SEQ ID NO: 3512 - RNA, 19 nt, Artificial Sequence
  Synthetic
gagaaucuggccaggaggu

SEQ ID NO: 3513 - RNA, 21 nt, Artificial Sequence
  Synthetic
augagaaucuggccaggaggu

SEQ ID NO: 3514 - RNA, 22 nt, Artificial Sequence
  Synthetic
aaugagaaucuggccaggaggu

SEQ ID NO: 3515 - RNA, 23 nt, Artificial Sequence
  Synthetic
aaaugagaaucuggccaggaggu

SEQ ID NO: 3516 - RNA, 24 nt, Artificial Sequence
  Synthetic
aaaaugagaaucuggccaggaggu

SEQ ID NO: 3517 - RNA, 18 nt, Artificial Sequence
  Synthetic
gcuucuggccugccuggu

SEQ ID NO: 3518 - RNA, 19 nt, Artificial Sequence
  Synthetic
ugcuucuggccugccuggu

SEQ ID NO: 3519 - RNA, 21 nt, Artificial Sequence
  Synthetic
gcugcuucuggccugccuggu

SEQ ID NO: 3520 - RNA, 22 nt, Artificial Sequence
  Synthetic
ugcugcuucuggccugccuggu

SEQ ID NO: 3521 - RNA, 23 nt, Artificial Sequence
  Synthetic
cugcugcuucuggccugccuggu

SEQ ID NO: 3522 - RNA, 24 nt, Artificial Sequence
  Synthetic
gcugcugcuucuggccugccuggu

SEQ ID NO: 3523 - RNA, 18 nt, Artificial Sequence
  Synthetic
cugccuggugugggaugu

SEQ ID NO: 3524 - RNA, 19 nt, Artificial Sequence
  Synthetic
ccugccuggugugggaugu

SEQ ID NO: 3525 - RNA, 21 nt, Artificial Sequence
  Synthetic
ggccugccuggugugggaugu

SEQ ID NO: 3526 - RNA, 22 nt, Artificial Sequence
  Synthetic
uggccugccuggugugggaugu

SEQ ID NO: 3527 - RNA, 23 nt, Artificial Sequence
  Synthetic
cuggccugccuggugugggaugu

SEQ ID NO: 3528 - RNA, 24 nt, Artificial Sequence
  Synthetic
ucuggccugccuggugugggaugu

SEQ ID NO: 3529 - RNA, 18 nt, Artificial Sequence
  Synthetic
cuccgagacaagucaguu

SEQ ID NO: 3530 - RNA, 19 nt, Artificial Sequence
  Synthetic
ccuccgagacaagucaguu

SEQ ID NO: 3531 - RNA, 21 nt, Artificial Sequence
  Synthetic
cuccuccgagacaagucaguu

SEQ ID NO: 3532 - RNA, 22 nt, Artificial Sequence
  Synthetic
ccuccuccgagacaagucaguu

SEQ ID NO: 3533 - RNA, 23 nt, Artificial Sequence
  Synthetic
accuccuccgagacaagucaguu

SEQ ID NO: 3534 - RNA, 24 nt, Artificial Sequence
  Synthetic
aaccuccuccgagacaagucaguu

SEQ ID NO: 3535 - RNA, 21 nt, Artificial Sequence
  Synthetic
guacuuauagcgguucuugaa

SEQ ID NO: 3536 - RNA, 24 nt, Artificial Sequence
  Synthetic
gcuguacuuauagcgguucuugaa

SEQ ID NO: 3537 - RNA, 19 nt, Artificial Sequence
  Synthetic
gcaaagagcuucuucucca

SEQ ID NO: 3538 - RNA, 22 nt, Artificial Sequence
  Synthetic
gaaaauuuuauuucacaaugua

SEQ ID NO: 3539 - RNA, 23 nt, Artificial Sequence
  Synthetic
gucaauguccguguagccacccc

SEQ ID NO: 3540 - RNA, 19 nt, Artificial Sequence
  Synthetic
guccgugguagccagcucc

SEQ ID NO: 3541 - RNA, 24 nt, Artificial Sequence
  Synthetic
gaacuguccgugguagccagcucc

SEQ ID NO: 3542 - RNA, 20 nt, Artificial Sequence
  Synthetic
gcccuggaaauagaggcucc

SEQ ID NO: 3543 - RNA, 22 nt, Artificial Sequence
  Synthetic
gcgcccuggaaauagaggcucc

SEQ ID NO: 3544 - RNA, 18 nt, Artificial Sequence
  Synthetic
gauucuccacguggucuc

SEQ ID NO: 3545 - RNA, 21 nt, Artificial Sequence
  Synthetic
gucgauucuccacguggucuc

SEQ ID NO: 3546 - RNA, 23 nt, Artificial Sequence
  Synthetic
gugucgauucuccacguggucuc

SEQ ID NO: 3547 - RNA, 19 nt, Artificial Sequence
  Synthetic
gcacagcccgagcaguguc

SEQ ID NO: 3548 - RNA, 22 nt, Artificial Sequence
  Synthetic
guggcacagcccgagcaguguc

SEQ ID NO: 3549 - RNA, 23 nt, Artificial Sequence
  Synthetic
gguggcacagcccgagcaguguc

SEQ ID NO: 3550 - RNA, 18 nt, Artificial Sequence
  Synthetic
gcccucagacuacaauuc

SEQ ID NO: 3551 - RNA, 24 nt, Artificial Sequence
  Synthetic
gucuacgcccucagacuacaauuc

SEQ ID NO: 3552 - RNA, 19 nt, Artificial Sequence
  Synthetic
gcuguacuuauagcgguuc

SEQ ID NO: 3553 - RNA, 22 nt, Artificial Sequence
  Synthetic
gcugcuguacuuauagcgguuc

SEQ ID NO: 3554 - RNA, 18 nt, Artificial Sequence
  Synthetic
gcaguaugugaaccuuag

SEQ ID NO: 3555 - RNA, 19 nt, Artificial Sequence
  Synthetic
ggcaguaugugaaccuuag

SEQ ID NO: 3556 - RNA, 24 nt, Artificial Sequence
  Synthetic
gccuaggcaguaugugaaccuuag

SEQ ID NO: 3557 - RNA, 19 nt, Artificial Sequence
  Synthetic
guguagggguaggugggcu

SEQ ID NO: 3558 - RNA, 21 nt, Artificial Sequence
  Synthetic
ggguguagggguaggugggcu

SEQ ID NO: 3559 - RNA, 18 nt, Artificial Sequence
  Synthetic
guucgaguuccagauucu

SEQ ID NO: 3560 - RNA, 22 nt, Artificial Sequence
  Synthetic
guuuguucgaguuccagauucu

SEQ ID NO: 3561 - RNA, 23 nt, Artificial Sequence
  Synthetic
gguuuguucgaguuccagauucu

SEQ ID NO: 3562 - RNA, 18 nt, Artificial Sequence
  Synthetic
guucuugaaugggauggu

SEQ ID NO: 3563 - RNA, 19 nt, Artificial Sequence
  Synthetic
gguucuugaaugggauggu

SEQ ID NO: 3564 - RNA, 21 nt, Artificial Sequence
  Synthetic
gcgguucuugaaugggauggu

SEQ ID NO: 3565 - RNA, 19 nt, Artificial Sequence
  Synthetic
guuugucucccagguuugu

SEQ ID NO: 3566 - RNA, 22 nt, Artificial Sequence
  Synthetic
gauguuugucucccagguuugu

SEQ ID NO: 3567 - RNA, 23 nt, Artificial Sequence
  Synthetic
ggauguuugucucccagguuugu

SEQ ID NO: 3568 - RNA, 18 nt, Artificial Sequence
  Synthetic
gugaccauguucauccuu

SEQ ID NO: 3569 - RNA, 19 nt, Artificial Sequence
  Synthetic
ggugaccauguucauccuu

SEQ ID NO: 3570 - RNA, 22 nt, Artificial Sequence
  Synthetic
gauggugaccauguucauccuu

SEQ ID NO: 3571 - RNA, 21 nt, Artificial Sequence
  Synthetic
ggcauuggcgacugacugcuu

SEQ ID NO: 3572 - RNA, 24 nt, Artificial Sequence
  Synthetic
gaaggcauuggcgacugacugcuu

SEQ ID NO: 3573 - RNA, 21 nt, Artificial Sequence
  Synthetic
guccucuccaaacugaaccca

SEQ ID NO: 3574 - RNA, 21 nt, Artificial Sequence
  Synthetic
gaauagcuccucuggccagca

SEQ ID NO: 3575 - RNA, 24 nt, Artificial Sequence
  Synthetic
gcagaauagcuccucuggccagca

SEQ ID NO: 3576 - RNA, 18 nt, Artificial Sequence
  Synthetic
ggcuucuaaugcuucaga

SEQ ID NO: 3577 - RNA, 21 nt, Artificial Sequence
  Synthetic
guuggcuucuaaugcuucaga

SEQ ID NO: 3578 - RNA, 20 nt, Artificial Sequence
  Synthetic
guuuucuuuucugaauuuac

SEQ ID NO: 3579 - RNA, 19 nt, Artificial Sequence
  Synthetic
gccuaggccacuggaaagc

SEQ ID NO: 3580 - RNA, 19 nt, Artificial Sequence
  Synthetic
gagaaucgacacaguuggc

SEQ ID NO: 3581 - RNA, 20 nt, Artificial Sequence
  Synthetic
ggagaaucgacacaguuggc

SEQ ID NO: 3582 - RNA, 22 nt, Artificial Sequence
  Synthetic
guggagaaucgacacaguuggc

SEQ ID NO: 3583 - RNA, 19 nt, Artificial Sequence
  Synthetic
gagcccaucuggcuaucuc

SEQ ID NO: 3584 - RNA, 21 nt, Artificial Sequence
  Synthetic
gagagcccaucuggcuaucuc

SEQ ID NO: 3585 - RNA, 22 nt, Artificial Sequence
  Synthetic
ggagagcccaucuggcuaucuc

SEQ ID NO: 3586 - RNA, 18 nt, Artificial Sequence
  Synthetic
gucaccaucuaacuauuc

SEQ ID NO: 3587 - RNA, 19 nt, Artificial Sequence
  Synthetic
ggucaccaucuaacuauuc

SEQ ID NO: 3588 - RNA, 21 nt, Artificial Sequence
  Synthetic
gcuaacugaaguuccugcuuc

SEQ ID NO: 3589 - RNA, 23 nt, Artificial Sequence
  Synthetic
gagcuaacugaaguuccugcuuc

SEQ ID NO: 3590 - RNA, 19 nt, Artificial Sequence
  Synthetic
gcauaacuucuaaaggaag

SEQ ID NO: 3591 - RNA, 18 nt, Artificial Sequence
  Synthetic
gcuucagauagaauacag

SEQ ID NO: 3592 - RNA, 18 nt, Artificial Sequence
  Synthetic
gccucuauuuccagggcg

SEQ ID NO: 3593 - RNA, 20 nt, Artificial Sequence
  Synthetic
gagccucuauuuccagggcg

SEQ ID NO: 3594 - RNA, 21 nt, Artificial Sequence
  Synthetic
ggagccucuauuuccagggcg

SEQ ID NO: 3595 - RNA, 22 nt, Artificial Sequence
  Synthetic
gggagccucuauuuccagggcg

SEQ ID NO: 3596 - RNA, 23 nt, Artificial Sequence
  Synthetic
ggggagccucuauuuccagggcg

SEQ ID NO: 3597 - RNA, 21 nt, Artificial Sequence
  Synthetic
gcuccagagaagguaagaaug

SEQ ID NO: 3598 - RNA, 22 nt, Artificial Sequence
  Synthetic
ggcuccagagaagguaagaaug

SEQ ID NO: 3599 - RNA, 20 nt, Artificial Sequence
  Synthetic
gaaugcagaguggggggacu

SEQ ID NO: 3600 - RNA, 24 nt, Artificial Sequence
  Synthetic
guaagaaugcagaguggggggacu

SEQ ID NO: 3601 - RNA, 21 nt, Artificial Sequence
  Synthetic
ggcuguggaugaagcaggccu

SEQ ID NO: 3602 - RNA, 23 nt, Artificial Sequence
  Synthetic
gcuacacggacauugacuuggcu

SEQ ID NO: 3603 - RNA, 24 nt, Artificial Sequence
  Synthetic
ggcuacacggacauugacuuggcu

SEQ ID NO: 3604 - RNA, 18 nt, Artificial Sequence
  Synthetic
ggacaguucccguauucu

SEQ ID NO: 3605 - RNA, 22 nt, Artificial Sequence
  Synthetic
gccaccaggcuccagagaaggu

SEQ ID NO: 3606 - RNA, 24 nt, Artificial Sequence
  Synthetic
gugccaccaggcuccagagaaggu

SEQ ID NO: 3607 - RNA, 21 nt, Artificial Sequence
  Synthetic
guucucuuccuugaacuuugu

SEQ ID NO: 3608 - RNA, 21 nt, Artificial Sequence
  Synthetic
gcacggauguccgccagguuu

SEQ ID NO: 3609 - RNA, 22 nt, Artificial Sequence
  Synthetic
ggcacggauguccgccagguuu

SEQ ID NO: 3610 - RNA, 18 nt, Artificial Sequence
  Synthetic
cuuauagcgguucuugaa

SEQ ID NO: 3611 - RNA, 19 nt, Artificial Sequence
  Synthetic
acuuauagcgguucuugaa

SEQ ID NO: 3612 - RNA, 22 nt, Artificial Sequence
  Synthetic
uguacuuauagcgguucuugaa

SEQ ID NO: 3613 - RNA, 23 nt, Artificial Sequence
  Synthetic
cuguacuuauagcgguucuugaa

SEQ ID NO: 3614 - RNA, 18 nt, Artificial Sequence
  Synthetic
caaagagcuucuucucca

SEQ ID NO: 3615 - RNA, 21 nt, Artificial Sequence
  Synthetic
aggcaaagagcuucuucucca

SEQ ID NO: 3616 - RNA, 22 nt, Artificial Sequence
  Synthetic
caggcaaagagcuucuucucca

SEQ ID NO: 3617 - RNA, 23 nt, Artificial Sequence
  Synthetic
ccaggcaaagagcuucuucucca

SEQ ID NO: 3618 - RNA, 24 nt, Artificial Sequence
  Synthetic
cccaggcaaagagcuucuucucca

SEQ ID NO: 3619 - RNA, 18 nt, Artificial Sequence
  Synthetic
aaaugcugacagaagaua

SEQ ID NO: 3620 - RNA, 19 nt, Artificial Sequence
  Synthetic
uaaaugcugacagaagaua

SEQ ID NO: 3621 - RNA, 20 nt, Artificial Sequence
  Synthetic
auaaaugcugacagaagaua

SEQ ID NO: 3622 - RNA, 21 nt, Artificial Sequence
  Synthetic
cauaaaugcugacagaagaua

SEQ ID NO: 3623 - RNA, 22 nt, Artificial Sequence
  Synthetic
ccauaaaugcugacagaagaua

SEQ ID NO: 3624 - RNA, 23 nt, Artificial Sequence
  Synthetic
cccauaaaugcugacagaagaua

SEQ ID NO: 3625 - RNA, 24 nt, Artificial Sequence
  Synthetic
ucccauaaaugcugacagaagaua

SEQ ID NO: 3626 - RNA, 18 nt, Artificial Sequence
  Synthetic
auuuuauuucacaaugua

SEQ ID NO: 3627 - RNA, 19 nt, Artificial Sequence
  Synthetic
aauuuuauuucacaaugua

SEQ ID NO: 3628 - RNA, 20 nt, Artificial Sequence
  Synthetic
aaauuuuauuucacaaugua

SEQ ID NO: 3629 - RNA, 21 nt, Artificial Sequence
  Synthetic
aaaauuuuauuucacaaugua

SEQ ID NO: 3630 - RNA, 23 nt, Artificial Sequence
  Synthetic
agaaaauuuuauuucacaaugua

SEQ ID NO: 3631 - RNA, 24 nt, Artificial Sequence
  Synthetic
aagaaaauuuuauuucacaaugua

SEQ ID NO: 3632 - RNA, 18 nt, Artificial Sequence
  Synthetic
uguccguguagccacccc

SEQ ID NO: 3633 - RNA, 19 nt, Artificial Sequence
  Synthetic
auguccguguagccacccc

SEQ ID NO: 3634 - RNA, 21 nt, Artificial Sequence
  Synthetic
caauguccguguagccacccc

SEQ ID NO: 3635 - RNA, 22 nt, Artificial Sequence
  Synthetic
ucaauguccguguagccacccc

SEQ ID NO: 3636 - RNA, 24 nt, Artificial Sequence
  Synthetic
agucaauguccguguagccacccc

SEQ ID NO: 3637 - RNA, 18 nt, Artificial Sequence
  Synthetic
uccgugguagccagcucc

SEQ ID NO: 3638 - RNA, 21 nt, Artificial Sequence
  Synthetic
cuguccgugguagccagcucc

SEQ ID NO: 3639 - RNA, 22 nt, Artificial Sequence
  Synthetic
acuguccgugguagccagcucc

SEQ ID NO: 3640 - RNA, 23 nt, Artificial Sequence
  Synthetic
aacuguccgugguagccagcucc

SEQ ID NO: 3641 - RNA, 18 nt, Artificial Sequence
  Synthetic
ccuggaaauagaggcucc

SEQ ID NO: 3642 - RNA, 19 nt, Artificial Sequence
  Synthetic
cccuggaaauagaggcucc

SEQ ID NO: 3643 - RNA, 21 nt, Artificial Sequence
  Synthetic
cgcccuggaaauagaggcucc

SEQ ID NO: 3644 - RNA, 23 nt, Artificial Sequence
  Synthetic
agcgcccuggaaauagaggcucc

SEQ ID NO: 3645 - RNA, 24 nt, Artificial Sequence
  Synthetic
cagcgcccuggaaauagaggcucc

SEQ ID NO: 3646 - RNA, 19 nt, Artificial Sequence
  Synthetic
cgauucuccacguggucuc

SEQ ID NO: 3647 - RNA, 20 nt, Artificial Sequence
  Synthetic
ucgauucuccacguggucuc

SEQ ID NO: 3648 - RNA, 22 nt, Artificial Sequence
  Synthetic
ugucgauucuccacguggucuc

SEQ ID NO: 3649 - RNA, 24 nt, Artificial Sequence
  Synthetic
ugugucgauucuccacguggucuc

SEQ ID NO: 3650 - RNA, 18 nt, Artificial Sequence
  Synthetic
cacagcccgagcaguguc

SEQ ID NO: 3651 - RNA, 21 nt, Artificial Sequence
  Synthetic
uggcacagcccgagcaguguc

SEQ ID NO: 3652 - RNA, 24 nt, Artificial Sequence
  Synthetic
ugguggcacagcccgagcaguguc

SEQ ID NO: 3653 - RNA, 19 nt, Artificial Sequence
  Synthetic
cgcccucagacuacaauuc

SEQ ID NO: 3654 - RNA, 21 nt, Artificial Sequence
  Synthetic
uacgcccucagacuacaauuc

SEQ ID NO: 3655 - RNA, 22 nt, Artificial Sequence
  Synthetic
cuacgcccucagacuacaauuc

SEQ ID NO: 3656 - RNA, 23 nt, Artificial Sequence
  Synthetic
ucuacgcccucagacuacaauuc

SEQ ID NO: 3657 - RNA, 18 nt, Artificial Sequence
  Synthetic
cuguacuuauagcgguuc

SEQ ID NO: 3658 - RNA, 21 nt, Artificial Sequence
  Synthetic
cugcuguacuuauagcgguuc

SEQ ID NO: 3659 - RNA, 23 nt, Artificial Sequence
  Synthetic
ugcugcuguacuuauagcgguuc

SEQ ID NO: 3660 - RNA, 24 nt, Artificial Sequence
  Synthetic
augcugcuguacuuauagcgguuc

SEQ ID NO: 3661 - RNA, 20 nt, Artificial Sequence
  Synthetic
aggcaguaugugaaccuuag

SEQ ID NO: 3662 - RNA, 21 nt, Artificial Sequence
  Synthetic
uaggcaguaugugaaccuuag

SEQ ID NO: 3663 - RNA, 22 nt, Artificial Sequence
  Synthetic
cuaggcaguaugugaaccuuag

SEQ ID NO: 3664 - RNA, 23 nt, Artificial Sequence
  Synthetic
ccuaggcaguaugugaaccuuag

SEQ ID NO: 3665 - RNA, 18 nt, Artificial Sequence
  Synthetic
aguucaaggaagagaacg

SEQ ID NO: 3666 - RNA, 19 nt, Artificial Sequence
  Synthetic
aaguucaaggaagagaacg

SEQ ID NO: 3667 - RNA, 20 nt, Artificial Sequence
  Synthetic
aaaguucaaggaagagaacg

SEQ ID NO: 3668 - RNA, 21 nt, Artificial Sequence
  Synthetic
caaaguucaaggaagagaacg

SEQ ID NO: 3669 - RNA, 22 nt, Artificial Sequence
  Synthetic
acaaaguucaaggaagagaacg

SEQ ID NO: 3670 - RNA, 23 nt, Artificial Sequence
  Synthetic
cacaaaguucaaggaagagaacg

SEQ ID NO: 3671 - RNA, 24 nt, Artificial Sequence
  Synthetic
ccacaaaguucaaggaagagaacg

SEQ ID NO: 3672 - RNA, 18 nt, Artificial Sequence
  Synthetic
uguagggguaggugggcu

SEQ ID NO: 3673 - RNA, 22 nt, Artificial Sequence
  Synthetic
uggguguagggguaggugggcu

SEQ ID NO: 3674 - RNA, 23 nt, Artificial Sequence
  Synthetic
cuggguguagggguaggugggcu

SEQ ID NO: 3675 - RNA, 24 nt, Artificial Sequence
  Synthetic
ccuggguguagggguaggugggcu

SEQ ID NO: 3676 - RNA, 19 nt, Artificial Sequence
  Synthetic
uguucgaguuccagauucu

SEQ ID NO: 3677 - RNA, 20 nt, Artificial Sequence
  Synthetic
uuguucgaguuccagauucu

SEQ ID NO: 3678 - RNA, 21 nt, Artificial Sequence
  Synthetic
uuuguucgaguuccagauucu

SEQ ID NO: 3679 - RNA, 24 nt, Artificial Sequence
  Synthetic
agguuuguucgaguuccagauucu

SEQ ID NO: 3680 - RNA, 22 nt, Artificial Sequence
  Synthetic
agcgguucuugaaugggauggu

SEQ ID NO: 3681 - RNA, 23 nt, Artificial Sequence
  Synthetic
uagcgguucuugaaugggauggu

SEQ ID NO: 3682 - RNA, 24 nt, Artificial Sequence
  Synthetic
auagcgguucuugaaugggauggu

SEQ ID NO: 3683 - RNA, 18 nt, Artificial Sequence
  Synthetic
acguggucuccugggugu

SEQ ID NO: 3684 - RNA, 19 nt, Artificial Sequence
  Synthetic
cacguggucuccugggugu

SEQ ID NO: 3685 - RNA, 21 nt, Artificial Sequence
  Synthetic
uccacguggucuccugggugu

SEQ ID NO: 3686 - RNA, 22 nt, Artificial Sequence
  Synthetic
cuccacguggucuccugggugu

SEQ ID NO: 3687 - RNA, 23 nt, Artificial Sequence
  Synthetic
ucuccacguggucuccugggugu

SEQ ID NO: 3688 - RNA, 24 nt, Artificial Sequence
  Synthetic
uucuccacguggucuccugggugu

SEQ ID NO: 3689 - RNA, 18 nt, Artificial Sequence
  Synthetic
uuugucucccagguuugu

SEQ ID NO: 3690 - RNA, 21 nt, Artificial Sequence
  Synthetic
auguuugucucccagguuugu

SEQ ID NO: 3691 - RNA, 24 nt, Artificial Sequence
  Synthetic
cggauguuugucucccagguuugu

SEQ ID NO: 3692 - RNA, 21 nt, Artificial Sequence
  Synthetic
auggugaccauguucauccuu

SEQ ID NO: 3693 - RNA, 23 nt, Artificial Sequence
  Synthetic
agauggugaccauguucauccuu

SEQ ID NO: 3694 - RNA, 24 nt, Artificial Sequence
  Synthetic
uagauggugaccauguucauccuu

SEQ ID NO: 3695 - RNA, 18 nt, Artificial Sequence
  Synthetic
auuggcgacugacugcuu

SEQ ID NO: 3696 - RNA, 19 nt, Artificial Sequence
  Synthetic
cauuggcgacugacugcuu

SEQ ID NO: 3697 - RNA, 22 nt, Artificial Sequence
  Synthetic
aggcauuggcgacugacugcuu

SEQ ID NO: 3698 - RNA, 23 nt, Artificial Sequence
  Synthetic
aaggcauuggcgacugacugcuu

SEQ ID NO: 3699 - RNA, 18 nt, Artificial Sequence
  Synthetic
cucuccaaacugaaccca

SEQ ID NO: 3700 - RNA, 19 nt, Artificial Sequence
  Synthetic
ccucuccaaacugaaccca

SEQ ID NO: 3701 - RNA, 20 nt, Artificial Sequence
  Synthetic
uccucuccaaacugaaccca

SEQ ID NO: 3702 - RNA, 22 nt, Artificial Sequence
  Synthetic
uguccucuccaaacugaaccca

SEQ ID NO: 3703 - RNA, 23 nt, Artificial Sequence
  Synthetic
uuguccucuccaaacugaaccca

SEQ ID NO: 3704 - RNA, 24 nt, Artificial Sequence
  Synthetic
auuguccucuccaaacugaaccca

SEQ ID NO: 3705 - RNA, 18 nt, Artificial Sequence
  Synthetic
uagcuccucuggccagca

SEQ ID NO: 3706 - RNA, 19 nt, Artificial Sequence
  Synthetic
auagcuccucuggccagca

SEQ ID NO: 3707 - RNA, 20 nt, Artificial Sequence
  Synthetic
aauagcuccucuggccagca

SEQ ID NO: 3708 - RNA, 22 nt, Artificial Sequence
  Synthetic
agaauagcuccucuggccagca

SEQ ID NO: 3709 - RNA, 23 nt, Artificial Sequence
  Synthetic
cagaauagcuccucuggccagca

SEQ ID NO: 3710 - RNA, 19 nt, Artificial Sequence
  Synthetic
uggcuucuaaugcuucaga

SEQ ID NO: 3711 - RNA, 20 nt, Artificial Sequence
  Synthetic
uuggcuucuaaugcuucaga

SEQ ID NO: 3712 - RNA, 22 nt, Artificial Sequence
  Synthetic
aguuggcuucuaaugcuucaga

SEQ ID NO: 3713 - RNA, 23 nt, Artificial Sequence
  Synthetic
caguuggcuucuaaugcuucaga

SEQ ID NO: 3714 - RNA, 24 nt, Artificial Sequence
  Synthetic
acaguuggcuucuaaugcuucaga

SEQ ID NO: 3715 - RNA, 18 nt, Artificial Sequence
  Synthetic
aucuucugucagcauuua

SEQ ID NO: 3716 - RNA, 19 nt, Artificial Sequence
  Synthetic
uaucuucugucagcauuua

SEQ ID NO: 3717 - RNA, 21 nt, Artificial Sequence
  Synthetic
uuuaucuucugucagcauuua

SEQ ID NO: 3718 - RNA, 22 nt, Artificial Sequence
  Synthetic
cuuuaucuucugucagcauuua

SEQ ID NO: 3719 - RNA, 23 nt, Artificial Sequence
  Synthetic
ccuuuaucuucugucagcauuua

SEQ ID NO: 3720 - RNA, 24 nt, Artificial Sequence
  Synthetic
uccuuuaucuucugucagcauuua

SEQ ID NO: 3721 - RNA, 18 nt, Artificial Sequence
  Synthetic
uuucuuuucugaauuuac

SEQ ID NO: 3722 - RNA, 19 nt, Artificial Sequence
  Synthetic
uuuucuuuucugaauuuac

SEQ ID NO: 3723 - RNA, 21 nt, Artificial Sequence
  Synthetic
cguuuucuuuucugaauuuac

SEQ ID NO: 3724 - RNA, 22 nt, Artificial Sequence
  Synthetic
ucguuuucuuuucugaauuuac

SEQ ID NO: 3725 - RNA, 23 nt, Artificial Sequence
  Synthetic
uucguuuucuuuucugaauuuac

SEQ ID NO: 3726 - RNA, 24 nt, Artificial Sequence
  Synthetic
cuucguuuucuuuucugaauuuac

SEQ ID NO: 3727 - RNA, 18 nt, Artificial Sequence
  Synthetic
ccuaggccacuggaaagc

SEQ ID NO: 3728 - RNA, 20 nt, Artificial Sequence
  Synthetic
ugccuaggccacuggaaagc

SEQ ID NO: 3729 - RNA, 21 nt, Artificial Sequence
  Synthetic
cugccuaggccacuggaaagc

SEQ ID NO: 3730 - RNA, 22 nt, Artificial Sequence
  Synthetic
acugccuaggccacuggaaagc

SEQ ID NO: 3731 - RNA, 23 nt, Artificial Sequence
  Synthetic
uacugccuaggccacuggaaagc

SEQ ID NO: 3732 - RNA, 24 nt, Artificial Sequence
  Synthetic
auacugccuaggccacuggaaagc

SEQ ID NO: 3733 - RNA, 18 nt, Artificial Sequence
  Synthetic
agaaucgacacaguuggc

SEQ ID NO: 3734 - RNA, 21 nt, Artificial Sequence
  Synthetic
uggagaaucgacacaguuggc

SEQ ID NO: 3735 - RNA, 23 nt, Artificial Sequence
  Synthetic
cguggagaaucgacacaguuggc

SEQ ID NO: 3736 - RNA, 24 nt, Artificial Sequence
  Synthetic
acguggagaaucgacacaguuggc

SEQ ID NO: 3737 - RNA, 18 nt, Artificial Sequence
  Synthetic
agcccaucuggcuaucuc

SEQ ID NO: 3738 - RNA, 23 nt, Artificial Sequence
  Synthetic
aggagagcccaucuggcuaucuc

SEQ ID NO: 3739 - RNA, 24 nt, Artificial Sequence
  Synthetic
aaggagagcccaucuggcuaucuc

SEQ ID NO: 3740 - RNA, 21 nt, Artificial Sequence
  Synthetic
auggucaccaucuaacuauuc

SEQ ID NO: 3741 - RNA, 22 nt, Artificial Sequence
  Synthetic
cauggucaccaucuaacuauuc

SEQ ID NO: 3742 - RNA, 23 nt, Artificial Sequence
  Synthetic
acauggucaccaucuaacuauuc

SEQ ID NO: 3743 - RNA, 24 nt, Artificial Sequence
  Synthetic
aacauggucaccaucuaacuauuc

SEQ ID NO: 3744 - RNA, 18 nt, Artificial Sequence
  Synthetic
aacugaaguuccugcuuc

SEQ ID NO: 3745 - RNA, 19 nt, Artificial Sequence
  Synthetic
uaacugaaguuccugcuuc

SEQ ID NO: 3746 - RNA, 20 nt, Artificial Sequence
  Synthetic
cuaacugaaguuccugcuuc

SEQ ID NO: 3747 - RNA, 22 nt, Artificial Sequence
  Synthetic
agcuaacugaaguuccugcuuc

SEQ ID NO: 3748 - RNA, 24 nt, Artificial Sequence
  Synthetic
cgagcuaacugaaguuccugcuuc

SEQ ID NO: 3749 - RNA, 18 nt, Artificial Sequence
  Synthetic
cauaacuucuaaaggaag

SEQ ID NO: 3750 - RNA, 20 nt, Artificial Sequence
  Synthetic
agcauaacuucuaaaggaag

SEQ ID NO: 3751 - RNA, 21 nt, Artificial Sequence
  Synthetic
aagcauaacuucuaaaggaag

SEQ ID NO: 3752 - RNA, 22 nt, Artificial Sequence
  Synthetic
aaagcauaacuucuaaaggaag

SEQ ID NO: 3753 - RNA, 23 nt, Artificial Sequence
  Synthetic
aaaagcauaacuucuaaaggaag

SEQ ID NO: 3754 - RNA, 24 nt, Artificial Sequence
  Synthetic
aaaaagcauaacuucuaaaggaag

SEQ ID NO: 3755 - RNA, 19 nt, Artificial Sequence
  Synthetic
ugcuucagauagaauacag

SEQ ID NO: 3756 - RNA, 20 nt, Artificial Sequence
  Synthetic
augcuucagauagaauacag

SEQ ID NO: 3757 - RNA, 21 nt, Artificial Sequence
  Synthetic
aaugcuucagauagaauacag

SEQ ID NO: 3758 - RNA, 22 nt, Artificial Sequence
  Synthetic
uaaugcuucagauagaauacag

SEQ ID NO: 3759 - RNA, 23 nt, Artificial Sequence
  Synthetic
cuaaugcuucagauagaauacag

SEQ ID NO: 3760 - RNA, 24 nt, Artificial Sequence
  Synthetic
ucuaaugcuucagauagaauacag

SEQ ID NO: 3761 - RNA, 18 nt, Artificial Sequence
  Synthetic
aaguuuucauuaauccag

SEQ ID NO: 3762 - RNA, 19 nt, Artificial Sequence
  Synthetic
caaguuuucauuaauccag

SEQ ID NO: 3763 - RNA, 21 nt, Artificial Sequence
  Synthetic
uccaaguuuucauuaauccag

SEQ ID NO: 3764 - RNA, 22 nt, Artificial Sequence
  Synthetic
uuccaaguuuucauuaauccag

SEQ ID NO: 3765 - RNA, 23 nt, Artificial Sequence
  Synthetic
uuuccaaguuuucauuaauccag

SEQ ID NO: 3766 - RNA, 24 nt, Artificial Sequence
  Synthetic
cuuuccaaguuuucauuaauccag

SEQ ID NO: 3767 - RNA, 18 nt, Artificial Sequence
  Synthetic
acugucauaagauaugag

SEQ ID NO: 3768 - RNA, 19 nt, Artificial Sequence
  Synthetic
aacugucauaagauaugag

SEQ ID NO: 3769 - RNA, 21 nt, Artificial Sequence
  Synthetic
agaacugucauaagauaugag

SEQ ID NO: 3770 - RNA, 22 nt, Artificial Sequence
  Synthetic
cagaacugucauaagauaugag

SEQ ID NO: 3771 - RNA, 23 nt, Artificial Sequence
  Synthetic
ccagaacugucauaagauaugag

SEQ ID NO: 3772 - RNA, 24 nt, Artificial Sequence
  Synthetic
uccagaacugucauaagauaugag

SEQ ID NO: 3773 - RNA, 18 nt, Artificial Sequence
  Synthetic
uuuaaugcaguuucuacg

SEQ ID NO: 3774 - RNA, 19 nt, Artificial Sequence
  Synthetic
uuuuaaugcaguuucuacg

SEQ ID NO: 3775 - RNA, 21 nt, Artificial Sequence
  Synthetic
ucuuuuaaugcaguuucuacg

SEQ ID NO: 3776 - RNA, 22 nt, Artificial Sequence
  Synthetic
uucuuuuaaugcaguuucuacg

SEQ ID NO: 3777 - RNA, 23 nt, Artificial Sequence
  Synthetic
uuucuuuuaaugcaguuucuacg

SEQ ID NO: 3778 - RNA, 24 nt, Artificial Sequence
  Synthetic
cuuucuuuuaaugcaguuucuacg

SEQ ID NO: 3779 - RNA, 19 nt, Artificial Sequence
  Synthetic
agccucuauuuccagggcg

SEQ ID NO: 3780 - RNA, 24 nt, Artificial Sequence
  Synthetic
cggggagccucuauuuccagggcg

SEQ ID NO: 3781 - RNA, 18 nt, Artificial Sequence
  Synthetic
ccagagaagguaagaaug

SEQ ID NO: 3782 - RNA, 19 nt, Artificial Sequence
  Synthetic
uccagagaagguaagaaug

SEQ ID NO: 3783 - RNA, 20 nt, Artificial Sequence
  Synthetic
cuccagagaagguaagaaug

SEQ ID NO: 3784 - RNA, 23 nt, Artificial Sequence
  Synthetic
aggcuccagagaagguaagaaug

SEQ ID NO: 3785 - RNA, 24 nt, Artificial Sequence
  Synthetic
caggcuccagagaagguaagaaug

SEQ ID NO: 3786 - RNA, 18 nt, Artificial Sequence
  Synthetic
cacccaggagaccacgug

SEQ ID NO: 3787 - RNA, 19 nt, Artificial Sequence
  Synthetic
acacccaggagaccacgug

SEQ ID NO: 3788 - RNA, 20 nt, Artificial Sequence
  Synthetic
uacacccaggagaccacgug

SEQ ID NO: 3789 - RNA, 21 nt, Artificial Sequence
  Synthetic
cuacacccaggagaccacgug

SEQ ID NO: 3790 - RNA, 22 nt, Artificial Sequence
  Synthetic
ccuacacccaggagaccacgug

SEQ ID NO: 3791 - RNA, 23 nt, Artificial Sequence
  Synthetic
cccuacacccaggagaccacgug

SEQ ID NO: 3792 - RNA, 24 nt, Artificial Sequence
  Synthetic
ccccuacacccaggagaccacgug

SEQ ID NO: 3793 - RNA, 18 nt, Artificial Sequence
  Synthetic
augcagaguggggggacu

SEQ ID NO: 3794 - RNA, 19 nt, Artificial Sequence
  Synthetic
aaugcagaguggggggacu

SEQ ID NO: 3795 - RNA, 21 nt, Artificial Sequence
  Synthetic
agaaugcagaguggggggacu

SEQ ID NO: 3796 - RNA, 22 nt, Artificial Sequence
  Synthetic
aagaaugcagaguggggggacu

SEQ ID NO: 3797 - RNA, 23 nt, Artificial Sequence
  Synthetic
uaagaaugcagaguggggggacu

SEQ ID NO: 3798 - RNA, 18 nt, Artificial Sequence
  Synthetic
uguggaugaagcaggccu

SEQ ID NO: 3799 - RNA, 19 nt, Artificial Sequence
  Synthetic
cuguggaugaagcaggccu

SEQ ID NO: 3800 - RNA, 22 nt, Artificial Sequence
  Synthetic
uggcuguggaugaagcaggccu

SEQ ID NO: 3801 - RNA, 23 nt, Artificial Sequence
  Synthetic
uuggcuguggaugaagcaggccu

SEQ ID NO: 3802 - RNA, 24 nt, Artificial Sequence
  Synthetic
cuuggcuguggaugaagcaggccu

SEQ ID NO: 3803 - RNA, 18 nt, Artificial Sequence
  Synthetic
acggacauugacuuggcu

SEQ ID NO: 3804 - RNA, 19 nt, Artificial Sequence
  Synthetic
cacggacauugacuuggcu

SEQ ID NO: 3805 - RNA, 21 nt, Artificial Sequence
  Synthetic
uacacggacauugacuuggcu

SEQ ID NO: 3806 - RNA, 22 nt, Artificial Sequence
  Synthetic
cuacacggacauugacuuggcu

SEQ ID NO: 3807 - RNA, 19 nt, Artificial Sequence
  Synthetic
cggacaguucccguauucu

SEQ ID NO: 3808 - RNA, 21 nt, Artificial Sequence
  Synthetic
cacggacaguucccguauucu

SEQ ID NO: 3809 - RNA, 22 nt, Artificial Sequence
  Synthetic
ccacggacaguucccguauucu

SEQ ID NO: 3810 - RNA, 23 nt, Artificial Sequence
  Synthetic
accacggacaguucccguauucu

SEQ ID NO: 3811 - RNA, 24 nt, Artificial Sequence
  Synthetic
uaccacggacaguucccguauucu

SEQ ID NO: 3812 - RNA, 18 nt, Artificial Sequence
  Synthetic
aggauguggagaacuagu

SEQ ID NO: 3813 - RNA, 19 nt, Artificial Sequence
  Synthetic
caggauguggagaacuagu

SEQ ID NO: 3814 - RNA, 20 nt, Artificial Sequence
  Synthetic
ccaggauguggagaacuagu

SEQ ID NO: 3815 - RNA, 21 nt, Artificial Sequence
  Synthetic
accaggauguggagaacuagu

SEQ ID NO: 3816 - RNA, 22 nt, Artificial Sequence
  Synthetic
uaccaggauguggagaacuagu

SEQ ID NO: 3817 - RNA, 23 nt, Artificial Sequence
  Synthetic
uuaccaggauguggagaacuagu

SEQ ID NO: 3818 - RNA, 24 nt, Artificial Sequence
  Synthetic
uuuaccaggauguggagaacuagu

SEQ ID NO: 3819 - RNA, 18 nt, Artificial Sequence
  Synthetic
ccaggcuccagagaaggu

SEQ ID NO: 3820 - RNA, 19 nt, Artificial Sequence
  Synthetic
accaggcuccagagaaggu

SEQ ID NO: 3821 - RNA, 20 nt, Artificial Sequence
  Synthetic
caccaggcuccagagaaggu

SEQ ID NO: 3822 - RNA, 21 nt, Artificial Sequence
  Synthetic
ccaccaggcuccagagaaggu

SEQ ID NO: 3823 - RNA, 23 nt, Artificial Sequence
  Synthetic
ugccaccaggcuccagagaaggu

SEQ ID NO: 3824 - RNA, 18 nt, Artificial Sequence
  Synthetic
uacuggcaaguauggugu

SEQ ID NO: 3825 - RNA, 19 nt, Artificial Sequence
  Synthetic
uuacuggcaaguauggugu

SEQ ID NO: 3826 - RNA, 20 nt, Artificial Sequence
  Synthetic
auuacuggcaaguauggugu

SEQ ID NO: 3827 - RNA, 21 nt, Artificial Sequence
  Synthetic
aauuacuggcaaguauggugu

SEQ ID NO: 3828 - RNA, 22 nt, Artificial Sequence
  Synthetic
caauuacuggcaaguauggugu

SEQ ID NO: 3829 - RNA, 23 nt, Artificial Sequence
  Synthetic
acaauuacuggcaaguauggugu

SEQ ID NO: 3830 - RNA, 24 nt, Artificial Sequence
  Synthetic
aacaauuacuggcaaguauggugu

SEQ ID NO: 3831 - RNA, 18 nt, Artificial Sequence
  Synthetic
cucuuccuugaacuuugu

SEQ ID NO: 3832 - RNA, 19 nt, Artificial Sequence
  Synthetic
ucucuuccuugaacuuugu

SEQ ID NO: 3833 - RNA, 22 nt, Artificial Sequence
  Synthetic
cguucucuuccuugaacuuugu

SEQ ID NO: 3834 - RNA, 23 nt, Artificial Sequence
  Synthetic
acguucucuuccuugaacuuugu

SEQ ID NO: 3835 - RNA, 24 nt, Artificial Sequence
  Synthetic
aacguucucuuccuugaacuuugu

SEQ ID NO: 3836 - RNA, 18 nt, Artificial Sequence
  Synthetic
cggauguccgccagguuu

SEQ ID NO: 3837 - RNA, 19 nt, Artificial Sequence
  Synthetic
acggauguccgccagguuu

SEQ ID NO: 3838 - RNA, 20 nt, Artificial Sequence
  Synthetic
cacggauguccgccagguuu

SEQ ID NO: 3839 - RNA, 23 nt, Artificial Sequence
  Synthetic
uggcacggauguccgccagguuu

SEQ ID NO: 3840 - RNA, 24 nt, Artificial Sequence
  Synthetic
uuggcacggauguccgccagguuu

SEQ ID NO: 3841 - RNA, 18 nt, Artificial Sequence
  Synthetic
guaaauucagaaaagaaa

SEQ ID NO: 3842 - RNA, 19 nt, Artificial Sequence
  Synthetic
gguaaauucagaaaagaaa

SEQ ID NO: 3843 - RNA, 20 nt, Artificial Sequence
  Synthetic
ugguaaauucagaaaagaaa

SEQ ID NO: 3844 - RNA, 21 nt, Artificial Sequence
  Synthetic
cugguaaauucagaaaagaaa

SEQ ID NO: 3845 - RNA, 22 nt, Artificial Sequence
  Synthetic
ccugguaaauucagaaaagaaa

SEQ ID NO: 3846 - RNA, 23 nt, Artificial Sequence
  Synthetic
uccugguaaauucagaaaagaaa

SEQ ID NO: 3847 - RNA, 24 nt, Artificial Sequence
  Synthetic
auccugguaaauucagaaaagaaa

SEQ ID NO: 3848 - RNA, 18 nt, Artificial Sequence
  Synthetic
gacucagcgcccuggaaa

SEQ ID NO: 3849 - RNA, 19 nt, Artificial Sequence
  Synthetic
ggacucagcgcccuggaaa

SEQ ID NO: 3850 - RNA, 20 nt, Artificial Sequence
  Synthetic
uggacucagcgcccuggaaa

SEQ ID NO: 3851 - RNA, 21 nt, Artificial Sequence
  Synthetic
cuggacucagcgcccuggaaa

SEQ ID NO: 3852 - RNA, 22 nt, Artificial Sequence
  Synthetic
ucuggacucagcgcccuggaaa

SEQ ID NO: 3853 - RNA, 23 nt, Artificial Sequence
  Synthetic
uucuggacucagcgcccuggaaa

SEQ ID NO: 3854 - RNA, 24 nt, Artificial Sequence
  Synthetic
guucuggacucagcgcccuggaaa

SEQ ID NO: 3855 - RNA, 18 nt, Artificial Sequence
  Synthetic
auccugguaaauucagaa

SEQ ID NO: 3856 - RNA, 19 nt, Artificial Sequence
  Synthetic
cauccugguaaauucagaa

SEQ ID NO: 3857 - RNA, 20 nt, Artificial Sequence
  Synthetic
acauccugguaaauucagaa

SEQ ID NO: 3858 - RNA, 21 nt, Artificial Sequence
  Synthetic
cacauccugguaaauucagaa

SEQ ID NO: 3859 - RNA, 22 nt, Artificial Sequence
  Synthetic
ccacauccugguaaauucagaa

SEQ ID NO: 3860 - RNA, 23 nt, Artificial Sequence
  Synthetic
uccacauccugguaaauucagaa

SEQ ID NO: 3861 - RNA, 24 nt, Artificial Sequence
  Synthetic
cuccacauccugguaaauucagaa

SEQ ID NO: 3862 - RNA, 18 nt, Artificial Sequence
  Synthetic
cccacaaaguucaaggaa

SEQ ID NO: 3863 - RNA, 19 nt, Artificial Sequence
  Synthetic
ucccacaaaguucaaggaa

SEQ ID NO: 3864 - RNA, 20 nt, Artificial Sequence
  Synthetic
uucccacaaaguucaaggaa

SEQ ID NO: 3865 - RNA, 18 nt, Artificial Sequence
  Synthetic
acguagaaacugcauuaa

SEQ ID NO: 3866 - RNA, 19 nt, Artificial Sequence
  Synthetic
cacguagaaacugcauuaa

SEQ ID NO: 3867 - RNA, 20 nt, Artificial Sequence
  Synthetic
ccacguagaaacugcauuaa

SEQ ID NO: 3868 - RNA, 21 nt, Artificial Sequence
  Synthetic
uccacguagaaacugcauuaa

SEQ ID NO: 3869 - RNA, 22 nt, Artificial Sequence
  Synthetic
uuccacguagaaacugcauuaa

SEQ ID NO: 3870 - RNA, 23 nt, Artificial Sequence
  Synthetic
auuccacguagaaacugcauuaa

SEQ ID NO: 3871 - RNA, 24 nt, Artificial Sequence
  Synthetic
aauuccacguagaaacugcauuaa

SEQ ID NO: 3872 - RNA, 18 nt, Artificial Sequence
  Synthetic
uauauucgaugcuggcca

SEQ ID NO: 3873 - RNA, 19 nt, Artificial Sequence
  Synthetic
uuauauucgaugcuggcca

SEQ ID NO: 3874 - RNA, 20 nt, Artificial Sequence
  Synthetic
cuuauauucgaugcuggcca

SEQ ID NO: 3875 - RNA, 21 nt, Artificial Sequence
  Synthetic
acuuauauucgaugcuggcca

SEQ ID NO: 3876 - RNA, 22 nt, Artificial Sequence
  Synthetic
uacuuauauucgaugcuggcca

SEQ ID NO: 3877 - RNA, 23 nt, Artificial Sequence
  Synthetic
uuacuuauauucgaugcuggcca

SEQ ID NO: 3878 - RNA, 24 nt, Artificial Sequence
  Synthetic
cuuacuuauauucgaugcuggcca

SEQ ID NO: 3879 - RNA, 18 nt, Artificial Sequence
  Synthetic
uucaaguugucccaggca

SEQ ID NO: 3880 - RNA, 19 nt, Artificial Sequence
  Synthetic
guucaaguugucccaggca

SEQ ID NO: 3881 - RNA, 21 nt, Artificial Sequence
  Synthetic
auguucaaguugucccaggca

SEQ ID NO: 3882 - RNA, 22 nt, Artificial Sequence
  Synthetic
cauguucaaguugucccaggca

SEQ ID NO: 3883 - RNA, 23 nt, Artificial Sequence
  Synthetic
ccauguucaaguugucccaggca

SEQ ID NO: 3884 - RNA, 24 nt, Artificial Sequence
  Synthetic
accauguucaaguugucccaggca

SEQ ID NO: 3885 - RNA, 18 nt, Artificial Sequence
  Synthetic
agaaacugcauuaaaaga

SEQ ID NO: 3886 - RNA, 19 nt, Artificial Sequence
  Synthetic
uagaaacugcauuaaaaga

SEQ ID NO: 3887 - RNA, 20 nt, Artificial Sequence
  Synthetic
guagaaacugcauuaaaaga

SEQ ID NO: 3888 - RNA, 21 nt, Artificial Sequence
  Synthetic
cguagaaacugcauuaaaaga

SEQ ID NO: 3889 - RNA, 22 nt, Artificial Sequence
  Synthetic
acguagaaacugcauuaaaaga

SEQ ID NO: 3890 - RNA, 23 nt, Artificial Sequence
  Synthetic
cacguagaaacugcauuaaaaga

SEQ ID NO: 3891 - RNA, 24 nt, Artificial Sequence
  Synthetic
ccacguagaaacugcauuaaaaga

SEQ ID NO: 3892 - RNA, 18 nt, Artificial Sequence
  Synthetic
cucuggguucaguuugga

SEQ ID NO: 3893 - RNA, 19 nt, Artificial Sequence
  Synthetic
ucucuggguucaguuugga

SEQ ID NO: 3894 - RNA, 20 nt, Artificial Sequence
  Synthetic
uucucuggguucaguuugga

SEQ ID NO: 3895 - RNA, 21 nt, Artificial Sequence
  Synthetic
auucucuggguucaguuugga

SEQ ID NO: 3896 - RNA, 22 nt, Artificial Sequence
  Synthetic
gauucucuggguucaguuugga

SEQ ID NO: 3897 - RNA, 23 nt, Artificial Sequence
  Synthetic
agauucucuggguucaguuugga

SEQ ID NO: 3898 - RNA, 24 nt, Artificial Sequence
  Synthetic
cagauucucuggguucaguuugga

SEQ ID NO: 3899 - RNA, 18 nt, Artificial Sequence
  Synthetic
acaucccauaaaugcuga

SEQ ID NO: 3900 - RNA, 19 nt, Artificial Sequence
  Synthetic
aacaucccauaaaugcuga

SEQ ID NO: 3901 - RNA, 20 nt, Artificial Sequence
  Synthetic
aaacaucccauaaaugcuga

SEQ ID NO: 3902 - RNA, 21 nt, Artificial Sequence
  Synthetic
uaaacaucccauaaaugcuga

SEQ ID NO: 3903 - RNA, 22 nt, Artificial Sequence
  Synthetic
uuaaacaucccauaaaugcuga

SEQ ID NO: 3904 - RNA, 23 nt, Artificial Sequence
  Synthetic
auuaaacaucccauaaaugcuga

SEQ ID NO: 3905 - RNA, 24 nt, Artificial Sequence
  Synthetic
cauuaaacaucccauaaaugcuga

SEQ ID NO: 3906 - RNA, 18 nt, Artificial Sequence
  Synthetic
acuuauagcgguucuuga

SEQ ID NO: 3907 - RNA, 19 nt, Artificial Sequence
  Synthetic
uacuuauagcgguucuuga

SEQ ID NO: 3908 - RNA, 21 nt, Artificial Sequence
  Synthetic
uguacuuauagcgguucuuga

SEQ ID NO: 3909 - RNA, 22 nt, Artificial Sequence
  Synthetic
cuguacuuauagcgguucuuga

SEQ ID NO: 3910 - RNA, 23 nt, Artificial Sequence
  Synthetic
gcuguacuuauagcgguucuuga

SEQ ID NO: 3911 - RNA, 24 nt, Artificial Sequence
  Synthetic
ugcuguacuuauagcgguucuuga

SEQ ID NO: 3912 - RNA, 18 nt, Artificial Sequence
  Synthetic
guagccaccccaagaaua

SEQ ID NO: 3913 - RNA, 19 nt, Artificial Sequence
  Synthetic
uguagccaccccaagaaua

SEQ ID NO: 3914 - RNA, 21 nt, Artificial Sequence
  Synthetic
cguguagccaccccaagaaua

SEQ ID NO: 3915 - RNA, 22 nt, Artificial Sequence
  Synthetic
ccguguagccaccccaagaaua

SEQ ID NO: 3916 - RNA, 23 nt, Artificial Sequence
  Synthetic
uccguguagccaccccaagaaua

SEQ ID NO: 3917 - RNA, 24 nt, Artificial Sequence
  Synthetic
guccguguagccaccccaagaaua

SEQ ID NO: 3918 - RNA, 18 nt, Artificial Sequence
  Synthetic
guucauccuucuggauua

SEQ ID NO: 3919 - RNA, 19 nt, Artificial Sequence
  Synthetic
uguucauccuucuggauua

SEQ ID NO: 3920 - RNA, 21 nt, Artificial Sequence
  Synthetic
cauguucauccuucuggauua

SEQ ID NO: 3921 - RNA, 22 nt, Artificial Sequence
  Synthetic
ccauguucauccuucuggauua

SEQ ID NO: 3922 - RNA, 23 nt, Artificial Sequence
  Synthetic
accauguucauccuucuggauua

SEQ ID NO: 3923 - RNA, 24 nt, Artificial Sequence
  Synthetic
gaccauguucauccuucuggauua

SEQ ID NO: 3924 - RNA, 18 nt, Artificial Sequence
  Synthetic
cccaaaucacaagaaaac

SEQ ID NO: 3925 - RNA, 19 nt, Artificial Sequence
  Synthetic
ccccaaaucacaagaaaac

SEQ ID NO: 3926 - RNA, 20 nt, Artificial Sequence
  Synthetic
gccccaaaucacaagaaaac

SEQ ID NO: 3927 - RNA, 21 nt, Artificial Sequence
  Synthetic
ugccccaaaucacaagaaaac

SEQ ID NO: 3928 - RNA, 22 nt, Artificial Sequence
  Synthetic
uugccccaaaucacaagaaaac

SEQ ID NO: 3929 - RNA, 23 nt, Artificial Sequence
  Synthetic
uuugccccaaaucacaagaaaac

SEQ ID NO: 3930 - RNA, 24 nt, Artificial Sequence
  Synthetic
uuuugccccaaaucacaagaaaac

SEQ ID NO: 3931 - RNA, 18 nt, Artificial Sequence
  Synthetic
uucuggauuaaugaaaac

SEQ ID NO: 3932 - RNA, 19 nt, Artificial Sequence
  Synthetic
cuucuggauuaaugaaaac

SEQ ID NO: 3933 - RNA, 21 nt, Artificial Sequence
  Synthetic
uccuucuggauuaaugaaaac

SEQ ID NO: 3934 - RNA, 22 nt, Artificial Sequence
  Synthetic
auccuucuggauuaaugaaaac

SEQ ID NO: 3935 - RNA, 23 nt, Artificial Sequence
  Synthetic
cauccuucuggauuaaugaaaac

SEQ ID NO: 3936 - RNA, 24 nt, Artificial Sequence
  Synthetic
ucauccuucuggauuaaugaaaac

SEQ ID NO: 3937 - RNA, 18 nt, Artificial Sequence
  Synthetic
gcuuuugccccaaaucac

SEQ ID NO: 3938 - RNA, 19 nt, Artificial Sequence
  Synthetic
agcuuuugccccaaaucac

SEQ ID NO: 3939 - RNA, 20 nt, Artificial Sequence
  Synthetic
cagcuuuugccccaaaucac

SEQ ID NO: 3940 - RNA, 21 nt, Artificial Sequence
  Synthetic
acagcuuuugccccaaaucac

SEQ ID NO: 3941 - RNA, 22 nt, Artificial Sequence
  Synthetic
uacagcuuuugccccaaaucac

SEQ ID NO: 3942 - RNA, 23 nt, Artificial Sequence
  Synthetic
uuacagcuuuugccccaaaucac

SEQ ID NO: 3943 - RNA, 24 nt, Artificial Sequence
  Synthetic
cuuacagcuuuugccccaaaucac

SEQ ID NO: 3944 - RNA, 18 nt, Artificial Sequence
  Synthetic
uagccaccccaagaauac

SEQ ID NO: 3945 - RNA, 19 nt, Artificial Sequence
  Synthetic
guagccaccccaagaauac

SEQ ID NO: 3946 - RNA, 21 nt, Artificial Sequence
  Synthetic
guguagccaccccaagaauac

SEQ ID NO: 3947 - RNA, 22 nt, Artificial Sequence
  Synthetic
cguguagccaccccaagaauac

SEQ ID NO: 3948 - RNA, 23 nt, Artificial Sequence
  Synthetic
ccguguagccaccccaagaauac

SEQ ID NO: 3949 - RNA, 24 nt, Artificial Sequence
  Synthetic
uccguguagccaccccaagaauac

SEQ ID NO: 3950 - RNA, 18 nt, Artificial Sequence
  Synthetic
ucggugcuguaaaugacc

SEQ ID NO: 3951 - RNA, 19 nt, Artificial Sequence
  Synthetic
aucggugcuguaaaugacc

SEQ ID NO: 3952 - RNA, 21 nt, Artificial Sequence
  Synthetic
ucaucggugcuguaaaugacc

SEQ ID NO: 3953 - RNA, 22 nt, Artificial Sequence
  Synthetic
cucaucggugcuguaaaugacc

SEQ ID NO: 3954 - RNA, 23 nt, Artificial Sequence
  Synthetic
ccucaucggugcuguaaaugacc

SEQ ID NO: 3955 - RNA, 24 nt, Artificial Sequence
  Synthetic
gccucaucggugcuguaaaugacc

SEQ ID NO: 3956 - RNA, 18 nt, Artificial Sequence
  Synthetic
cuucagccugcucccccc

SEQ ID NO: 3957 - RNA, 19 nt, Artificial Sequence
  Synthetic
ccuucagccugcucccccc

SEQ ID NO: 3958 - RNA, 21 nt, Artificial Sequence
  Synthetic
ucccuucagccugcucccccc

SEQ ID NO: 3959 - RNA, 22 nt, Artificial Sequence
  Synthetic
cucccuucagccugcucccccc

SEQ ID NO: 3960 - RNA, 23 nt, Artificial Sequence
  Synthetic
ucucccuucagccugcucccccc

SEQ ID NO: 3961 - RNA, 24 nt, Artificial Sequence
  Synthetic
cucucccuucagccugcucccccc

SEQ ID NO: 3962 - RNA, 18 nt, Artificial Sequence
  Synthetic
ccuucagccugcuccccc

SEQ ID NO: 3963 - RNA, 19 nt, Artificial Sequence
  Synthetic
cccuucagccugcuccccc

SEQ ID NO: 3964 - RNA, 21 nt, Artificial Sequence
  Synthetic
cucccuucagccugcuccccc

SEQ ID NO: 3965 - RNA, 22 nt, Artificial Sequence
  Synthetic
ucucccuucagccugcuccccc

SEQ ID NO: 3966 - RNA, 23 nt, Artificial Sequence
  Synthetic
cucucccuucagccugcuccccc

SEQ ID NO: 3967 - RNA, 24 nt, Artificial Sequence
  Synthetic
gcucucccuucagccugcuccccc

SEQ ID NO: 3968 - RNA, 18 nt, Artificial Sequence
  Synthetic
guucuggacucagcgccc

SEQ ID NO: 3969 - RNA, 19 nt, Artificial Sequence
  Synthetic
aguucuggacucagcgccc

SEQ ID NO: 3970 - RNA, 21 nt, Artificial Sequence
  Synthetic
acaguucuggacucagcgccc

SEQ ID NO: 3971 - RNA, 22 nt, Artificial Sequence
  Synthetic
gacaguucuggacucagcgccc

SEQ ID NO: 3972 - RNA, 23 nt, Artificial Sequence
  Synthetic
ugacaguucuggacucagcgccc

SEQ ID NO: 3973 - RNA, 24 nt, Artificial Sequence
  Synthetic
augacaguucuggacucagcgccc

SEQ ID NO: 3974 - RNA, 18 nt, Artificial Sequence
  Synthetic
cugcuccccccaggagcc

SEQ ID NO: 3975 - RNA, 19 nt, Artificial Sequence
  Synthetic
ccugcuccccccaggagcc

SEQ ID NO: 3976 - RNA, 21 nt, Artificial Sequence
  Synthetic
agccugcuccccccaggagcc

SEQ ID NO: 3977 - RNA, 22 nt, Artificial Sequence
  Synthetic
cagccugcuccccccaggagcc

SEQ ID NO: 3978 - RNA, 23 nt, Artificial Sequence
  Synthetic
ucagccugcuccccccaggagcc

SEQ ID NO: 3979 - RNA, 24 nt, Artificial Sequence
  Synthetic
uucagccugcuccccccaggagcc

SEQ ID NO: 3980 - RNA, 18 nt, Artificial Sequence
  Synthetic
aguucuggacucagcgcc

SEQ ID NO: 3981 - RNA, 19 nt, Artificial Sequence
  Synthetic
caguucuggacucagcgcc

SEQ ID NO: 3982 - RNA, 20 nt, Artificial Sequence
  Synthetic
acaguucuggacucagcgcc

SEQ ID NO: 3983 - RNA, 21 nt, Artificial Sequence
  Synthetic
gacaguucuggacucagcgcc

SEQ ID NO: 3984 - RNA, 22 nt, Artificial Sequence
  Synthetic
ugacaguucuggacucagcgcc

SEQ ID NO: 3985 - RNA, 23 nt, Artificial Sequence
  Synthetic
augacaguucuggacucagcgcc

SEQ ID NO: 3986 - RNA, 24 nt, Artificial Sequence
  Synthetic
uaugacaguucuggacucagcgcc

SEQ ID NO: 3987 - RNA, 18 nt, Artificial Sequence
  Synthetic
gcaaagagcuucuucucc

SEQ ID NO: 3988 - RNA, 19 nt, Artificial Sequence
  Synthetic
ggcaaagagcuucuucucc

SEQ ID NO: 3989 - RNA, 21 nt, Artificial Sequence
  Synthetic
caggcaaagagcuucuucucc

SEQ ID NO: 3990 - RNA, 22 nt, Artificial Sequence
  Synthetic
ccaggcaaagagcuucuucucc

SEQ ID NO: 3991 - RNA, 23 nt, Artificial Sequence
  Synthetic
cccaggcaaagagcuucuucucc

SEQ ID NO: 3992 - RNA, 24 nt, Artificial Sequence
  Synthetic
ucccaggcaaagagcuucuucucc

SEQ ID NO: 3993 - RNA, 18 nt, Artificial Sequence
  Synthetic
agcucggacuucaguucc

SEQ ID NO: 3994 - RNA, 19 nt, Artificial Sequence
  Synthetic
uagcucggacuucaguucc

SEQ ID NO: 3995 - RNA, 21 nt, Artificial Sequence
  Synthetic
guuagcucggacuucaguucc

SEQ ID NO: 3996 - RNA, 22 nt, Artificial Sequence
  Synthetic
aguuagcucggacuucaguucc

SEQ ID NO: 3997 - RNA, 23 nt, Artificial Sequence
  Synthetic
caguuagcucggacuucaguucc

SEQ ID NO: 3998 - RNA, 24 nt, Artificial Sequence
  Synthetic
ucaguuagcucggacuucaguucc

SEQ ID NO: 3999 - RNA, 18 nt, Artificial Sequence
  Synthetic
cuucaaaauucgggaagc

SEQ ID NO: 4000 - RNA, 19 nt, Artificial Sequence
  Synthetic
ccuucaaaauucgggaagc

SEQ ID NO: 4001 - RNA, 21 nt, Artificial Sequence
  Synthetic
cuccuucaaaauucgggaagc

SEQ ID NO: 4002 - RNA, 22 nt, Artificial Sequence
  Synthetic
ucuccuucaaaauucgggaagc

SEQ ID NO: 4003 - RNA, 23 nt, Artificial Sequence
  Synthetic
cucuccuucaaaauucgggaagc

SEQ ID NO: 4004 - RNA, 24 nt, Artificial Sequence
  Synthetic
gcucuccuucaaaauucgggaagc

SEQ ID NO: 4005 - RNA, 18 nt, Artificial Sequence
  Synthetic
ggagccugguggcacagc

SEQ ID NO: 4006 - RNA, 19 nt, Artificial Sequence
  Synthetic
uggagccugguggcacagc

SEQ ID NO: 4007 - RNA, 21 nt, Artificial Sequence
  Synthetic
ucuggagccugguggcacagc

SEQ ID NO: 4008 - RNA, 22 nt, Artificial Sequence
  Synthetic
cucuggagccugguggcacagc

SEQ ID NO: 4009 - RNA, 23 nt, Artificial Sequence
  Synthetic
ucucuggagccugguggcacagc

SEQ ID NO: 4010 - RNA, 24 nt, Artificial Sequence
  Synthetic
uucucuggagccugguggcacagc

SEQ ID NO: 4011 - RNA, 18 nt, Artificial Sequence
  Synthetic
ugccauugccuguacagc

SEQ ID NO: 4012 - RNA, 19 nt, Artificial Sequence
  Synthetic
cugccauugccuguacagc

SEQ ID NO: 4013 - RNA, 21 nt, Artificial Sequence
  Synthetic
uucugccauugccuguacagc

SEQ ID NO: 4014 - RNA, 22 nt, Artificial Sequence
  Synthetic
cuucugccauugccuguacagc

SEQ ID NO: 4015 - RNA, 23 nt, Artificial Sequence
  Synthetic
ccuucugccauugccuguacagc

SEQ ID NO: 4016 - RNA, 24 nt, Artificial Sequence
  Synthetic
uccuucugccauugccuguacagc

SEQ ID NO: 4017 - RNA, 18 nt, Artificial Sequence
  Synthetic
guuucugcuguucucagc

SEQ ID NO: 4018 - RNA, 19 nt, Artificial Sequence
  Synthetic
uguuucugcuguucucagc

SEQ ID NO: 4019 - RNA, 20 nt, Artificial Sequence
  Synthetic
uuguuucugcuguucucagc

SEQ ID NO: 4020 - RNA, 21 nt, Artificial Sequence
  Synthetic
auuguuucugcuguucucagc

SEQ ID NO: 4021 - RNA, 22 nt, Artificial Sequence
  Synthetic
aauuguuucugcuguucucagc

SEQ ID NO: 4022 - RNA, 23 nt, Artificial Sequence
  Synthetic
uaauuguuucugcuguucucagc

SEQ ID NO: 4023 - RNA, 24 nt, Artificial Sequence
  Synthetic
guaauuguuucugcuguucucagc

SEQ ID NO: 4024 - RNA, 18 nt, Artificial Sequence
  Synthetic
gcaggaacuucaguuagc

SEQ ID NO: 4025 - RNA, 19 nt, Artificial Sequence
  Synthetic
agcaggaacuucaguuagc

SEQ ID NO: 4026 - RNA, 20 nt, Artificial Sequence
  Synthetic
aagcaggaacuucaguuagc

SEQ ID NO: 4027 - RNA, 21 nt, Artificial Sequence
  Synthetic
gaagcaggaacuucaguuagc

SEQ ID NO: 4028 - RNA, 22 nt, Artificial Sequence
  Synthetic
ggaagcaggaacuucaguuagc

SEQ ID NO: 4029 - RNA, 23 nt, Artificial Sequence
  Synthetic
gggaagcaggaacuucaguuagc

SEQ ID NO: 4030 - RNA, 24 nt, Artificial Sequence
  Synthetic
cgggaagcaggaacuucaguuagc

SEQ ID NO: 4031 - RNA, 18 nt, Artificial Sequence
  Synthetic
guguagggguaggugggc

SEQ ID NO: 4032 - RNA, 19 nt, Artificial Sequence
  Synthetic
gguguagggguaggugggc

SEQ ID NO: 4033 - RNA, 20 nt, Artificial Sequence
  Synthetic
ggguguagggguaggugggc

SEQ ID NO: 4034 - RNA, 21 nt, Artificial Sequence
  Synthetic
uggguguagggguaggugggc

SEQ ID NO: 4035 - RNA, 22 nt, Artificial Sequence
  Synthetic
cuggguguagggguaggugggc

SEQ ID NO: 4036 - RNA, 23 nt, Artificial Sequence
  Synthetic
ccuggguguagggguaggugggc

SEQ ID NO: 4037 - RNA, 24 nt, Artificial Sequence
  Synthetic
uccuggguguagggguaggugggc

SEQ ID NO: 4038 - RNA, 18 nt, Artificial Sequence
  Synthetic
cuuauauucgaugcuggc

SEQ ID NO: 4039 - RNA, 19 nt, Artificial Sequence
  Synthetic
acuuauauucgaugcuggc

SEQ ID NO: 4040 - RNA, 20 nt, Artificial Sequence
  Synthetic
uacuuauauucgaugcuggc

SEQ ID NO: 4041 - RNA, 21 nt, Artificial Sequence
  Synthetic
uuacuuauauucgaugcuggc

SEQ ID NO: 4042 - RNA, 22 nt, Artificial Sequence
  Synthetic
cuuacuuauauucgaugcuggc

SEQ ID NO: 4043 - RNA, 23 nt, Artificial Sequence
  Synthetic
ucuuacuuauauucgaugcuggc

SEQ ID NO: 4044 - RNA, 24 nt, Artificial Sequence
  Synthetic
aucuuacuuauauucgaugcuggc

SEQ ID NO: 4045 - RNA, 18 nt, Artificial Sequence
  Synthetic
gguaaccauguaacaugc

SEQ ID NO: 4046 - RNA, 19 nt, Artificial Sequence
  Synthetic
ugguaaccauguaacaugc

SEQ ID NO: 4047 - RNA, 20 nt, Artificial Sequence
  Synthetic
gugguaaccauguaacaugc

SEQ ID NO: 4048 - RNA, 21 nt, Artificial Sequence
  Synthetic
ugugguaaccauguaacaugc

SEQ ID NO: 4049 - RNA, 22 nt, Artificial Sequence
  Synthetic
uugugguaaccauguaacaugc

SEQ ID NO: 4050 - RNA, 23 nt, Artificial Sequence
  Synthetic
cuugugguaaccauguaacaugc

SEQ ID NO: 4051 - RNA, 24 nt, Artificial Sequence
  Synthetic
gcuugugguaaccauguaacaugc

SEQ ID NO: 4052 - RNA, 18 nt, Artificial Sequence
  Synthetic
gaaagcagucaaagcugc

SEQ ID NO: 4053 - RNA, 19 nt, Artificial Sequence
  Synthetic
ggaaagcagucaaagcugc

SEQ ID NO: 4054 - RNA, 21 nt, Artificial Sequence
  Synthetic
uuggaaagcagucaaagcugc

SEQ ID NO: 4055 - RNA, 22 nt, Artificial Sequence
  Synthetic
cuuggaaagcagucaaagcugc

SEQ ID NO: 4056 - RNA, 23 nt, Artificial Sequence
  Synthetic
acuuggaaagcagucaaagcugc

SEQ ID NO: 4057 - RNA, 24 nt, Artificial Sequence
  Synthetic
aacuuggaaagcagucaaagcugc

SEQ ID NO: 4058 - RNA, 18 nt, Artificial Sequence
  Synthetic
uuggaggcuuuucacauc

SEQ ID NO: 4059 - RNA, 19 nt, Artificial Sequence
  Synthetic
cuuggaggcuuuucacauc

SEQ ID NO: 4060 - RNA, 21 nt, Artificial Sequence
  Synthetic
agcuuggaggcuuuucacauc

SEQ ID NO: 4061 - RNA, 22 nt, Artificial Sequence
  Synthetic
cagcuuggaggcuuuucacauc

SEQ ID NO: 4062 - RNA, 23 nt, Artificial Sequence
  Synthetic
acagcuuggaggcuuuucacauc

SEQ ID NO: 4063 - RNA, 24 nt, Artificial Sequence
  Synthetic
uacagcuuggaggcuuuucacauc

SEQ ID NO: 4064 - RNA, 18 nt, Artificial Sequence
  Synthetic
gugucucccucuccacuc

SEQ ID NO: 4065 - RNA, 19 nt, Artificial Sequence
  Synthetic
ggugucucccucuccacuc

SEQ ID NO: 4066 - RNA, 20 nt, Artificial Sequence
  Synthetic
cggugucucccucuccacuc

SEQ ID NO: 4067 - RNA, 21 nt, Artificial Sequence
  Synthetic
ccggugucucccucuccacuc

SEQ ID NO: 4068 - RNA, 22 nt, Artificial Sequence
  Synthetic
accggugucucccucuccacuc

SEQ ID NO: 4069 - RNA, 23 nt, Artificial Sequence
  Synthetic
uaccggugucucccucuccacuc

SEQ ID NO: 4070 - RNA, 24 nt, Artificial Sequence
  Synthetic
auaccggugucucccucuccacuc

SEQ ID NO: 4071 - RNA, 18 nt, Artificial Sequence
  Synthetic
guccgugguagccagcuc

SEQ ID NO: 4072 - RNA, 19 nt, Artificial Sequence
  Synthetic
uguccgugguagccagcuc

SEQ ID NO: 4073 - RNA, 21 nt, Artificial Sequence
  Synthetic
acuguccgugguagccagcuc

SEQ ID NO: 4074 - RNA, 22 nt, Artificial Sequence
  Synthetic
aacuguccgugguagccagcuc

SEQ ID NO: 4075 - RNA, 23 nt, Artificial Sequence
  Synthetic
gaacuguccgugguagccagcuc

SEQ ID NO: 4076 - RNA, 24 nt, Artificial Sequence
  Synthetic
ggaacuguccgugguagccagcuc

SEQ ID NO: 4077 - RNA, 18 nt, Artificial Sequence
  Synthetic
cugcauucuuaccuucuc

SEQ ID NO: 4078 - RNA, 19 nt, Artificial Sequence
  Synthetic
ucugcauucuuaccuucuc

SEQ ID NO: 4079 - RNA, 21 nt, Artificial Sequence
  Synthetic
acucugcauucuuaccuucuc

SEQ ID NO: 4080 - RNA, 22 nt, Artificial Sequence
  Synthetic
cacucugcauucuuaccuucuc

SEQ ID NO: 4081 - RNA, 23 nt, Artificial Sequence
  Synthetic
ccacucugcauucuuaccuucuc

SEQ ID NO: 4082 - RNA, 24 nt, Artificial Sequence
  Synthetic
cccacucugcauucuuaccuucuc

SEQ ID NO: 4083 - RNA, 18 nt, Artificial Sequence
  Synthetic
ggcaaagagcuucuucuc

SEQ ID NO: 4084 - RNA, 19 nt, Artificial Sequence
  Synthetic
aggcaaagagcuucuucuc

SEQ ID NO: 4085 - RNA, 21 nt, Artificial Sequence
  Synthetic
ccaggcaaagagcuucuucuc

SEQ ID NO: 4086 - RNA, 22 nt, Artificial Sequence
  Synthetic
cccaggcaaagagcuucuucuc

SEQ ID NO: 4087 - RNA, 23 nt, Artificial Sequence
  Synthetic
ucccaggcaaagagcuucuucuc

SEQ ID NO: 4088 - RNA, 24 nt, Artificial Sequence
  Synthetic
gucccaggcaaagagcuucuucuc

SEQ ID NO: 4089 - RNA, 18 nt, Artificial Sequence
  Synthetic
cgagcagugucucggguc

SEQ ID NO: 4090 - RNA, 19 nt, Artificial Sequence
  Synthetic
ccgagcagugucucggguc

SEQ ID NO: 4091 - RNA, 21 nt, Artificial Sequence
  Synthetic
gcccgagcagugucucggguc

SEQ ID NO: 4092 - RNA, 22 nt, Artificial Sequence
  Synthetic
agcccgagcagugucucggguc

SEQ ID NO: 4093 - RNA, 23 nt, Artificial Sequence
  Synthetic
cagcccgagcagugucucggguc

SEQ ID NO: 4094 - RNA, 24 nt, Artificial Sequence
  Synthetic
acagcccgagcagugucucggguc

SEQ ID NO: 4095 - RNA, 18 nt, Artificial Sequence
  Synthetic
ggcucuccuucaaaauuc

SEQ ID NO: 4096 - RNA, 19 nt, Artificial Sequence
  Synthetic
gggcucuccuucaaaauuc

SEQ ID NO: 4097 - RNA, 21 nt, Artificial Sequence
  Synthetic
augggcucuccuucaaaauuc

SEQ ID NO: 4098 - RNA, 22 nt, Artificial Sequence
  Synthetic
gaugggcucuccuucaaaauuc

SEQ ID NO: 4099 - RNA, 23 nt, Artificial Sequence
  Synthetic
agaugggcucuccuucaaaauuc

SEQ ID NO: 4100 - RNA, 24 nt, Artificial Sequence
  Synthetic
cagaugggcucuccuucaaaauuc

SEQ ID NO: 4101 - RNA, 18 nt, Artificial Sequence
  Synthetic
uagcucggacuucaguuc

SEQ ID NO: 4102 - RNA, 19 nt, Artificial Sequence
  Synthetic
uuagcucggacuucaguuc

SEQ ID NO: 4103 - RNA, 20 nt, Artificial Sequence
  Synthetic
guuagcucggacuucaguuc

SEQ ID NO: 4104 - RNA, 21 nt, Artificial Sequence
  Synthetic
aguuagcucggacuucaguuc

SEQ ID NO: 4105 - RNA, 22 nt, Artificial Sequence
  Synthetic
caguuagcucggacuucaguuc

SEQ ID NO: 4106 - RNA, 23 nt, Artificial Sequence
  Synthetic
ucaguuagcucggacuucaguuc

SEQ ID NO: 4107 - RNA, 24 nt, Artificial Sequence
  Synthetic
uucaguuagcucggacuucaguuc

SEQ ID NO: 4108 - RNA, 18 nt, Artificial Sequence
  Synthetic
gcaagagcaaugguuuuc

SEQ ID NO: 4109 - RNA, 19 nt, Artificial Sequence
  Synthetic
ugcaagagcaaugguuuuc

SEQ ID NO: 4110 - RNA, 21 nt, Artificial Sequence
  Synthetic
caugcaagagcaaugguuuuc

SEQ ID NO: 4111 - RNA, 22 nt, Artificial Sequence
  Synthetic
acaugcaagagcaaugguuuuc

SEQ ID NO: 4112 - RNA, 23 nt, Artificial Sequence
  Synthetic
aacaugcaagagcaaugguuuuc

SEQ ID NO: 4113 - RNA, 24 nt, Artificial Sequence
  Synthetic
uaacaugcaagagcaaugguuuuc

SEQ ID NO: 4114 - RNA, 18 nt, Artificial Sequence
  Synthetic
ccuucaaaauucgggaag

SEQ ID NO: 4115 - RNA, 19 nt, Artificial Sequence
  Synthetic
uccuucaaaauucgggaag

SEQ ID NO: 4116 - RNA, 20 nt, Artificial Sequence
  Synthetic
cuccuucaaaauucgggaag

SEQ ID NO: 4117 - RNA, 21 nt, Artificial Sequence
  Synthetic
ucuccuucaaaauucgggaag

SEQ ID NO: 4118 - RNA, 22 nt, Artificial Sequence
  Synthetic
cucuccuucaaaauucgggaag

SEQ ID NO: 4119 - RNA, 23 nt, Artificial Sequence
  Synthetic
gcucuccuucaaaauucgggaag

SEQ ID NO: 4120 - RNA, 24 nt, Artificial Sequence
  Synthetic
ggcucuccuucaaaauucgggaag

SEQ ID NO: 4121 - RNA, 18 nt, Artificial Sequence
  Synthetic
cacuccugagauagccag

SEQ ID NO: 4122 - RNA, 19 nt, Artificial Sequence
  Synthetic
ccacuccugagauagccag

SEQ ID NO: 4123 - RNA, 20 nt, Artificial Sequence
  Synthetic
uccacuccugagauagccag

SEQ ID NO: 4124 - RNA, 21 nt, Artificial Sequence
  Synthetic
cuccacuccugagauagccag

SEQ ID NO: 4125 - RNA, 22 nt, Artificial Sequence
  Synthetic
ucuccacuccugagauagccag

SEQ ID NO: 4126 - RNA, 23 nt, Artificial Sequence
  Synthetic
cucuccacuccugagauagccag

SEQ ID NO: 4127 - RNA, 24 nt, Artificial Sequence
  Synthetic
ccucuccacuccugagauagccag

SEQ ID NO: 4128 - RNA, 18 nt, Artificial Sequence
  Synthetic
auauucgaugcuggccag

SEQ ID NO: 4129 - RNA, 19 nt, Artificial Sequence
  Synthetic
uauauucgaugcuggccag

SEQ ID NO: 4130 - RNA, 21 nt, Artificial Sequence
  Synthetic
cuuauauucgaugcuggccag

SEQ ID NO: 4131 - RNA, 22 nt, Artificial Sequence
  Synthetic
acuuauauucgaugcuggccag

SEQ ID NO: 4132 - RNA, 23 nt, Artificial Sequence
  Synthetic
uacuuauauucgaugcuggccag

SEQ ID NO: 4133 - RNA, 24 nt, Artificial Sequence
  Synthetic
uuacuuauauucgaugcuggccag

SEQ ID NO: 4134 - RNA, 18 nt, Artificial Sequence
  Synthetic
uccuggguguagggguag

SEQ ID NO: 4135 - RNA, 19 nt, Artificial Sequence
  Synthetic
cuccuggguguagggguag

SEQ ID NO: 4136 - RNA, 20 nt, Artificial Sequence
  Synthetic
ucuccuggguguagggguag

SEQ ID NO: 4137 - RNA, 21 nt, Artificial Sequence
  Synthetic
gucuccuggguguagggguag

SEQ ID NO: 4138 - RNA, 22 nt, Artificial Sequence
  Synthetic
ggucuccuggguguagggguag

SEQ ID NO: 4139 - RNA, 23 nt, Artificial Sequence
  Synthetic
uggucuccuggguguagggguag

SEQ ID NO: 4140 - RNA, 24 nt, Artificial Sequence
  Synthetic
guggucuccuggguguagggguag

SEQ ID NO: 4141 - RNA, 18 nt, Artificial Sequence
  Synthetic
aaguguccaaauuccacg

SEQ ID NO: 4142 - RNA, 19 nt, Artificial Sequence
  Synthetic
aaaguguccaaauuccacg

SEQ ID NO: 4143 - RNA, 20 nt, Artificial Sequence
  Synthetic
caaaguguccaaauuccacg

SEQ ID NO: 4144 - RNA, 21 nt, Artificial Sequence
  Synthetic
ccaaaguguccaaauuccacg

SEQ ID NO: 4145 - RNA, 22 nt, Artificial Sequence
  Synthetic
gccaaaguguccaaauuccacg

SEQ ID NO: 4146 - RNA, 23 nt, Artificial Sequence
  Synthetic
ggccaaaguguccaaauuccacg

SEQ ID NO: 4147 - RNA, 24 nt, Artificial Sequence
  Synthetic
aggccaaaguguccaaauuccacg

SEQ ID NO: 4148 - RNA, 18 nt, Artificial Sequence
  Synthetic
uucccacaaaguucaagg

SEQ ID NO: 4149 - RNA, 19 nt, Artificial Sequence
  Synthetic
auucccacaaaguucaagg

SEQ ID NO: 4150 - RNA, 20 nt, Artificial Sequence
  Synthetic
gauucccacaaaguucaagg

SEQ ID NO: 4151 - RNA, 18 nt, Artificial Sequence
  Synthetic
agagcaaugguuuucagg

SEQ ID NO: 4152 - RNA, 19 nt, Artificial Sequence
  Synthetic
aagagcaaugguuuucagg

SEQ ID NO: 4153 - RNA, 20 nt, Artificial Sequence
  Synthetic
caagagcaaugguuuucagg

SEQ ID NO: 4154 - RNA, 21 nt, Artificial Sequence
  Synthetic
gcaagagcaaugguuuucagg

SEQ ID NO: 4155 - RNA, 22 nt, Artificial Sequence
  Synthetic
ugcaagagcaaugguuuucagg

SEQ ID NO: 4156 - RNA, 23 nt, Artificial Sequence
  Synthetic
augcaagagcaaugguuuucagg

SEQ ID NO: 4157 - RNA, 24 nt, Artificial Sequence
  Synthetic
caugcaagagcaaugguuuucagg

SEQ ID NO: 4158 - RNA, 18 nt, Artificial Sequence
  Synthetic
uacaaggugccacagaug

SEQ ID NO: 4159 - RNA, 19 nt, Artificial Sequence
  Synthetic
guacaaggugccacagaug

SEQ ID NO: 4160 - RNA, 21 nt, Artificial Sequence
  Synthetic
guguacaaggugccacagaug

SEQ ID NO: 4161 - RNA, 22 nt, Artificial Sequence
  Synthetic
gguguacaaggugccacagaug

SEQ ID NO: 4162 - RNA, 23 nt, Artificial Sequence
  Synthetic
cgguguacaaggugccacagaug

SEQ ID NO: 4163 - RNA, 24 nt, Artificial Sequence
  Synthetic
acgguguacaaggugccacagaug

SEQ ID NO: 4164 - RNA, 18 nt, Artificial Sequence
  Synthetic
gucauacucaaaaaccug

SEQ ID NO: 4165 - RNA, 19 nt, Artificial Sequence
  Synthetic
ggucauacucaaaaaccug

SEQ ID NO: 4166 - RNA, 20 nt, Artificial Sequence
  Synthetic
aggucauacucaaaaaccug

SEQ ID NO: 4167 - RNA, 21 nt, Artificial Sequence
  Synthetic
gaggucauacucaaaaaccug

SEQ ID NO: 4168 - RNA, 22 nt, Artificial Sequence
  Synthetic
ugaggucauacucaaaaaccug

SEQ ID NO: 4169 - RNA, 23 nt, Artificial Sequence
  Synthetic
augaggucauacucaaaaaccug

SEQ ID NO: 4170 - RNA, 24 nt, Artificial Sequence
  Synthetic
gaugaggucauacucaaaaaccug

SEQ ID NO: 4171 - RNA, 18 nt, Artificial Sequence
  Synthetic
cccugcauaaacuggcug

SEQ ID NO: 4172 - RNA, 19 nt, Artificial Sequence
  Synthetic
gcccugcauaaacuggcug

SEQ ID NO: 4173 - RNA, 20 nt, Artificial Sequence
  Synthetic
agcccugcauaaacuggcug

SEQ ID NO: 4174 - RNA, 21 nt, Artificial Sequence
  Synthetic
uagcccugcauaaacuggcug

SEQ ID NO: 4175 - RNA, 22 nt, Artificial Sequence
  Synthetic
guagcccugcauaaacuggcug

SEQ ID NO: 4176 - RNA, 23 nt, Artificial Sequence
  Synthetic
gguagcccugcauaaacuggcug

SEQ ID NO: 4177 - RNA, 24 nt, Artificial Sequence
  Synthetic
ggguagcccugcauaaacuggcug

SEQ ID NO: 4178 - RNA, 18 nt, Artificial Sequence
  Synthetic
aguugacgguagcaucug

SEQ ID NO: 4179 - RNA, 19 nt, Artificial Sequence
  Synthetic
aaguugacgguagcaucug

SEQ ID NO: 4180 - RNA, 21 nt, Artificial Sequence
  Synthetic
caaaguugacgguagcaucug

SEQ ID NO: 4181 - RNA, 22 nt, Artificial Sequence
  Synthetic
gcaaaguugacgguagcaucug

SEQ ID NO: 4182 - RNA, 23 nt, Artificial Sequence
  Synthetic
agcaaaguugacgguagcaucug

SEQ ID NO: 4183 - RNA, 24 nt, Artificial Sequence
  Synthetic
aagcaaaguugacgguagcaucug

SEQ ID NO: 4184 - RNA, 18 nt, Artificial Sequence
  Synthetic
cacguggucuccugggug

SEQ ID NO: 4185 - RNA, 19 nt, Artificial Sequence
  Synthetic
ccacguggucuccugggug

SEQ ID NO: 4186 - RNA, 20 nt, Artificial Sequence
  Synthetic
uccacguggucuccugggug

SEQ ID NO: 4187 - RNA, 21 nt, Artificial Sequence
  Synthetic
cuccacguggucuccugggug

SEQ ID NO: 4188 - RNA, 22 nt, Artificial Sequence
  Synthetic
ucuccacguggucuccugggug

SEQ ID NO: 4189 - RNA, 23 nt, Artificial Sequence
  Synthetic
uucuccacguggucuccugggug

SEQ ID NO: 4190 - RNA, 24 nt, Artificial Sequence
  Synthetic
auucuccacguggucuccugggug

SEQ ID NO: 4191 - RNA, 18 nt, Artificial Sequence
  Synthetic
gaggcuuuucacaucuug

SEQ ID NO: 4192 - RNA, 19 nt, Artificial Sequence
  Synthetic
ggaggcuuuucacaucuug

SEQ ID NO: 4193 - RNA, 21 nt, Artificial Sequence
  Synthetic
uuggaggcuuuucacaucuug

SEQ ID NO: 4194 - RNA, 22 nt, Artificial Sequence
  Synthetic
cuuggaggcuuuucacaucuug

SEQ ID NO: 4195 - RNA, 23 nt, Artificial Sequence
  Synthetic
gcuuggaggcuuuucacaucuug

SEQ ID NO: 4196 - RNA, 24 nt, Artificial Sequence
  Synthetic
agcuuggaggcuuuucacaucuug

SEQ ID NO: 4197 - RNA, 18 nt, Artificial Sequence
  Synthetic
uucucuggguucaguuug

SEQ ID NO: 4198 - RNA, 19 nt, Artificial Sequence
  Synthetic
auucucuggguucaguuug

SEQ ID NO: 4199 - RNA, 20 nt, Artificial Sequence
  Synthetic
gauucucuggguucaguuug

SEQ ID NO: 4200 - RNA, 21 nt, Artificial Sequence
  Synthetic
agauucucuggguucaguuug

SEQ ID NO: 4201 - RNA, 22 nt, Artificial Sequence
  Synthetic
cagauucucuggguucaguuug

SEQ ID NO: 4202 - RNA, 23 nt, Artificial Sequence
  Synthetic
ccagauucucuggguucaguuug

SEQ ID NO: 4203 - RNA, 24 nt, Artificial Sequence
  Synthetic
uccagauucucuggguucaguuug

SEQ ID NO: 4204 - RNA, 18 nt, Artificial Sequence
  Synthetic
ugggcucuccuucaaaau

SEQ ID NO: 4205 - RNA, 19 nt, Artificial Sequence
  Synthetic
augggcucuccuucaaaau

SEQ ID NO: 4206 - RNA, 20 nt, Artificial Sequence
  Synthetic
gaugggcucuccuucaaaau

SEQ ID NO: 4207 - RNA, 21 nt, Artificial Sequence
  Synthetic
agaugggcucuccuucaaaau

SEQ ID NO: 4208 - RNA, 22 nt, Artificial Sequence
  Synthetic
cagaugggcucuccuucaaaau

SEQ ID NO: 4209 - RNA, 23 nt, Artificial Sequence
  Synthetic
ccagaugggcucuccuucaaaau

SEQ ID NO: 4210 - RNA, 24 nt, Artificial Sequence
  Synthetic
gccagaugggcucuccuucaaaau

SEQ ID NO: 4211 - RNA, 18 nt, Artificial Sequence
  Synthetic
uguagccaccccaagaau

SEQ ID NO: 4212 - RNA, 19 nt, Artificial Sequence
  Synthetic
guguagccaccccaagaau

SEQ ID NO: 4213 - RNA, 21 nt, Artificial Sequence
  Synthetic
ccguguagccaccccaagaau

SEQ ID NO: 4214 - RNA, 22 nt, Artificial Sequence
  Synthetic
uccguguagccaccccaagaau

SEQ ID NO: 4215 - RNA, 23 nt, Artificial Sequence
  Synthetic
guccguguagccaccccaagaau

SEQ ID NO: 4216 - RNA, 24 nt, Artificial Sequence
  Synthetic
uguccguguagccaccccaagaau

SEQ ID NO: 4217 - RNA, 18 nt, Artificial Sequence
  Synthetic
guauucuaucugaagcau

SEQ ID NO: 4218 - RNA, 19 nt, Artificial Sequence
  Synthetic
uguauucuaucugaagcau

SEQ ID NO: 4219 - RNA, 20 nt, Artificial Sequence
  Synthetic
cuguauucuaucugaagcau

SEQ ID NO: 4220 - RNA, 21 nt, Artificial Sequence
  Synthetic
acuguauucuaucugaagcau

SEQ ID NO: 4221 - RNA, 22 nt, Artificial Sequence
  Synthetic
aacuguauucuaucugaagcau

SEQ ID NO: 4222 - RNA, 23 nt, Artificial Sequence
  Synthetic
caacuguauucuaucugaagcau

SEQ ID NO: 4223 - RNA, 24 nt, Artificial Sequence
  Synthetic
ccaacuguauucuaucugaagcau

SEQ ID NO: 4224 - RNA, 18 nt, Artificial Sequence
  Synthetic
gacccaacuguauucuau

SEQ ID NO: 4225 - RNA, 19 nt, Artificial Sequence
  Synthetic
agacccaacuguauucuau

SEQ ID NO: 4226 - RNA, 20 nt, Artificial Sequence
  Synthetic
gagacccaacuguauucuau

SEQ ID NO: 4227 - RNA, 21 nt, Artificial Sequence
  Synthetic
ugagacccaacuguauucuau

SEQ ID NO: 4228 - RNA, 22 nt, Artificial Sequence
  Synthetic
gugagacccaacuguauucuau

SEQ ID NO: 4229 - RNA, 23 nt, Artificial Sequence
  Synthetic
ugugagacccaacuguauucuau

SEQ ID NO: 4230 - RNA, 24 nt, Artificial Sequence
  Synthetic
augugagacccaacuguauucuau

SEQ ID NO: 4231 - RNA, 18 nt, Artificial Sequence
  Synthetic
caguggccuaggcaguau

SEQ ID NO: 4232 - RNA, 19 nt, Artificial Sequence
  Synthetic
ccaguggccuaggcaguau

SEQ ID NO: 4233 - RNA, 20 nt, Artificial Sequence
  Synthetic
uccaguggccuaggcaguau

SEQ ID NO: 4234 - RNA, 21 nt, Artificial Sequence
  Synthetic
uuccaguggccuaggcaguau

SEQ ID NO: 4235 - RNA, 22 nt, Artificial Sequence
  Synthetic
uuuccaguggccuaggcaguau

SEQ ID NO: 4236 - RNA, 23 nt, Artificial Sequence
  Synthetic
cuuuccaguggccuaggcaguau

SEQ ID NO: 4237 - RNA, 24 nt, Artificial Sequence
  Synthetic
gcuuuccaguggccuaggcaguau

SEQ ID NO: 4238 - RNA, 18 nt, Artificial Sequence
  Synthetic
auaaaggauauuuauuau

SEQ ID NO: 4239 - RNA, 19 nt, Artificial Sequence
  Synthetic
gauaaaggauauuuauuau

SEQ ID NO: 4240 - RNA, 20 nt, Artificial Sequence
  Synthetic
agauaaaggauauuuauuau

SEQ ID NO: 4241 - RNA, 21 nt, Artificial Sequence
  Synthetic
aagauaaaggauauuuauuau

SEQ ID NO: 4242 - RNA, 22 nt, Artificial Sequence
  Synthetic
gaagauaaaggauauuuauuau

SEQ ID NO: 4243 - RNA, 23 nt, Artificial Sequence
  Synthetic
agaagauaaaggauauuuauuau

SEQ ID NO: 4244 - RNA, 24 nt, Artificial Sequence
  Synthetic
cagaagauaaaggauauuuauuau

SEQ ID NO: 4245 - RNA, 18 nt, Artificial Sequence
  Synthetic
cacaauguaaaggguuau

SEQ ID NO: 4246 - RNA, 19 nt, Artificial Sequence
  Synthetic
ucacaauguaaaggguuau

SEQ ID NO: 4247 - RNA, 20 nt, Artificial Sequence
  Synthetic
uucacaauguaaaggguuau

SEQ ID NO: 4248 - RNA, 21 nt, Artificial Sequence
  Synthetic
uuucacaauguaaaggguuau

SEQ ID NO: 4249 - RNA, 22 nt, Artificial Sequence
  Synthetic
auuucacaauguaaaggguuau

SEQ ID NO: 4250 - RNA, 23 nt, Artificial Sequence
  Synthetic
uauuucacaauguaaaggguuau

SEQ ID NO: 4251 - RNA, 24 nt, Artificial Sequence
  Synthetic
uuauuucacaauguaaaggguuau

SEQ ID NO: 4252 - RNA, 18 nt, Artificial Sequence
  Synthetic
ucuggauuaaugaaaacu

SEQ ID NO: 4253 - RNA, 19 nt, Artificial Sequence
  Synthetic
uucuggauuaaugaaaacu

SEQ ID NO: 4254 - RNA, 21 nt, Artificial Sequence
  Synthetic
ccuucuggauuaaugaaaacu

SEQ ID NO: 4255 - RNA, 22 nt, Artificial Sequence
  Synthetic
uccuucuggauuaaugaaaacu

SEQ ID NO: 4256 - RNA, 23 nt, Artificial Sequence
  Synthetic
auccuucuggauuaaugaaaacu

SEQ ID NO: 4257 - RNA, 24 nt, Artificial Sequence
  Synthetic
cauccuucuggauuaaugaaaacu

SEQ ID NO: 4258 - RNA, 18 nt, Artificial Sequence
  Synthetic
uaggcaguaugugaaccu

SEQ ID NO: 4259 - RNA, 19 nt, Artificial Sequence
  Synthetic
cuaggcaguaugugaaccu

SEQ ID NO: 4260 - RNA, 20 nt, Artificial Sequence
  Synthetic
ccuaggcaguaugugaaccu

SEQ ID NO: 4261 - RNA, 21 nt, Artificial Sequence
  Synthetic
gccuaggcaguaugugaaccu

SEQ ID NO: 4262 - RNA, 22 nt, Artificial Sequence
  Synthetic
ggccuaggcaguaugugaaccu

SEQ ID NO: 4263 - RNA, 23 nt, Artificial Sequence
  Synthetic
uggccuaggcaguaugugaaccu

SEQ ID NO: 4264 - RNA, 24 nt, Artificial Sequence
  Synthetic
guggccuaggcaguaugugaaccu

SEQ ID NO: 4265 - RNA, 18 nt, Artificial Sequence
  Synthetic
gccauugccuguacagcu

SEQ ID NO: 4266 - RNA, 19 nt, Artificial Sequence
  Synthetic
ugccauugccuguacagcu

SEQ ID NO: 4267 - RNA, 21 nt, Artificial Sequence
  Synthetic
ucugccauugccuguacagcu

SEQ ID NO: 4268 - RNA, 22 nt, Artificial Sequence
  Synthetic
uucugccauugccuguacagcu

SEQ ID NO: 4269 - RNA, 23 nt, Artificial Sequence
  Synthetic
cuucugccauugccuguacagcu

SEQ ID NO: 4270 - RNA, 24 nt, Artificial Sequence
  Synthetic
ccuucugccauugccuguacagcu

SEQ ID NO: 4271 - RNA, 18 nt, Artificial Sequence
  Synthetic
uggaggcuuuucacaucu

SEQ ID NO: 4272 - RNA, 19 nt, Artificial Sequence
  Synthetic
uuggaggcuuuucacaucu

SEQ ID NO: 4273 - RNA, 21 nt, Artificial Sequence
  Synthetic
gcuuggaggcuuuucacaucu

SEQ ID NO: 4274 - RNA, 22 nt, Artificial Sequence
  Synthetic
agcuuggaggcuuuucacaucu

SEQ ID NO: 4275 - RNA, 23 nt, Artificial Sequence
  Synthetic
cagcuuggaggcuuuucacaucu

SEQ ID NO: 4276 - RNA, 24 nt, Artificial Sequence
  Synthetic
acagcuuggaggcuuuucacaucu

SEQ ID NO: 4277 - RNA, 18 nt, Artificial Sequence
  Synthetic
gagcagugucucgggucu

SEQ ID NO: 4278 - RNA, 19 nt, Artificial Sequence
  Synthetic
cgagcagugucucgggucu

SEQ ID NO: 4279 - RNA, 21 nt, Artificial Sequence
  Synthetic
cccgagcagugucucgggucu

SEQ ID NO: 4280 - RNA, 22 nt, Artificial Sequence
  Synthetic
gcccgagcagugucucgggucu

SEQ ID NO: 4281 - RNA, 23 nt, Artificial Sequence
  Synthetic
agcccgagcagugucucgggucu

SEQ ID NO: 4282 - RNA, 24 nt, Artificial Sequence
  Synthetic
cagcccgagcagugucucgggucu

SEQ ID NO: 4283 - RNA, 18 nt, Artificial Sequence
  Synthetic
ucugcauucuuaccuucu

SEQ ID NO: 4284 - RNA, 19 nt, Artificial Sequence
  Synthetic
cucugcauucuuaccuucu

SEQ ID NO: 4285 - RNA, 20 nt, Artificial Sequence
  Synthetic
acucugcauucuuaccuucu

SEQ ID NO: 4286 - RNA, 21 nt, Artificial Sequence
  Synthetic
cacucugcauucuuaccuucu

SEQ ID NO: 4287 - RNA, 22 nt, Artificial Sequence
  Synthetic
ccacucugcauucuuaccuucu

SEQ ID NO: 4288 - RNA, 23 nt, Artificial Sequence
  Synthetic
cccacucugcauucuuaccuucu

SEQ ID NO: 4289 - RNA, 24 nt, Artificial Sequence
  Synthetic
ccccacucugcauucuuaccuucu

SEQ ID NO: 4290 - RNA, 18 nt, Artificial Sequence
  Synthetic
agauucucuggguucagu

SEQ ID NO: 4291 - RNA, 19 nt, Artificial Sequence
  Synthetic
cagauucucuggguucagu

SEQ ID NO: 4292 - RNA, 20 nt, Artificial Sequence
  Synthetic
ccagauucucuggguucagu

SEQ ID NO: 4293 - RNA, 21 nt, Artificial Sequence
  Synthetic
uccagauucucuggguucagu

SEQ ID NO: 4294 - RNA, 22 nt, Artificial Sequence
  Synthetic
uuccagauucucuggguucagu

SEQ ID NO: 4295 - RNA, 23 nt, Artificial Sequence
  Synthetic
guuccagauucucuggguucagu

SEQ ID NO: 4296 - RNA, 24 nt, Artificial Sequence
  Synthetic
aguuccagauucucuggguucagu

SEQ ID NO: 4297 - RNA, 18 nt, Artificial Sequence
  Synthetic
uucugcuguucucagcgu

SEQ ID NO: 4298 - RNA, 19 nt, Artificial Sequence
  Synthetic
uuucugcuguucucagcgu

SEQ ID NO: 4299 - RNA, 20 nt, Artificial Sequence
  Synthetic
guuucugcuguucucagcgu

SEQ ID NO: 4300 - RNA, 21 nt, Artificial Sequence
  Synthetic
uguuucugcuguucucagcgu

SEQ ID NO: 4301 - RNA, 22 nt, Artificial Sequence
  Synthetic
uuguuucugcuguucucagcgu

SEQ ID NO: 4302 - RNA, 23 nt, Artificial Sequence
  Synthetic
auuguuucugcuguucucagcgu

SEQ ID NO: 4303 - RNA, 24 nt, Artificial Sequence
  Synthetic
aauuguuucugcuguucucagcgu

SEQ ID NO: 4304 - RNA, 18 nt, Artificial Sequence
  Synthetic
ccgagcagugucucgggu

SEQ ID NO: 4305 - RNA, 19 nt, Artificial Sequence
  Synthetic
cccgagcagugucucgggu

SEQ ID NO: 4306 - RNA, 21 nt, Artificial Sequence
  Synthetic
agcccgagcagugucucgggu

SEQ ID NO: 4307 - RNA, 22 nt, Artificial Sequence
  Synthetic
cagcccgagcagugucucgggu

SEQ ID NO: 4308 - RNA, 23 nt, Artificial Sequence
  Synthetic
acagcccgagcagugucucgggu

SEQ ID NO: 4309 - RNA, 24 nt, Artificial Sequence
  Synthetic
cacagcccgagcagugucucgggu

SEQ ID NO: 4310 - RNA, 18 nt, Artificial Sequence
  Synthetic
aggaagagaacguugggu

SEQ ID NO: 4311 - RNA, 19 nt, Artificial Sequence
  Synthetic
aaggaagagaacguugggu

SEQ ID NO: 4312 - RNA, 20 nt, Artificial Sequence
  Synthetic
caaggaagagaacguugggu

SEQ ID NO: 4313 - RNA, 21 nt, Artificial Sequence
  Synthetic
ucaaggaagagaacguugggu

SEQ ID NO: 4314 - RNA, 22 nt, Artificial Sequence
  Synthetic
uucaaggaagagaacguugggu

SEQ ID NO: 4315 - RNA, 23 nt, Artificial Sequence
  Synthetic
guucaaggaagagaacguugggu

SEQ ID NO: 4316 - RNA, 24 nt, Artificial Sequence
  Synthetic
aguucaaggaagagaacguugggu

SEQ ID NO: 4317 - RNA, 18 nt, Artificial Sequence
  Synthetic
gggcucuccuucaaaauu

SEQ ID NO: 4318 - RNA, 19 nt, Artificial Sequence
  Synthetic
ugggcucuccuucaaaauu

SEQ ID NO: 4319 - RNA, 21 nt, Artificial Sequence
  Synthetic
gaugggcucuccuucaaaauu

SEQ ID NO: 4320 - RNA, 22 nt, Artificial Sequence
  Synthetic
agaugggcucuccuucaaaauu

SEQ ID NO: 4321 - RNA, 23 nt, Artificial Sequence
  Synthetic
cagaugggcucuccuucaaaauu

SEQ ID NO: 4322 - RNA, 24 nt, Artificial Sequence
  Synthetic
ccagaugggcucuccuucaaaauu

SEQ ID NO: 4323 - RNA, 18 nt, Artificial Sequence
  Synthetic
uccacauccugguaaauu

SEQ ID NO: 4324 - RNA, 19 nt, Artificial Sequence
  Synthetic
cuccacauccugguaaauu

SEQ ID NO: 4325 - RNA, 20 nt, Artificial Sequence
  Synthetic
ucuccacauccugguaaauu

SEQ ID NO: 4326 - RNA, 21 nt, Artificial Sequence
  Synthetic
uucuccacauccugguaaauu

SEQ ID NO: 4327 - RNA, 22 nt, Artificial Sequence
  Synthetic
guucuccacauccugguaaauu

SEQ ID NO: 4328 - RNA, 23 nt, Artificial Sequence
  Synthetic
aguucuccacauccugguaaauu

SEQ ID NO: 4329 - RNA, 24 nt, Artificial Sequence
  Synthetic
uaguucuccacauccugguaaauu

SEQ ID NO: 4330 - RNA, 18 nt, Artificial Sequence
  Synthetic
gagcuauucugcuuccuu

SEQ ID NO: 4331 - RNA, 19 nt, Artificial Sequence
  Synthetic
ggagcuauucugcuuccuu

SEQ ID NO: 4332 - RNA, 20 nt, Artificial Sequence
  Synthetic
aggagcuauucugcuuccuu

SEQ ID NO: 4333 - RNA, 21 nt, Artificial Sequence
  Synthetic
gaggagcuauucugcuuccuu

SEQ ID NO: 4334 - RNA, 22 nt, Artificial Sequence
  Synthetic
agaggagcuauucugcuuccuu

SEQ ID NO: 4335 - RNA, 23 nt, Artificial Sequence
  Synthetic
cagaggagcuauucugcuuccuu

SEQ ID NO: 4336 - RNA, 24 nt, Artificial Sequence
  Synthetic
ccagaggagcuauucugcuuccuu

SEQ ID NO: 4337 - RNA, 18 nt, Artificial Sequence
  Synthetic
ucauaucuuaugacaguu

SEQ ID NO: 4338 - RNA, 19 nt, Artificial Sequence
  Synthetic
cucauaucuuaugacaguu

SEQ ID NO: 4339 - RNA, 21 nt, Artificial Sequence
  Synthetic
agcucauaucuuaugacaguu

SEQ ID NO: 4340 - RNA, 22 nt, Artificial Sequence
  Synthetic
cagcucauaucuuaugacaguu

SEQ ID NO: 4341 - RNA, 23 nt, Artificial Sequence
  Synthetic
ucagcucauaucuuaugacaguu

SEQ ID NO: 4342 - RNA, 24 nt, Artificial Sequence
  Synthetic
uucagcucauaucuuaugacaguu

SEQ ID NO: 4343 - RNA, 18 nt, Artificial Sequence
  Synthetic
gauucucuggguucaguu

SEQ ID NO: 4344 - RNA, 19 nt, Artificial Sequence
  Synthetic
agauucucuggguucaguu

SEQ ID NO: 4345 - RNA, 21 nt, Artificial Sequence
  Synthetic
ccagauucucuggguucaguu

SEQ ID NO: 4346 - RNA, 22 nt, Artificial Sequence
  Synthetic
uccagauucucuggguucaguu

SEQ ID NO: 4347 - RNA, 23 nt, Artificial Sequence
  Synthetic
uuccagauucucuggguucaguu

SEQ ID NO: 4348 - RNA, 24 nt, Artificial Sequence
  Synthetic
guuccagauucucuggguucaguu

SEQ ID NO: 4349 - RNA, 18 nt, Artificial Sequence
  Synthetic
ugcaagagcaaugguuuu

SEQ ID NO: 4350 - RNA, 19 nt, Artificial Sequence
  Synthetic
augcaagagcaaugguuuu

SEQ ID NO: 4351 - RNA, 20 nt, Artificial Sequence
  Synthetic
caugcaagagcaaugguuuu

SEQ ID NO: 4352 - RNA, 21 nt, Artificial Sequence
  Synthetic
acaugcaagagcaaugguuuu

SEQ ID NO: 4353 - RNA, 22 nt, Artificial Sequence
  Synthetic
aacaugcaagagcaaugguuuu

SEQ ID NO: 4354 - RNA, 23 nt, Artificial Sequence
  Synthetic
uaacaugcaagagcaaugguuuu

SEQ ID NO: 4355 - RNA, 24 nt, Artificial Sequence
  Synthetic
guaacaugcaagagcaaugguuuu

SEQ ID NO: 4356 - RNA, 18 nt, Artificial Sequence
  Synthetic
gccauuguccucuccaaa

SEQ ID NO: 4357 - RNA, 19 nt, Artificial Sequence
  Synthetic
ugccauuguccucuccaaa

SEQ ID NO: 4358 - RNA, 20 nt, Artificial Sequence
  Synthetic
gugccauuguccucuccaaa

SEQ ID NO: 4359 - RNA, 21 nt, Artificial Sequence
  Synthetic
ggugccauuguccucuccaaa

SEQ ID NO: 4360 - RNA, 22 nt, Artificial Sequence
  Synthetic
aggugccauuguccucuccaaa

SEQ ID NO: 4361 - RNA, 23 nt, Artificial Sequence
  Synthetic
aaggugccauuguccucuccaaa

SEQ ID NO: 4362 - RNA, 24 nt, Artificial Sequence
  Synthetic
aaaggugccauuguccucuccaaa

SEQ ID NO: 4363 - RNA, 18 nt, Artificial Sequence
  Synthetic
acuuuggccuuccaggaa

SEQ ID NO: 4364 - RNA, 19 nt, Artificial Sequence
  Synthetic
cacuuuggccuuccaggaa

SEQ ID NO: 4365 - RNA, 20 nt, Artificial Sequence
  Synthetic
acacuuuggccuuccaggaa

SEQ ID NO: 4366 - RNA, 21 nt, Artificial Sequence
  Synthetic
gacacuuuggccuuccaggaa

SEQ ID NO: 4367 - RNA, 22 nt, Artificial Sequence
  Synthetic
ggacacuuuggccuuccaggaa

SEQ ID NO: 4368 - RNA, 23 nt, Artificial Sequence
  Synthetic
uggacacuuuggccuuccaggaa

SEQ ID NO: 4369 - RNA, 24 nt, Artificial Sequence
  Synthetic
uuggacacuuuggccuuccaggaa

SEQ ID NO: 4370 - RNA, 18 nt, Artificial Sequence
  Synthetic
uggggggagcaggcugaa

SEQ ID NO: 4371 - RNA, 19 nt, Artificial Sequence
  Synthetic
cuggggggagcaggcugaa

SEQ ID NO: 4372 - RNA, 21 nt, Artificial Sequence
  Synthetic
uccuggggggagcaggcugaa

SEQ ID NO: 4373 - RNA, 22 nt, Artificial Sequence
  Synthetic
cuccuggggggagcaggcugaa

SEQ ID NO: 4374 - RNA, 23 nt, Artificial Sequence
  Synthetic
gcuccuggggggagcaggcugaa

SEQ ID NO: 4375 - RNA, 24 nt, Artificial Sequence
  Synthetic
ggcuccuggggggagcaggcugaa

SEQ ID NO: 4376 - RNA, 18 nt, Artificial Sequence
  Synthetic
aacugaaguccgagcuaa

SEQ ID NO: 4377 - RNA, 19 nt, Artificial Sequence
  Synthetic
gaacugaaguccgagcuaa

SEQ ID NO: 4378 - RNA, 20 nt, Artificial Sequence
  Synthetic
ggaacugaaguccgagcuaa

SEQ ID NO: 4379 - RNA, 21 nt, Artificial Sequence
  Synthetic
aggaacugaaguccgagcuaa

SEQ ID NO: 4380 - RNA, 22 nt, Artificial Sequence
  Synthetic
caggaacugaaguccgagcuaa

SEQ ID NO: 4381 - RNA, 23 nt, Artificial Sequence
  Synthetic
ccaggaacugaaguccgagcuaa

SEQ ID NO: 4382 - RNA, 24 nt, Artificial Sequence
  Synthetic
uccaggaacugaaguccgagcuaa

SEQ ID NO: 4383 - RNA, 18 nt, Artificial Sequence
  Synthetic
aaaaagcauaacuucuaa

SEQ ID NO: 4384 - RNA, 19 nt, Artificial Sequence
  Synthetic
uaaaaagcauaacuucuaa

SEQ ID NO: 4385 - RNA, 21 nt, Artificial Sequence
  Synthetic
aauaaaaagcauaacuucuaa

SEQ ID NO: 4386 - RNA, 22 nt, Artificial Sequence
  Synthetic
caauaaaaagcauaacuucuaa

SEQ ID NO: 4387 - RNA, 23 nt, Artificial Sequence
  Synthetic
acaauaaaaagcauaacuucuaa

SEQ ID NO: 4388 - RNA, 24 nt, Artificial Sequence
  Synthetic
cacaauaaaaagcauaacuucuaa

SEQ ID NO: 4389 - RNA, 18 nt, Artificial Sequence
  Synthetic
gagcugaauaccgagaca

SEQ ID NO: 4390 - RNA, 19 nt, Artificial Sequence
  Synthetic
ugagcugaauaccgagaca

SEQ ID NO: 4391 - RNA, 21 nt, Artificial Sequence
  Synthetic
uaugagcugaauaccgagaca

SEQ ID NO: 4392 - RNA, 22 nt, Artificial Sequence
  Synthetic
auaugagcugaauaccgagaca

SEQ ID NO: 4393 - RNA, 23 nt, Artificial Sequence
  Synthetic
gauaugagcugaauaccgagaca

SEQ ID NO: 4394 - RNA, 24 nt, Artificial Sequence
  Synthetic
agauaugagcugaauaccgagaca

SEQ ID NO: 4395 - RNA, 18 nt, Artificial Sequence
  Synthetic
cacauacugccuaggcca

SEQ ID NO: 4396 - RNA, 19 nt, Artificial Sequence
  Synthetic
ucacauacugccuaggcca

SEQ ID NO: 4397 - RNA, 20 nt, Artificial Sequence
  Synthetic
uucacauacugccuaggcca

SEQ ID NO: 4398 - RNA, 21 nt, Artificial Sequence
  Synthetic
guucacauacugccuaggcca

SEQ ID NO: 4399 - RNA, 22 nt, Artificial Sequence
  Synthetic
gguucacauacugccuaggcca

SEQ ID NO: 4400 - RNA, 23 nt, Artificial Sequence
  Synthetic
agguucacauacugccuaggcca

SEQ ID NO: 4401 - RNA, 24 nt, Artificial Sequence
  Synthetic
aagguucacauacugccuaggcca

SEQ ID NO: 4402 - RNA, 18 nt, Artificial Sequence
  Synthetic
cugugccaccaggcucca

SEQ ID NO: 4403 - RNA, 19 nt, Artificial Sequence
  Synthetic
gcugugccaccaggcucca

SEQ ID NO: 4404 - RNA, 21 nt, Artificial Sequence
  Synthetic
gggcugugccaccaggcucca

SEQ ID NO: 4405 - RNA, 22 nt, Artificial Sequence
  Synthetic
cgggcugugccaccaggcucca

SEQ ID NO: 4406 - RNA, 23 nt, Artificial Sequence
  Synthetic
ucgggcugugccaccaggcucca

SEQ ID NO: 4407 - RNA, 24 nt, Artificial Sequence
  Synthetic
cucgggcugugccaccaggcucca

SEQ ID NO: 4408 - RNA, 18 nt, Artificial Sequence
  Synthetic
uguacaggcaauggcaga

SEQ ID NO: 4409 - RNA, 19 nt, Artificial Sequence
  Synthetic
cuguacaggcaauggcaga

SEQ ID NO: 4410 - RNA, 21 nt, Artificial Sequence
  Synthetic
agcuguacaggcaauggcaga

SEQ ID NO: 4411 - RNA, 22 nt, Artificial Sequence
  Synthetic
aagcuguacaggcaauggcaga

SEQ ID NO: 4412 - RNA, 23 nt, Artificial Sequence
  Synthetic
caagcuguacaggcaauggcaga

SEQ ID NO: 4413 - RNA, 24 nt, Artificial Sequence
  Synthetic
ccaagcuguacaggcaauggcaga

SEQ ID NO: 4414 - RNA, 18 nt, Artificial Sequence
  Synthetic
agaagguaagaaugcaga

SEQ ID NO: 4415 - RNA, 19 nt, Artificial Sequence
  Synthetic
gagaagguaagaaugcaga

SEQ ID NO: 4416 - RNA, 20 nt, Artificial Sequence
  Synthetic
agagaagguaagaaugcaga

SEQ ID NO: 4417 - RNA, 21 nt, Artificial Sequence
  Synthetic
cagagaagguaagaaugcaga

SEQ ID NO: 4418 - RNA, 22 nt, Artificial Sequence
  Synthetic
ccagagaagguaagaaugcaga

SEQ ID NO: 4419 - RNA, 23 nt, Artificial Sequence
  Synthetic
uccagagaagguaagaaugcaga

SEQ ID NO: 4420 - RNA, 24 nt, Artificial Sequence
  Synthetic
cuccagagaagguaagaaugcaga

SEQ ID NO: 4421 - RNA, 18 nt, Artificial Sequence
  Synthetic
cuaucucaggaguggaga

SEQ ID NO: 4422 - RNA, 19 nt, Artificial Sequence
  Synthetic
gcuaucucaggaguggaga

SEQ ID NO: 4423 - RNA, 21 nt, Artificial Sequence
  Synthetic
uggcuaucucaggaguggaga

SEQ ID NO: 4424 - RNA, 22 nt, Artificial Sequence
  Synthetic
cuggcuaucucaggaguggaga

SEQ ID NO: 4425 - RNA, 23 nt, Artificial Sequence
  Synthetic
ucuggcuaucucaggaguggaga

SEQ ID NO: 4426 - RNA, 24 nt, Artificial Sequence
  Synthetic
aucuggcuaucucaggaguggaga

SEQ ID NO: 4427 - RNA, 18 nt, Artificial Sequence
  Synthetic
gagguagcaaggcugaga

SEQ ID NO: 4428 - RNA, 19 nt, Artificial Sequence
  Synthetic
ggagguagcaaggcugaga

SEQ ID NO: 4429 - RNA, 21 nt, Artificial Sequence
  Synthetic
caggagguagcaaggcugaga

SEQ ID NO: 4430 - RNA, 22 nt, Artificial Sequence
  Synthetic
ccaggagguagcaaggcugaga

SEQ ID NO: 4431 - RNA, 23 nt, Artificial Sequence
  Synthetic
gccaggagguagcaaggcugaga

SEQ ID NO: 4432 - RNA, 24 nt, Artificial Sequence
  Synthetic
agccaggagguagcaaggcugaga

SEQ ID NO: 4433 - RNA, 18 nt, Artificial Sequence
  Synthetic
agacagugaaggcugaga

SEQ ID NO: 4434 - RNA, 19 nt, Artificial Sequence
  Synthetic
gagacagugaaggcugaga

SEQ ID NO: 4435 - RNA, 21 nt, Artificial Sequence
  Synthetic
ccgagacagugaaggcugaga

SEQ ID NO: 4436 - RNA, 22 nt, Artificial Sequence
  Synthetic
accgagacagugaaggcugaga

SEQ ID NO: 4437 - RNA, 23 nt, Artificial Sequence
  Synthetic
uaccgagacagugaaggcugaga

SEQ ID NO: 4438 - RNA, 24 nt, Artificial Sequence
  Synthetic
auaccgagacagugaaggcugaga

SEQ ID NO: 4439 - RNA, 18 nt, Artificial Sequence
  Synthetic
caucuggcuaucucagga

SEQ ID NO: 4440 - RNA, 19 nt, Artificial Sequence
  Synthetic
ccaucuggcuaucucagga

SEQ ID NO: 4441 - RNA, 20 nt, Artificial Sequence
  Synthetic
cccaucuggcuaucucagga

SEQ ID NO: 4442 - RNA, 21 nt, Artificial Sequence
  Synthetic
gcccaucuggcuaucucagga

SEQ ID NO: 4443 - RNA, 22 nt, Artificial Sequence
  Synthetic
agcccaucuggcuaucucagga

SEQ ID NO: 4444 - RNA, 23 nt, Artificial Sequence
  Synthetic
gagcccaucuggcuaucucagga

SEQ ID NO: 4445 - RNA, 24 nt, Artificial Sequence
  Synthetic
agagcccaucuggcuaucucagga

SEQ ID NO: 4446 - RNA, 18 nt, Artificial Sequence
  Synthetic
ggcuaucucaggagugga

SEQ ID NO: 4447 - RNA, 19 nt, Artificial Sequence
  Synthetic
uggcuaucucaggagugga

SEQ ID NO: 4448 - RNA, 20 nt, Artificial Sequence
  Synthetic
cuggcuaucucaggagugga

SEQ ID NO: 4449 - RNA, 21 nt, Artificial Sequence
  Synthetic
ucuggcuaucucaggagugga

SEQ ID NO: 4450 - RNA, 22 nt, Artificial Sequence
  Synthetic
aucuggcuaucucaggagugga

SEQ ID NO: 4451 - RNA, 23 nt, Artificial Sequence
  Synthetic
caucuggcuaucucaggagugga

SEQ ID NO: 4452 - RNA, 24 nt, Artificial Sequence
  Synthetic
ccaucuggcuaucucaggagugga

SEQ ID NO: 4453 - RNA, 18 nt, Artificial Sequence
  Synthetic
cuggggggagcaggcuga

SEQ ID NO: 4454 - RNA, 19 nt, Artificial Sequence
  Synthetic
ccuggggggagcaggcuga

SEQ ID NO: 4455 - RNA, 21 nt, Artificial Sequence
  Synthetic
cuccuggggggagcaggcuga

SEQ ID NO: 4456 - RNA, 22 nt, Artificial Sequence
  Synthetic
gcuccuggggggagcaggcuga

SEQ ID NO: 4457 - RNA, 23 nt, Artificial Sequence
  Synthetic
ggcuccuggggggagcaggcuga

SEQ ID NO: 4458 - RNA, 24 nt, Artificial Sequence
  Synthetic
gggcuccuggggggagcaggcuga

SEQ ID NO: 4459 - RNA, 18 nt, Artificial Sequence
  Synthetic
cugcuucccgaauuuuga

SEQ ID NO: 4460 - RNA, 19 nt, Artificial Sequence
  Synthetic
ccugcuucccgaauuuuga

SEQ ID NO: 4461 - RNA, 21 nt, Artificial Sequence
  Synthetic
uuccugcuucccgaauuuuga

SEQ ID NO: 4462 - RNA, 22 nt, Artificial Sequence
  Synthetic
guuccugcuucccgaauuuuga

SEQ ID NO: 4463 - RNA, 23 nt, Artificial Sequence
  Synthetic
aguuccugcuucccgaauuuuga

SEQ ID NO: 4464 - RNA, 24 nt, Artificial Sequence
  Synthetic
aaguuccugcuucccgaauuuuga

SEQ ID NO: 4465 - RNA, 18 nt, Artificial Sequence
  Synthetic
uaagauaugagcugaaua

SEQ ID NO: 4466 - RNA, 19 nt, Artificial Sequence
  Synthetic
auaagauaugagcugaaua

SEQ ID NO: 4467 - RNA, 21 nt, Artificial Sequence
  Synthetic
ucauaagauaugagcugaaua

SEQ ID NO: 4468 - RNA, 22 nt, Artificial Sequence
  Synthetic
gucauaagauaugagcugaaua

SEQ ID NO: 4469 - RNA, 23 nt, Artificial Sequence
  Synthetic
ugucauaagauaugagcugaaua

SEQ ID NO: 4470 - RNA, 24 nt, Artificial Sequence
  Synthetic
cugucauaagauaugagcugaaua

SEQ ID NO: 4471 - RNA, 18 nt, Artificial Sequence
  Synthetic
uaaaaagcauaacuucua

SEQ ID NO: 4472 - RNA, 19 nt, Artificial Sequence
  Synthetic
auaaaaagcauaacuucua

SEQ ID NO: 4473 - RNA, 20 nt, Artificial Sequence
  Synthetic
aauaaaaagcauaacuucua

SEQ ID NO: 4474 - RNA, 21 nt, Artificial Sequence
  Synthetic
caauaaaaagcauaacuucua

SEQ ID NO: 4475 - RNA, 22 nt, Artificial Sequence
  Synthetic
acaauaaaaagcauaacuucua

SEQ ID NO: 4476 - RNA, 23 nt, Artificial Sequence
  Synthetic
cacaauaaaaagcauaacuucua

SEQ ID NO: 4477 - RNA, 24 nt, Artificial Sequence
  Synthetic
ccacaauaaaaagcauaacuucua

SEQ ID NO: 4478 - RNA, 18 nt, Artificial Sequence
  Synthetic
ucuggaacucgaacaaac

SEQ ID NO: 4479 - RNA, 19 nt, Artificial Sequence
  Synthetic
aucuggaacucgaacaaac

SEQ ID NO: 4480 - RNA, 20 nt, Artificial Sequence
  Synthetic
aaucuggaacucgaacaaac

SEQ ID NO: 4481 - RNA, 21 nt, Artificial Sequence
  Synthetic
gaaucuggaacucgaacaaac

SEQ ID NO: 4482 - RNA, 22 nt, Artificial Sequence
  Synthetic
agaaucuggaacucgaacaaac

SEQ ID NO: 4483 - RNA, 23 nt, Artificial Sequence
  Synthetic
gagaaucuggaacucgaacaaac

SEQ ID NO: 4484 - RNA, 24 nt, Artificial Sequence
  Synthetic
agagaaucuggaacucgaacaaac

SEQ ID NO: 4485 - RNA, 18 nt, Artificial Sequence
  Synthetic
cucuuugccugggacaac

SEQ ID NO: 4486 - RNA, 19 nt, Artificial Sequence
  Synthetic
gcucuuugccugggacaac

SEQ ID NO: 4487 - RNA, 21 nt, Artificial Sequence
  Synthetic
aagcucuuugccugggacaac

SEQ ID NO: 4488 - RNA, 22 nt, Artificial Sequence
  Synthetic
gaagcucuuugccugggacaac

SEQ ID NO: 4489 - RNA, 23 nt, Artificial Sequence
  Synthetic
agaagcucuuugccugggacaac

SEQ ID NO: 4490 - RNA, 24 nt, Artificial Sequence
  Synthetic
aagaagcucuuugccugggacaac

SEQ ID NO: 4491 - RNA, 18 nt, Artificial Sequence
  Synthetic
acccagagaaucuggaac

SEQ ID NO: 4492 - RNA, 19 nt, Artificial Sequence
  Synthetic
aacccagagaaucuggaac

SEQ ID NO: 4493 - RNA, 20 nt, Artificial Sequence
  Synthetic
gaacccagagaaucuggaac

SEQ ID NO: 4494 - RNA, 21 nt, Artificial Sequence
  Synthetic
ugaacccagagaaucuggaac

SEQ ID NO: 4495 - RNA, 22 nt, Artificial Sequence
  Synthetic
cugaacccagagaaucuggaac

SEQ ID NO: 4496 - RNA, 23 nt, Artificial Sequence
  Synthetic
acugaacccagagaaucuggaac

SEQ ID NO: 4497 - RNA, 24 nt, Artificial Sequence
  Synthetic
aacugaacccagagaaucuggaac

SEQ ID NO: 4498 - RNA, 18 nt, Artificial Sequence
  Synthetic
cuacacccaggagaccac

SEQ ID NO: 4499 - RNA, 19 nt, Artificial Sequence
  Synthetic
ccuacacccaggagaccac

SEQ ID NO: 4500 - RNA, 20 nt, Artificial Sequence
  Synthetic
cccuacacccaggagaccac

SEQ ID NO: 4501 - RNA, 21 nt, Artificial Sequence
  Synthetic
ccccuacacccaggagaccac

SEQ ID NO: 4502 - RNA, 22 nt, Artificial Sequence
  Synthetic
accccuacacccaggagaccac

SEQ ID NO: 4503 - RNA, 23 nt, Artificial Sequence
  Synthetic
uaccccuacacccaggagaccac

SEQ ID NO: 4504 - RNA, 24 nt, Artificial Sequence
  Synthetic
cuaccccuacacccaggagaccac

SEQ ID NO: 4505 - RNA, 18 nt, Artificial Sequence
  Synthetic
acauacugccuaggccac

SEQ ID NO: 4506 - RNA, 19 nt, Artificial Sequence
  Synthetic
cacauacugccuaggccac

SEQ ID NO: 4507 - RNA, 21 nt, Artificial Sequence
  Synthetic
uucacauacugccuaggccac

SEQ ID NO: 4508 - RNA, 22 nt, Artificial Sequence
  Synthetic
guucacauacugccuaggccac

SEQ ID NO: 4509 - RNA, 23 nt, Artificial Sequence
  Synthetic
gguucacauacugccuaggccac

SEQ ID NO: 4510 - RNA, 24 nt, Artificial Sequence
  Synthetic
agguucacauacugccuaggccac

SEQ ID NO: 4511 - RNA, 18 nt, Artificial Sequence
  Synthetic
gggccaguguccccagac

SEQ ID NO: 4512 - RNA, 19 nt, Artificial Sequence
  Synthetic
ggggccaguguccccagac

SEQ ID NO: 4513 - RNA, 21 nt, Artificial Sequence
  Synthetic
aaggggccaguguccccagac

SEQ ID NO: 4514 - RNA, 22 nt, Artificial Sequence
  Synthetic
gaaggggccaguguccccagac

SEQ ID NO: 4515 - RNA, 23 nt, Artificial Sequence
  Synthetic
agaaggggccaguguccccagac

SEQ ID NO: 4516 - RNA, 24 nt, Artificial Sequence
  Synthetic
gagaaggggccaguguccccagac

SEQ ID NO: 4517 - RNA, 18 nt, Artificial Sequence
  Synthetic
uauucuugggguggcuac

SEQ ID NO: 4518 - RNA, 19 nt, Artificial Sequence
  Synthetic
guauucuugggguggcuac

SEQ ID NO: 4519 - RNA, 21 nt, Artificial Sequence
  Synthetic
ccguauucuugggguggcuac

SEQ ID NO: 4520 - RNA, 22 nt, Artificial Sequence
  Synthetic
cccguauucuugggguggcuac

SEQ ID NO: 4521 - RNA, 23 nt, Artificial Sequence
  Synthetic
ucccguauucuugggguggcuac

SEQ ID NO: 4522 - RNA, 24 nt, Artificial Sequence
  Synthetic
uucccguauucuugggguggcuac

SEQ ID NO: 4523 - RNA, 18 nt, Artificial Sequence
  Synthetic
uuuuaaugcaguuucuac

SEQ ID NO: 4524 - RNA, 19 nt, Artificial Sequence
  Synthetic
cuuuuaaugcaguuucuac

SEQ ID NO: 4525 - RNA, 20 nt, Artificial Sequence
  Synthetic
ucuuuuaaugcaguuucuac

SEQ ID NO: 4526 - RNA, 21 nt, Artificial Sequence
  Synthetic
uucuuuuaaugcaguuucuac

SEQ ID NO: 4527 - RNA, 22 nt, Artificial Sequence
  Synthetic
uuucuuuuaaugcaguuucuac

SEQ ID NO: 4528 - RNA, 23 nt, Artificial Sequence
  Synthetic
cuuucuuuuaaugcaguuucuac

SEQ ID NO: 4529 - RNA, 24 nt, Artificial Sequence
  Synthetic
ucuuucuuuuaaugcaguuucuac

SEQ ID NO: 4530 - RNA, 18 nt, Artificial Sequence
  Synthetic
acgggugcugugguguac

SEQ ID NO: 4531 - RNA, 19 nt, Artificial Sequence
  Synthetic
cacgggugcugugguguac

SEQ ID NO: 4532 - RNA, 20 nt, Artificial Sequence
  Synthetic
gcacgggugcugugguguac

SEQ ID NO: 4533 - RNA, 21 nt, Artificial Sequence
  Synthetic
agcacgggugcugugguguac

SEQ ID NO: 4534 - RNA, 22 nt, Artificial Sequence
  Synthetic
aagcacgggugcugugguguac

SEQ ID NO: 4535 - RNA, 23 nt, Artificial Sequence
  Synthetic
aaagcacgggugcugugguguac

SEQ ID NO: 4536 - RNA, 24 nt, Artificial Sequence
  Synthetic
gaaagcacgggugcugugguguac

SEQ ID NO: 4537 - RNA, 18 nt, Artificial Sequence
  Synthetic
cuggaacucgaacaaacc

SEQ ID NO: 4538 - RNA, 19 nt, Artificial Sequence
  Synthetic
ucuggaacucgaacaaacc

SEQ ID NO: 4539 - RNA, 21 nt, Artificial Sequence
  Synthetic
aaucuggaacucgaacaaacc

SEQ ID NO: 4540 - RNA, 22 nt, Artificial Sequence
  Synthetic
gaaucuggaacucgaacaaacc

SEQ ID NO: 4541 - RNA, 23 nt, Artificial Sequence
  Synthetic
agaaucuggaacucgaacaaacc

SEQ ID NO: 4542 - RNA, 24 nt, Artificial Sequence
  Synthetic
gagaaucuggaacucgaacaaacc

SEQ ID NO: 4543 - RNA, 18 nt, Artificial Sequence
  Synthetic
uccucuccaaacugaacc

SEQ ID NO: 4544 - RNA, 19 nt, Artificial Sequence
  Synthetic
guccucuccaaacugaacc

SEQ ID NO: 4545 - RNA, 20 nt, Artificial Sequence
  Synthetic
uguccucuccaaacugaacc

SEQ ID NO: 4546 - RNA, 21 nt, Artificial Sequence
  Synthetic
uuguccucuccaaacugaacc

SEQ ID NO: 4547 - RNA, 22 nt, Artificial Sequence
  Synthetic
auuguccucuccaaacugaacc

SEQ ID NO: 4548 - RNA, 23 nt, Artificial Sequence
  Synthetic
cauuguccucuccaaacugaacc

SEQ ID NO: 4549 - RNA, 24 nt, Artificial Sequence
  Synthetic
ccauuguccucuccaaacugaacc

SEQ ID NO: 4550 - RNA, 18 nt, Artificial Sequence
  Synthetic
cccaccuaccccuacacc

SEQ ID NO: 4551 - RNA, 19 nt, Artificial Sequence
  Synthetic
gcccaccuaccccuacacc

SEQ ID NO: 4552 - RNA, 20 nt, Artificial Sequence
  Synthetic
agcccaccuaccccuacacc

SEQ ID NO: 4553 - RNA, 21 nt, Artificial Sequence
  Synthetic
aagcccaccuaccccuacacc

SEQ ID NO: 4554 - RNA, 22 nt, Artificial Sequence
  Synthetic
caagcccaccuaccccuacacc

SEQ ID NO: 4555 - RNA, 23 nt, Artificial Sequence
  Synthetic
ccaagcccaccuaccccuacacc

SEQ ID NO: 4556 - RNA, 24 nt, Artificial Sequence
  Synthetic
cccaagcccaccuaccccuacacc

SEQ ID NO: 4557 - RNA, 18 nt, Artificial Sequence
  Synthetic
ucccuggagcuggcuacc

SEQ ID NO: 4558 - RNA, 19 nt, Artificial Sequence
  Synthetic
aucccuggagcuggcuacc

SEQ ID NO: 4559 - RNA, 21 nt, Artificial Sequence
  Synthetic
aaaucccuggagcuggcuacc

SEQ ID NO: 4560 - RNA, 22 nt, Artificial Sequence
  Synthetic
gaaaucccuggagcuggcuacc

SEQ ID NO: 4561 - RNA, 23 nt, Artificial Sequence
  Synthetic
ggaaaucccuggagcuggcuacc

SEQ ID NO: 4562 - RNA, 24 nt, Artificial Sequence
  Synthetic
aggaaaucccuggagcuggcuacc

SEQ ID NO: 4563 - RNA, 18 nt, Artificial Sequence
  Synthetic
ccaccuaccccuacaccc

SEQ ID NO: 4564 - RNA, 19 nt, Artificial Sequence
  Synthetic
cccaccuaccccuacaccc

SEQ ID NO: 4565 - RNA, 21 nt, Artificial Sequence
  Synthetic
agcccaccuaccccuacaccc

SEQ ID NO: 4566 - RNA, 22 nt, Artificial Sequence
  Synthetic
aagcccaccuaccccuacaccc

SEQ ID NO: 4567 - RNA, 23 nt, Artificial Sequence
  Synthetic
caagcccaccuaccccuacaccc

SEQ ID NO: 4568 - RNA, 24 nt, Artificial Sequence
  Synthetic
ccaagcccaccuaccccuacaccc

SEQ ID NO: 4569 - RNA, 18 nt, Artificial Sequence
  Synthetic
augauugacuacaacccc

SEQ ID NO: 4570 - RNA, 19 nt, Artificial Sequence
  Synthetic
caugauugacuacaacccc

SEQ ID NO: 4571 - RNA, 21 nt, Artificial Sequence
  Synthetic
agcaugauugacuacaacccc

SEQ ID NO: 4572 - RNA, 22 nt, Artificial Sequence
  Synthetic
cagcaugauugacuacaacccc

SEQ ID NO: 4573 - RNA, 23 nt, Artificial Sequence
  Synthetic
gcagcaugauugacuacaacccc

SEQ ID NO: 4574 - RNA, 24 nt, Artificial Sequence
  Synthetic
agcagcaugauugacuacaacccc

SEQ ID NO: 4575 - RNA, 18 nt, Artificial Sequence
  Synthetic
ugauugacuacaaccccc

SEQ ID NO: 4576 - RNA, 19 nt, Artificial Sequence
  Synthetic
augauugacuacaaccccc

SEQ ID NO: 4577 - RNA, 21 nt, Artificial Sequence
  Synthetic
gcaugauugacuacaaccccc

SEQ ID NO: 4578 - RNA, 22 nt, Artificial Sequence
  Synthetic
agcaugauugacuacaaccccc

SEQ ID NO: 4579 - RNA, 23 nt, Artificial Sequence
  Synthetic
cagcaugauugacuacaaccccc

SEQ ID NO: 4580 - RNA, 24 nt, Artificial Sequence
  Synthetic
gcagcaugauugacuacaaccccc

SEQ ID NO: 4581 - RNA, 18 nt, Artificial Sequence
  Synthetic
ggcugagaaggaaauccc

SEQ ID NO: 4582 - RNA, 19 nt, Artificial Sequence
  Synthetic
aggcugagaaggaaauccc

SEQ ID NO: 4583 - RNA, 21 nt, Artificial Sequence
  Synthetic
gaaggcugagaaggaaauccc

SEQ ID NO: 4584 - RNA, 22 nt, Artificial Sequence
  Synthetic
ugaaggcugagaaggaaauccc

SEQ ID NO: 4585 - RNA, 23 nt, Artificial Sequence
  Synthetic
gugaaggcugagaaggaaauccc

SEQ ID NO: 4586 - RNA, 24 nt, Artificial Sequence
  Synthetic
agugaaggcugagaaggaaauccc

SEQ ID NO: 4587 - RNA, 18 nt, Artificial Sequence
  Synthetic
gagaagaagcucuuugcc

SEQ ID NO: 4588 - RNA, 19 nt, Artificial Sequence
  Synthetic
ggagaagaagcucuuugcc

SEQ ID NO: 4589 - RNA, 21 nt, Artificial Sequence
  Synthetic
cuggagaagaagcucuuugcc

SEQ ID NO: 4590 - RNA, 22 nt, Artificial Sequence
  Synthetic
ccuggagaagaagcucuuugcc

SEQ ID NO: 4591 - RNA, 23 nt, Artificial Sequence
  Synthetic
cccuggagaagaagcucuuugcc

SEQ ID NO: 4592 - RNA, 24 nt, Artificial Sequence
  Synthetic
ccccuggagaagaagcucuuugcc

SEQ ID NO: 4593 - RNA, 18 nt, Artificial Sequence
  Synthetic
aggcugagaaggaaaucc

SEQ ID NO: 4594 - RNA, 19 nt, Artificial Sequence
  Synthetic
aaggcugagaaggaaaucc

SEQ ID NO: 4595 - RNA, 21 nt, Artificial Sequence
  Synthetic
ugaaggcugagaaggaaaucc

SEQ ID NO: 4596 - RNA, 22 nt, Artificial Sequence
  Synthetic
gugaaggcugagaaggaaaucc

SEQ ID NO: 4597 - RNA, 23 nt, Artificial Sequence
  Synthetic
agugaaggcugagaaggaaaucc

SEQ ID NO: 4598 - RNA, 24 nt, Artificial Sequence
  Synthetic
cagugaaggcugagaaggaaaucc

SEQ ID NO: 4599 - RNA, 18 nt, Artificial Sequence
  Synthetic
ggagaugcucagggcucc

SEQ ID NO: 4600 - RNA, 19 nt, Artificial Sequence
  Synthetic
aggagaugcucagggcucc

SEQ ID NO: 4601 - RNA, 21 nt, Artificial Sequence
  Synthetic
gaaggagaugcucagggcucc

SEQ ID NO: 4602 - RNA, 22 nt, Artificial Sequence
  Synthetic
agaaggagaugcucagggcucc

SEQ ID NO: 4603 - RNA, 23 nt, Artificial Sequence
  Synthetic
cagaaggagaugcucagggcucc

SEQ ID NO: 4604 - RNA, 24 nt, Artificial Sequence
  Synthetic
gcagaaggagaugcucagggcucc

SEQ ID NO: 4605 - RNA, 18 nt, Artificial Sequence
  Synthetic
uggacacuuuggccuucc

SEQ ID NO: 4606 - RNA, 19 nt, Artificial Sequence
  Synthetic
uuggacacuuuggccuucc

SEQ ID NO: 4607 - RNA, 21 nt, Artificial Sequence
  Synthetic
auuuggacacuuuggccuucc

SEQ ID NO: 4608 - RNA, 22 nt, Artificial Sequence
  Synthetic
aauuuggacacuuuggccuucc

SEQ ID NO: 4609 - RNA, 23 nt, Artificial Sequence
  Synthetic
gaauuuggacacuuuggccuucc

SEQ ID NO: 4610 - RNA, 24 nt, Artificial Sequence
  Synthetic
ggaauuuggacacuuuggccuucc

SEQ ID NO: 4611 - RNA, 18 nt, Artificial Sequence
  Synthetic
uacccaacguucucuucc

SEQ ID NO: 4612 - RNA, 19 nt, Artificial Sequence
  Synthetic
uuacccaacguucucuucc

SEQ ID NO: 4613 - RNA, 20 nt, Artificial Sequence
  Synthetic
cuuacccaacguucucuucc

SEQ ID NO: 4614 - RNA, 21 nt, Artificial Sequence
  Synthetic
ucuuacccaacguucucuucc

SEQ ID NO: 4615 - RNA, 22 nt, Artificial Sequence
  Synthetic
uucuuacccaacguucucuucc

SEQ ID NO: 4616 - RNA, 23 nt, Artificial Sequence
  Synthetic
uuucuuacccaacguucucuucc

SEQ ID NO: 4617 - RNA, 24 nt, Artificial Sequence
  Synthetic
uuuucuuacccaacguucucuucc

SEQ ID NO: 4618 - RNA, 18 nt, Artificial Sequence
  Synthetic
aagggagagccagccagc

SEQ ID NO: 4619 - RNA, 19 nt, Artificial Sequence
  Synthetic
gaagggagagccagccagc

SEQ ID NO: 4620 - RNA, 21 nt, Artificial Sequence
  Synthetic
cugaagggagagccagccagc

SEQ ID NO: 4621 - RNA, 22 nt, Artificial Sequence
  Synthetic
gcugaagggagagccagccagc

SEQ ID NO: 4622 - RNA, 23 nt, Artificial Sequence
  Synthetic
ggcugaagggagagccagccagc

SEQ ID NO: 4623 - RNA, 24 nt, Artificial Sequence
  Synthetic
aggcugaagggagagccagccagc

SEQ ID NO: 4624 - RNA, 18 nt, Artificial Sequence
  Synthetic
ccagacccgagacacugc

SEQ ID NO: 4625 - RNA, 19 nt, Artificial Sequence
  Synthetic
cccagacccgagacacugc

SEQ ID NO: 4626 - RNA, 21 nt, Artificial Sequence
  Synthetic
uccccagacccgagacacugc

SEQ ID NO: 4627 - RNA, 22 nt, Artificial Sequence
  Synthetic
guccccagacccgagacacugc

SEQ ID NO: 4628 - RNA, 23 nt, Artificial Sequence
  Synthetic
uguccccagacccgagacacugc

SEQ ID NO: 4629 - RNA, 24 nt, Artificial Sequence
  Synthetic
guguccccagacccgagacacugc

SEQ ID NO: 4630 - RNA, 18 nt, Artificial Sequence
  Synthetic
ggagaagaagcucuuugc

SEQ ID NO: 4631 - RNA, 19 nt, Artificial Sequence
  Synthetic
uggagaagaagcucuuugc

SEQ ID NO: 4632 - RNA, 21 nt, Artificial Sequence
  Synthetic
ccuggagaagaagcucuuugc

SEQ ID NO: 4633 - RNA, 22 nt, Artificial Sequence
  Synthetic
cccuggagaagaagcucuuugc

SEQ ID NO: 4634 - RNA, 23 nt, Artificial Sequence
  Synthetic
ccccuggagaagaagcucuuugc

SEQ ID NO: 4635 - RNA, 24 nt, Artificial Sequence
  Synthetic
cccccuggagaagaagcucuuugc

SEQ ID NO: 4636 - RNA, 18 nt, Artificial Sequence
  Synthetic
aacugaacccagagaauc

SEQ ID NO: 4637 - RNA, 19 nt, Artificial Sequence
  Synthetic
aaacugaacccagagaauc

SEQ ID NO: 4638 - RNA, 21 nt, Artificial Sequence
  Synthetic
ccaaacugaacccagagaauc

SEQ ID NO: 4639 - RNA, 22 nt, Artificial Sequence
  Synthetic
uccaaacugaacccagagaauc

SEQ ID NO: 4640 - RNA, 23 nt, Artificial Sequence
  Synthetic
cuccaaacugaacccagagaauc

SEQ ID NO: 4641 - RNA, 24 nt, Artificial Sequence
  Synthetic
ucuccaaacugaacccagagaauc

SEQ ID NO: 4642 - RNA, 18 nt, Artificial Sequence
  Synthetic
uccaaguuuucauuaauc

SEQ ID NO: 4643 - RNA, 19 nt, Artificial Sequence
  Synthetic
uuccaaguuuucauuaauc

SEQ ID NO: 4644 - RNA, 21 nt, Artificial Sequence
  Synthetic
cuuuccaaguuuucauuaauc

SEQ ID NO: 4645 - RNA, 22 nt, Artificial Sequence
  Synthetic
gcuuuccaaguuuucauuaauc

SEQ ID NO: 4646 - RNA, 23 nt, Artificial Sequence
  Synthetic
ugcuuuccaaguuuucauuaauc

SEQ ID NO: 4647 - RNA, 24 nt, Artificial Sequence
  Synthetic
cugcuuuccaaguuuucauuaauc

SEQ ID NO: 4648 - RNA, 18 nt, Artificial Sequence
  Synthetic
gggugcugugguguacuc

SEQ ID NO: 4649 - RNA, 19 nt, Artificial Sequence
  Synthetic
cgggugcugugguguacuc

SEQ ID NO: 4650 - RNA, 21 nt, Artificial Sequence
  Synthetic
cacgggugcugugguguacuc

SEQ ID NO: 4651 - RNA, 22 nt, Artificial Sequence
  Synthetic
gcacgggugcugugguguacuc

SEQ ID NO: 4652 - RNA, 23 nt, Artificial Sequence
  Synthetic
agcacgggugcugugguguacuc

SEQ ID NO: 4653 - RNA, 24 nt, Artificial Sequence
  Synthetic
aagcacgggugcugugguguacuc

SEQ ID NO: 4654 - RNA, 18 nt, Artificial Sequence
  Synthetic
ggcugugccaccaggcuc

SEQ ID NO: 4655 - RNA, 19 nt, Artificial Sequence
  Synthetic
gggcugugccaccaggcuc

SEQ ID NO: 4656 - RNA, 21 nt, Artificial Sequence
  Synthetic
ucgggcugugccaccaggcuc

SEQ ID NO: 4657 - RNA, 22 nt, Artificial Sequence
  Synthetic
cucgggcugugccaccaggcuc

SEQ ID NO: 4658 - RNA, 23 nt, Artificial Sequence
  Synthetic
gcucgggcugugccaccaggcuc

SEQ ID NO: 4659 - RNA, 24 nt, Artificial Sequence
  Synthetic
ugcucgggcugugccaccaggcuc

SEQ ID NO: 4660 - RNA, 18 nt, Artificial Sequence
  Synthetic
aggagaugcucagggcuc

SEQ ID NO: 4661 - RNA, 19 nt, Artificial Sequence
  Synthetic
aaggagaugcucagggcuc

SEQ ID NO: 4662 - RNA, 21 nt, Artificial Sequence
  Synthetic
agaaggagaugcucagggcuc

SEQ ID NO: 4663 - RNA, 22 nt, Artificial Sequence
  Synthetic
cagaaggagaugcucagggcuc

SEQ ID NO: 4664 - RNA, 23 nt, Artificial Sequence
  Synthetic
gcagaaggagaugcucagggcuc

SEQ ID NO: 4665 - RNA, 24 nt, Artificial Sequence
  Synthetic
ggcagaaggagaugcucagggcuc

SEQ ID NO: 4666 - RNA, 18 nt, Artificial Sequence
  Synthetic
uuuccagggcgcugaguc

SEQ ID NO: 4667 - RNA, 19 nt, Artificial Sequence
  Synthetic
auuuccagggcgcugaguc

SEQ ID NO: 4668 - RNA, 20 nt, Artificial Sequence
  Synthetic
uauuuccagggcgcugaguc

SEQ ID NO: 4669 - RNA, 21 nt, Artificial Sequence
  Synthetic
cuauuuccagggcgcugaguc

SEQ ID NO: 4670 - RNA, 22 nt, Artificial Sequence
  Synthetic
ucuauuuccagggcgcugaguc

SEQ ID NO: 4671 - RNA, 23 nt, Artificial Sequence
  Synthetic
cucuauuuccagggcgcugaguc

SEQ ID NO: 4672 - RNA, 24 nt, Artificial Sequence
  Synthetic
ccucuauuuccagggcgcugaguc

SEQ ID NO: 4673 - RNA, 18 nt, Artificial Sequence
  Synthetic
acccugaccaucccauuc

SEQ ID NO: 4674 - RNA, 19 nt, Artificial Sequence
  Synthetic
gacccugaccaucccauuc

SEQ ID NO: 4675 - RNA, 21 nt, Artificial Sequence
  Synthetic
aagacccugaccaucccauuc

SEQ ID NO: 4676 - RNA, 22 nt, Artificial Sequence
  Synthetic
caagacccugaccaucccauuc

SEQ ID NO: 4677 - RNA, 23 nt, Artificial Sequence
  Synthetic
gcaagacccugaccaucccauuc

SEQ ID NO: 4678 - RNA, 24 nt, Artificial Sequence
  Synthetic
agcaagacccugaccaucccauuc

SEQ ID NO: 4679 - RNA, 18 nt, Artificial Sequence
  Synthetic
cggacaguucccguauuc

SEQ ID NO: 4680 - RNA, 19 nt, Artificial Sequence
  Synthetic
acggacaguucccguauuc

SEQ ID NO: 4681 - RNA, 21 nt, Artificial Sequence
  Synthetic
ccacggacaguucccguauuc

SEQ ID NO: 4682 - RNA, 22 nt, Artificial Sequence
  Synthetic
accacggacaguucccguauuc

SEQ ID NO: 4683 - RNA, 23 nt, Artificial Sequence
  Synthetic
uaccacggacaguucccguauuc

SEQ ID NO: 4684 - RNA, 24 nt, Artificial Sequence
  Synthetic
cuaccacggacaguucccguauuc

SEQ ID NO: 4685 - RNA, 18 nt, Artificial Sequence
  Synthetic
uuggacacuuuggccuuc

SEQ ID NO: 4686 - RNA, 19 nt, Artificial Sequence
  Synthetic
uuuggacacuuuggccuuc

SEQ ID NO: 4687 - RNA, 20 nt, Artificial Sequence
  Synthetic
auuuggacacuuuggccuuc

SEQ ID NO: 4688 - RNA, 21 nt, Artificial Sequence
  Synthetic
aauuuggacacuuuggccuuc

SEQ ID NO: 4689 - RNA, 22 nt, Artificial Sequence
  Synthetic
gaauuuggacacuuuggccuuc

SEQ ID NO: 4690 - RNA, 23 nt, Artificial Sequence
  Synthetic
ggaauuuggacacuuuggccuuc

SEQ ID NO: 4691 - RNA, 24 nt, Artificial Sequence
  Synthetic
uggaauuuggacacuuuggccuuc

SEQ ID NO: 4692 - RNA, 18 nt, Artificial Sequence
  Synthetic
aggcauaauaguuucuuc

SEQ ID NO: 4693 - RNA, 19 nt, Artificial Sequence
  Synthetic
aaggcauaauaguuucuuc

SEQ ID NO: 4694 - RNA, 20 nt, Artificial Sequence
  Synthetic
uaaggcauaauaguuucuuc

SEQ ID NO: 4695 - RNA, 21 nt, Artificial Sequence
  Synthetic
guaaggcauaauaguuucuuc

SEQ ID NO: 4696 - RNA, 22 nt, Artificial Sequence
  Synthetic
uguaaggcauaauaguuucuuc

SEQ ID NO: 4697 - RNA, 23 nt, Artificial Sequence
  Synthetic
cuguaaggcauaauaguuucuuc

SEQ ID NO: 4698 - RNA, 24 nt, Artificial Sequence
  Synthetic
gcuguaaggcauaauaguuucuuc

SEQ ID NO: 4699 - RNA, 18 nt, Artificial Sequence
  Synthetic
ucggggagccucuauuuc

SEQ ID NO: 4700 - RNA, 19 nt, Artificial Sequence
  Synthetic
cucggggagccucuauuuc

SEQ ID NO: 4701 - RNA, 20 nt, Artificial Sequence
  Synthetic
acucggggagccucuauuuc

SEQ ID NO: 4702 - RNA, 21 nt, Artificial Sequence
  Synthetic
uacucggggagccucuauuuc

SEQ ID NO: 4703 - RNA, 22 nt, Artificial Sequence
  Synthetic
guacucggggagccucuauuuc

SEQ ID NO: 4704 - RNA, 23 nt, Artificial Sequence
  Synthetic
uguacucggggagccucuauuuc

SEQ ID NO: 4705 - RNA, 24 nt, Artificial Sequence
  Synthetic
guguacucggggagccucuauuuc

SEQ ID NO: 4706 - RNA, 18 nt, Artificial Sequence
  Synthetic
gcuucccgaauuuugaag

SEQ ID NO: 4707 - RNA, 19 nt, Artificial Sequence
  Synthetic
ugcuucccgaauuuugaag

SEQ ID NO: 4708 - RNA, 20 nt, Artificial Sequence
  Synthetic
cugcuucccgaauuuugaag

SEQ ID NO: 4709 - RNA, 21 nt, Artificial Sequence
  Synthetic
ccugcuucccgaauuuugaag

SEQ ID NO: 4710 - RNA, 22 nt, Artificial Sequence
  Synthetic
uccugcuucccgaauuuugaag

SEQ ID NO: 4711 - RNA, 23 nt, Artificial Sequence
  Synthetic
uuccugcuucccgaauuuugaag

SEQ ID NO: 4712 - RNA, 24 nt, Artificial Sequence
  Synthetic
guuccugcuucccgaauuuugaag

SEQ ID NO: 4713 - RNA, 18 nt, Artificial Sequence
  Synthetic
cucucacgcugagaacag

SEQ ID NO: 4714 - RNA, 19 nt, Artificial Sequence
  Synthetic
ccucucacgcugagaacag

SEQ ID NO: 4715 - RNA, 20 nt, Artificial Sequence
  Synthetic
gccucucacgcugagaacag

SEQ ID NO: 4716 - RNA, 21 nt, Artificial Sequence
  Synthetic
agccucucacgcugagaacag

SEQ ID NO: 4717 - RNA, 22 nt, Artificial Sequence
  Synthetic
gagccucucacgcugagaacag

SEQ ID NO: 4718 - RNA, 23 nt, Artificial Sequence
  Synthetic
agagccucucacgcugagaacag

SEQ ID NO: 4719 - RNA, 24 nt, Artificial Sequence
  Synthetic
gagagccucucacgcugagaacag

SEQ ID NO: 4720 - RNA, 18 nt, Artificial Sequence
  Synthetic
cuguacaggcaauggcag

SEQ ID NO: 4721 - RNA, 19 nt, Artificial Sequence
  Synthetic
gcuguacaggcaauggcag

SEQ ID NO: 4722 - RNA, 21 nt, Artificial Sequence
  Synthetic
aagcuguacaggcaauggcag

SEQ ID NO: 4723 - RNA, 22 nt, Artificial Sequence
  Synthetic
caagcuguacaggcaauggcag

SEQ ID NO: 4724 - RNA, 23 nt, Artificial Sequence
  Synthetic
ccaagcuguacaggcaauggcag

SEQ ID NO: 4725 - RNA, 24 nt, Artificial Sequence
  Synthetic
uccaagcuguacaggcaauggcag

SEQ ID NO: 4726 - RNA, 18 nt, Artificial Sequence
  Synthetic
gaagguaagaaugcagag

SEQ ID NO: 4727 - RNA, 19 nt, Artificial Sequence
  Synthetic
agaagguaagaaugcagag

SEQ ID NO: 4728 - RNA, 21 nt, Artificial Sequence
  Synthetic
agagaagguaagaaugcagag

SEQ ID NO: 4729 - RNA, 22 nt, Artificial Sequence
  Synthetic
cagagaagguaagaaugcagag

SEQ ID NO: 4730 - RNA, 23 nt, Artificial Sequence
  Synthetic
ccagagaagguaagaaugcagag

SEQ ID NO: 4731 - RNA, 24 nt, Artificial Sequence
  Synthetic
uccagagaagguaagaaugcagag

SEQ ID NO: 4732 - RNA, 18 nt, Artificial Sequence
  Synthetic
aucuggcuaucucaggag

SEQ ID NO: 4733 - RNA, 19 nt, Artificial Sequence
  Synthetic
caucuggcuaucucaggag

SEQ ID NO: 4734 - RNA, 21 nt, Artificial Sequence
  Synthetic
cccaucuggcuaucucaggag

SEQ ID NO: 4735 - RNA, 22 nt, Artificial Sequence
  Synthetic
gcccaucuggcuaucucaggag

SEQ ID NO: 4736 - RNA, 23 nt, Artificial Sequence
  Synthetic
agcccaucuggcuaucucaggag

SEQ ID NO: 4737 - RNA, 24 nt, Artificial Sequence
  Synthetic
gagcccaucuggcuaucucaggag

SEQ ID NO: 4738 - RNA, 18 nt, Artificial Sequence
  Synthetic
gacuacaacccccuggag

SEQ ID NO: 4739 - RNA, 19 nt, Artificial Sequence
  Synthetic
ugacuacaacccccuggag

SEQ ID NO: 4740 - RNA, 21 nt, Artificial Sequence
  Synthetic
auugacuacaacccccuggag

SEQ ID NO: 4741 - RNA, 22 nt, Artificial Sequence
  Synthetic
gauugacuacaacccccuggag

SEQ ID NO: 4742 - RNA, 23 nt, Artificial Sequence
  Synthetic
ugauugacuacaacccccuggag

SEQ ID NO: 4743 - RNA, 24 nt, Artificial Sequence
  Synthetic
augauugacuacaacccccuggag

SEQ ID NO: 4744 - RNA, 18 nt, Artificial Sequence
  Synthetic
gcuaucucaggaguggag

SEQ ID NO: 4745 - RNA, 19 nt, Artificial Sequence
  Synthetic
ggcuaucucaggaguggag

SEQ ID NO: 4746 - RNA, 21 nt, Artificial Sequence
  Synthetic
cuggcuaucucaggaguggag

SEQ ID NO: 4747 - RNA, 22 nt, Artificial Sequence
  Synthetic
ucuggcuaucucaggaguggag

SEQ ID NO: 4748 - RNA, 23 nt, Artificial Sequence
  Synthetic
aucuggcuaucucaggaguggag

SEQ ID NO: 4749 - RNA, 24 nt, Artificial Sequence
  Synthetic
caucuggcuaucucaggaguggag

SEQ ID NO: 4750 - RNA, 18 nt, Artificial Sequence
  Synthetic
ggagguagcaaggcugag

SEQ ID NO: 4751 - RNA, 19 nt, Artificial Sequence
  Synthetic
aggagguagcaaggcugag

SEQ ID NO: 4752 - RNA, 21 nt, Artificial Sequence
  Synthetic
ccaggagguagcaaggcugag

SEQ ID NO: 4753 - RNA, 22 nt, Artificial Sequence
  Synthetic
gccaggagguagcaaggcugag

SEQ ID NO: 4754 - RNA, 23 nt, Artificial Sequence
  Synthetic
agccaggagguagcaaggcugag

SEQ ID NO: 4755 - RNA, 24 nt, Artificial Sequence
  Synthetic
cagccaggagguagcaaggcugag

SEQ ID NO: 4756 - RNA, 18 nt, Artificial Sequence
  Synthetic
gagacagugaaggcugag

SEQ ID NO: 4757 - RNA, 19 nt, Artificial Sequence
  Synthetic
cgagacagugaaggcugag

SEQ ID NO: 4758 - RNA, 21 nt, Artificial Sequence
  Synthetic
accgagacagugaaggcugag

SEQ ID NO: 4759 - RNA, 22 nt, Artificial Sequence
  Synthetic
uaccgagacagugaaggcugag

SEQ ID NO: 4760 - RNA, 23 nt, Artificial Sequence
  Synthetic
auaccgagacagugaaggcugag

SEQ ID NO: 4761 - RNA, 24 nt, Artificial Sequence
  Synthetic
aauaccgagacagugaaggcugag

SEQ ID NO: 4762 - RNA, 18 nt, Artificial Sequence
  Synthetic
gagaacuaguuuggguag

SEQ ID NO: 4763 - RNA, 19 nt, Artificial Sequence
  Synthetic
ggagaacuaguuuggguag

SEQ ID NO: 4764 - RNA, 20 nt, Artificial Sequence
  Synthetic
uggagaacuaguuuggguag

SEQ ID NO: 4765 - RNA, 21 nt, Artificial Sequence
  Synthetic
guggagaacuaguuuggguag

SEQ ID NO: 4766 - RNA, 22 nt, Artificial Sequence
  Synthetic
uguggagaacuaguuuggguag

SEQ ID NO: 4767 - RNA, 23 nt, Artificial Sequence
  Synthetic
auguggagaacuaguuuggguag

SEQ ID NO: 4768 - RNA, 24 nt, Artificial Sequence
  Synthetic
gauguggagaacuaguuuggguag

SEQ ID NO: 4769 - RNA, 18 nt, Artificial Sequence
  Synthetic
uacacccaggagaccacg

SEQ ID NO: 4770 - RNA, 19 nt, Artificial Sequence
  Synthetic
cuacacccaggagaccacg

SEQ ID NO: 4771 - RNA, 21 nt, Artificial Sequence
  Synthetic
cccuacacccaggagaccacg

SEQ ID NO: 4772 - RNA, 22 nt, Artificial Sequence
  Synthetic
ccccuacacccaggagaccacg

SEQ ID NO: 4773 - RNA, 23 nt, Artificial Sequence
  Synthetic
accccuacacccaggagaccacg

SEQ ID NO: 4774 - RNA, 24 nt, Artificial Sequence
  Synthetic
uaccccuacacccaggagaccacg

SEQ ID NO: 4775 - RNA, 18 nt, Artificial Sequence
  Synthetic
guaggagagccucucacg

SEQ ID NO: 4776 - RNA, 19 nt, Artificial Sequence
  Synthetic
gguaggagagccucucacg

SEQ ID NO: 4777 - RNA, 20 nt, Artificial Sequence
  Synthetic
ggguaggagagccucucacg

SEQ ID NO: 4778 - RNA, 21 nt, Artificial Sequence
  Synthetic
uggguaggagagccucucacg

SEQ ID NO: 4779 - RNA, 22 nt, Artificial Sequence
  Synthetic
uuggguaggagagccucucacg

SEQ ID NO: 4780 - RNA, 23 nt, Artificial Sequence
  Synthetic
uuuggguaggagagccucucacg

SEQ ID NO: 4781 - RNA, 24 nt, Artificial Sequence
  Synthetic
guuuggguaggagagccucucacg

SEQ ID NO: 4782 - RNA, 18 nt, Artificial Sequence
  Synthetic
gggucauuuacagcaccg

SEQ ID NO: 4783 - RNA, 19 nt, Artificial Sequence
  Synthetic
ugggucauuuacagcaccg

SEQ ID NO: 4784 - RNA, 21 nt, Artificial Sequence
  Synthetic
ucugggucauuuacagcaccg

SEQ ID NO: 4785 - RNA, 22 nt, Artificial Sequence
  Synthetic
cucugggucauuuacagcaccg

SEQ ID NO: 4786 - RNA, 23 nt, Artificial Sequence
  Synthetic
ccucugggucauuuacagcaccg

SEQ ID NO: 4787 - RNA, 24 nt, Artificial Sequence
  Synthetic
gccucugggucauuuacagcaccg

SEQ ID NO: 4788 - RNA, 18 nt, Artificial Sequence
  Synthetic
ggugcugugguguacucg

SEQ ID NO: 4789 - RNA, 19 nt, Artificial Sequence
  Synthetic
gggugcugugguguacucg

SEQ ID NO: 4790 - RNA, 21 nt, Artificial Sequence
  Synthetic
acgggugcugugguguacucg

SEQ ID NO: 4791 - RNA, 22 nt, Artificial Sequence
  Synthetic
cacgggugcugugguguacucg

SEQ ID NO: 4792 - RNA, 23 nt, Artificial Sequence
  Synthetic
gcacgggugcugugguguacucg

SEQ ID NO: 4793 - RNA, 24 nt, Artificial Sequence
  Synthetic
agcacgggugcugugguguacucg

SEQ ID NO: 4794 - RNA, 18 nt, Artificial Sequence
  Synthetic
agccaggagguagcaagg

SEQ ID NO: 4795 - RNA, 19 nt, Artificial Sequence
  Synthetic
cagccaggagguagcaagg

SEQ ID NO: 4796 - RNA, 21 nt, Artificial Sequence
  Synthetic
agcagccaggagguagcaagg

SEQ ID NO: 4797 - RNA, 22 nt, Artificial Sequence
  Synthetic
cagcagccaggagguagcaagg

SEQ ID NO: 4798 - RNA, 23 nt, Artificial Sequence
  Synthetic
gcagcagccaggagguagcaagg

SEQ ID NO: 4799 - RNA, 24 nt, Artificial Sequence
  Synthetic
agcagcagccaggagguagcaagg

SEQ ID NO: 4800 - RNA, 18 nt, Artificial Sequence
  Synthetic
uuucauuaauccagaagg

SEQ ID NO: 4801 - RNA, 19 nt, Artificial Sequence
  Synthetic
uuuucauuaauccagaagg

SEQ ID NO: 4802 - RNA, 21 nt, Artificial Sequence
  Synthetic
aguuuucauuaauccagaagg

SEQ ID NO: 4803 - RNA, 22 nt, Artificial Sequence
  Synthetic
aaguuuucauuaauccagaagg

SEQ ID NO: 4804 - RNA, 23 nt, Artificial Sequence
  Synthetic
caaguuuucauuaauccagaagg

SEQ ID NO: 4805 - RNA, 24 nt, Artificial Sequence
  Synthetic
ccaaguuuucauuaauccagaagg

SEQ ID NO: 4806 - RNA, 18 nt, Artificial Sequence
  Synthetic
gggggagcaggcugaagg

SEQ ID NO: 4807 - RNA, 19 nt, Artificial Sequence
  Synthetic
ggggggagcaggcugaagg

SEQ ID NO: 4808 - RNA, 21 nt, Artificial Sequence
  Synthetic
cuggggggagcaggcugaagg

SEQ ID NO: 4809 - RNA, 22 nt, Artificial Sequence
  Synthetic
ccuggggggagcaggcugaagg

SEQ ID NO: 4810 - RNA, 23 nt, Artificial Sequence
  Synthetic
uccuggggggagcaggcugaagg

SEQ ID NO: 4811 - RNA, 24 nt, Artificial Sequence
  Synthetic
cuccuggggggagcaggcugaagg

SEQ ID NO: 4812 - RNA, 18 nt, Artificial Sequence
  Synthetic
auaccgagacagugaagg

SEQ ID NO: 4813 - RNA, 19 nt, Artificial Sequence
  Synthetic
aauaccgagacagugaagg

SEQ ID NO: 4814 - RNA, 21 nt, Artificial Sequence
  Synthetic
ugaauaccgagacagugaagg

SEQ ID NO: 4815 - RNA, 22 nt, Artificial Sequence
  Synthetic
cugaauaccgagacagugaagg

SEQ ID NO: 4816 - RNA, 23 nt, Artificial Sequence
  Synthetic
gcugaauaccgagacagugaagg

SEQ ID NO: 4817 - RNA, 24 nt, Artificial Sequence
  Synthetic
agcugaauaccgagacagugaagg

SEQ ID NO: 4818 - RNA, 18 nt, Artificial Sequence
  Synthetic
gcuccuggggggagcagg

SEQ ID NO: 4819 - RNA, 19 nt, Artificial Sequence
  Synthetic
ggcuccuggggggagcagg

SEQ ID NO: 4820 - RNA, 21 nt, Artificial Sequence
  Synthetic
agggcuccuggggggagcagg

SEQ ID NO: 4821 - RNA, 22 nt, Artificial Sequence
  Synthetic
cagggcuccuggggggagcagg

SEQ ID NO: 4822 - RNA, 23 nt, Artificial Sequence
  Synthetic
ucagggcuccuggggggagcagg

SEQ ID NO: 4823 - RNA, 24 nt, Artificial Sequence
  Synthetic
cucagggcuccuggggggagcagg

SEQ ID NO: 4824 - RNA, 18 nt, Artificial Sequence
  Synthetic
augcucagggcuccuggg

SEQ ID NO: 4825 - RNA, 19 nt, Artificial Sequence
  Synthetic
gaugcucagggcuccuggg

SEQ ID NO: 4826 - RNA, 21 nt, Artificial Sequence
  Synthetic
gagaugcucagggcuccuggg

SEQ ID NO: 4827 - RNA, 22 nt, Artificial Sequence
  Synthetic
ggagaugcucagggcuccuggg

SEQ ID NO: 4828 - RNA, 23 nt, Artificial Sequence
  Synthetic
aggagaugcucagggcuccuggg

SEQ ID NO: 4829 - RNA, 24 nt, Artificial Sequence
  Synthetic
aaggagaugcucagggcuccuggg

SEQ ID NO: 4830 - RNA, 18 nt, Artificial Sequence
  Synthetic
guggagaacuaguuuggg

SEQ ID NO: 4831 - RNA, 19 nt, Artificial Sequence
  Synthetic
uguggagaacuaguuuggg

SEQ ID NO: 4832 - RNA, 20 nt, Artificial Sequence
  Synthetic
auguggagaacuaguuuggg

SEQ ID NO: 4833 - RNA, 21 nt, Artificial Sequence
  Synthetic
gauguggagaacuaguuuggg

SEQ ID NO: 4834 - RNA, 22 nt, Artificial Sequence
  Synthetic
ggauguggagaacuaguuuggg

SEQ ID NO: 4835 - RNA, 23 nt, Artificial Sequence
  Synthetic
aggauguggagaacuaguuuggg

SEQ ID NO: 4836 - RNA, 24 nt, Artificial Sequence
  Synthetic
caggauguggagaacuaguuuggg

SEQ ID NO: 4837 - RNA, 18 nt, Artificial Sequence
  Synthetic
aagcuguacaggcaaugg

SEQ ID NO: 4838 - RNA, 19 nt, Artificial Sequence
  Synthetic
caagcuguacaggcaaugg

SEQ ID NO: 4839 - RNA, 21 nt, Artificial Sequence
  Synthetic
uccaagcuguacaggcaaugg

SEQ ID NO: 4840 - RNA, 22 nt, Artificial Sequence
  Synthetic
cuccaagcuguacaggcaaugg

SEQ ID NO: 4841 - RNA, 23 nt, Artificial Sequence
  Synthetic
ccuccaagcuguacaggcaaugg

SEQ ID NO: 4842 - RNA, 24 nt, Artificial Sequence
  Synthetic
gccuccaagcuguacaggcaaugg

SEQ ID NO: 4843 - RNA, 18 nt, Artificial Sequence
  Synthetic
gaugcucagggcuccugg

SEQ ID NO: 4844 - RNA, 19 nt, Artificial Sequence
  Synthetic
agaugcucagggcuccugg

SEQ ID NO: 4845 - RNA, 21 nt, Artificial Sequence
  Synthetic
ggagaugcucagggcuccugg

SEQ ID NO: 4846 - RNA, 22 nt, Artificial Sequence
  Synthetic
aggagaugcucagggcuccugg

SEQ ID NO: 4847 - RNA, 23 nt, Artificial Sequence
  Synthetic
aaggagaugcucagggcuccugg

SEQ ID NO: 4848 - RNA, 24 nt, Artificial Sequence
  Synthetic
gaaggagaugcucagggcuccugg

SEQ ID NO: 4849 - RNA, 18 nt, Artificial Sequence
  Synthetic
gguaagaaugcagagugg

SEQ ID NO: 4850 - RNA, 19 nt, Artificial Sequence
  Synthetic
agguaagaaugcagagugg

SEQ ID NO: 4851 - RNA, 21 nt, Artificial Sequence
  Synthetic
gaagguaagaaugcagagugg

SEQ ID NO: 4852 - RNA, 22 nt, Artificial Sequence
  Synthetic
agaagguaagaaugcagagugg

SEQ ID NO: 4853 - RNA, 23 nt, Artificial Sequence
  Synthetic
gagaagguaagaaugcagagugg

SEQ ID NO: 4854 - RNA, 24 nt, Artificial Sequence
  Synthetic
agagaagguaagaaugcagagugg

SEQ ID NO: 4855 - RNA, 18 nt, Artificial Sequence
  Synthetic
acauugacuuggcugugg

SEQ ID NO: 4856 - RNA, 19 nt, Artificial Sequence
  Synthetic
gacauugacuuggcugugg

SEQ ID NO: 4857 - RNA, 21 nt, Artificial Sequence
  Synthetic
cggacauugacuuggcugugg

SEQ ID NO: 4858 - RNA, 22 nt, Artificial Sequence
  Synthetic
acggacauugacuuggcugugg

SEQ ID NO: 4859 - RNA, 23 nt, Artificial Sequence
  Synthetic
cacggacauugacuuggcugugg

SEQ ID NO: 4860 - RNA, 24 nt, Artificial Sequence
  Synthetic
acacggacauugacuuggcugugg

SEQ ID NO: 4861 - RNA, 18 nt, Artificial Sequence
  Synthetic
ucugaauuuaccaggaug

SEQ ID NO: 4862 - RNA, 19 nt, Artificial Sequence
  Synthetic
uucugaauuuaccaggaug

SEQ ID NO: 4863 - RNA, 21 nt, Artificial Sequence
  Synthetic
uuuucugaauuuaccaggaug

SEQ ID NO: 4864 - RNA, 22 nt, Artificial Sequence
  Synthetic
cuuuucugaauuuaccaggaug

SEQ ID NO: 4865 - RNA, 23 nt, Artificial Sequence
  Synthetic
ucuuuucugaauuuaccaggaug

SEQ ID NO: 4866 - RNA, 24 nt, Artificial Sequence
  Synthetic
uucuuuucugaauuuaccaggaug

SEQ ID NO: 4867 - RNA, 18 nt, Artificial Sequence
  Synthetic
cucaucagccaguuuaug

SEQ ID NO: 4868 - RNA, 19 nt, Artificial Sequence
  Synthetic
ccucaucagccaguuuaug

SEQ ID NO: 4869 - RNA, 20 nt, Artificial Sequence
  Synthetic
accucaucagccaguuuaug

SEQ ID NO: 4870 - RNA, 21 nt, Artificial Sequence
  Synthetic
gaccucaucagccaguuuaug

SEQ ID NO: 4871 - RNA, 22 nt, Artificial Sequence
  Synthetic
ugaccucaucagccaguuuaug

SEQ ID NO: 4872 - RNA, 23 nt, Artificial Sequence
  Synthetic
augaccucaucagccaguuuaug

SEQ ID NO: 4873 - RNA, 24 nt, Artificial Sequence
  Synthetic
uaugaccucaucagccaguuuaug

SEQ ID NO: 4874 - RNA, 18 nt, Artificial Sequence
  Synthetic
auugacuacaacccccug

SEQ ID NO: 4875 - RNA, 19 nt, Artificial Sequence
  Synthetic
gauugacuacaacccccug

SEQ ID NO: 4876 - RNA, 21 nt, Artificial Sequence
  Synthetic
augauugacuacaacccccug

SEQ ID NO: 4877 - RNA, 22 nt, Artificial Sequence
  Synthetic
caugauugacuacaacccccug

SEQ ID NO: 4878 - RNA, 23 nt, Artificial Sequence
  Synthetic
gcaugauugacuacaacccccug

SEQ ID NO: 4879 - RNA, 24 nt, Artificial Sequence
  Synthetic
agcaugauugacuacaacccccug

SEQ ID NO: 4880 - RNA, 18 nt, Artificial Sequence
  Synthetic
agaugcucagggcuccug

SEQ ID NO: 4881 - RNA, 19 nt, Artificial Sequence
  Synthetic
gagaugcucagggcuccug

SEQ ID NO: 4882 - RNA, 21 nt, Artificial Sequence
  Synthetic
aggagaugcucagggcuccug

SEQ ID NO: 4883 - RNA, 22 nt, Artificial Sequence
  Synthetic
aaggagaugcucagggcuccug

SEQ ID NO: 4884 - RNA, 23 nt, Artificial Sequence
  Synthetic
gaaggagaugcucagggcuccug

SEQ ID NO: 4885 - RNA, 24 nt, Artificial Sequence
  Synthetic
agaaggagaugcucagggcuccug

SEQ ID NO: 4886 - RNA, 18 nt, Artificial Sequence
  Synthetic
ccuggggggagcaggcug

SEQ ID NO: 4887 - RNA, 19 nt, Artificial Sequence
  Synthetic
uccuggggggagcaggcug

SEQ ID NO: 4888 - RNA, 21 nt, Artificial Sequence
  Synthetic
gcuccuggggggagcaggcug

SEQ ID NO: 4889 - RNA, 22 nt, Artificial Sequence
  Synthetic
ggcuccuggggggagcaggcug

SEQ ID NO: 4890 - RNA, 23 nt, Artificial Sequence
  Synthetic
gggcuccuggggggagcaggcug

SEQ ID NO: 4891 - RNA, 24 nt, Artificial Sequence
  Synthetic
agggcuccuggggggagcaggcug

SEQ ID NO: 4892 - RNA, 18 nt, Artificial Sequence
  Synthetic
agguaagaaugcagagug

SEQ ID NO: 4893 - RNA, 19 nt, Artificial Sequence
  Synthetic
aagguaagaaugcagagug

SEQ ID NO: 4894 - RNA, 21 nt, Artificial Sequence
  Synthetic
agaagguaagaaugcagagug

SEQ ID NO: 4895 - RNA, 22 nt, Artificial Sequence
  Synthetic
gagaagguaagaaugcagagug

SEQ ID NO: 4896 - RNA, 23 nt, Artificial Sequence
  Synthetic
agagaagguaagaaugcagagug

SEQ ID NO: 4897 - RNA, 24 nt, Artificial Sequence
  Synthetic
cagagaagguaagaaugcagagug

SEQ ID NO: 4898 - RNA, 18 nt, Artificial Sequence
  Synthetic
cuggcuaucucaggagug

SEQ ID NO: 4899 - RNA, 19 nt, Artificial Sequence
  Synthetic
ucuggcuaucucaggagug

SEQ ID NO: 4900 - RNA, 20 nt, Artificial Sequence
  Synthetic
aucuggcuaucucaggagug

SEQ ID NO: 4901 - RNA, 21 nt, Artificial Sequence
  Synthetic
caucuggcuaucucaggagug

SEQ ID NO: 4902 - RNA, 22 nt, Artificial Sequence
  Synthetic
ccaucuggcuaucucaggagug

SEQ ID NO: 4903 - RNA, 23 nt, Artificial Sequence
  Synthetic
cccaucuggcuaucucaggagug

SEQ ID NO: 4904 - RNA, 24 nt, Artificial Sequence
  Synthetic
gcccaucuggcuaucucaggagug

SEQ ID NO: 4905 - RNA, 18 nt, Artificial Sequence
  Synthetic
ugaauuuaccaggaugug

SEQ ID NO: 4906 - RNA, 19 nt, Artificial Sequence
  Synthetic
cugaauuuaccaggaugug

SEQ ID NO: 4907 - RNA, 20 nt, Artificial Sequence
  Synthetic
ucugaauuuaccaggaugug

SEQ ID NO: 4908 - RNA, 21 nt, Artificial Sequence
  Synthetic
uucugaauuuaccaggaugug

SEQ ID NO: 4909 - RNA, 22 nt, Artificial Sequence
  Synthetic
uuucugaauuuaccaggaugug

SEQ ID NO: 4910 - RNA, 23 nt, Artificial Sequence
  Synthetic
uuuucugaauuuaccaggaugug

SEQ ID NO: 4911 - RNA, 24 nt, Artificial Sequence
  Synthetic
cuuuucugaauuuaccaggaugug

SEQ ID NO: 4912 - RNA, 18 nt, Artificial Sequence
  Synthetic
ucucuuccuugaacuuug

SEQ ID NO: 4913 - RNA, 19 nt, Artificial Sequence
  Synthetic
uucucuuccuugaacuuug

SEQ ID NO: 4914 - RNA, 21 nt, Artificial Sequence
  Synthetic
cguucucuuccuugaacuuug

SEQ ID NO: 4915 - RNA, 22 nt, Artificial Sequence
  Synthetic
acguucucuuccuugaacuuug

SEQ ID NO: 4916 - RNA, 23 nt, Artificial Sequence
  Synthetic
aacguucucuuccuugaacuuug

SEQ ID NO: 4917 - RNA, 24 nt, Artificial Sequence
  Synthetic
caacguucucuuccuugaacuuug

SEQ ID NO: 4918 - RNA, 18 nt, Artificial Sequence
  Synthetic
ccugcuucccgaauuuug

SEQ ID NO: 4919 - RNA, 19 nt, Artificial Sequence
  Synthetic
uccugcuucccgaauuuug

SEQ ID NO: 4920 - RNA, 20 nt, Artificial Sequence
  Synthetic
uuccugcuucccgaauuuug

SEQ ID NO: 4921 - RNA, 21 nt, Artificial Sequence
  Synthetic
guuccugcuucccgaauuuug

SEQ ID NO: 4922 - RNA, 22 nt, Artificial Sequence
  Synthetic
aguuccugcuucccgaauuuug

SEQ ID NO: 4923 - RNA, 23 nt, Artificial Sequence
  Synthetic
aaguuccugcuucccgaauuuug

SEQ ID NO: 4924 - RNA, 24 nt, Artificial Sequence
  Synthetic
gaaguuccugcuucccgaauuuug

SEQ ID NO: 4925 - RNA, 18 nt, Artificial Sequence
  Synthetic
aaacugaacccagagaau

SEQ ID NO: 4926 - RNA, 19 nt, Artificial Sequence
  Synthetic
caaacugaacccagagaau

SEQ ID NO: 4927 - RNA, 20 nt, Artificial Sequence
  Synthetic
ccaaacugaacccagagaau

SEQ ID NO: 4928 - RNA, 21 nt, Artificial Sequence
  Synthetic
uccaaacugaacccagagaau

SEQ ID NO: 4929 - RNA, 22 nt, Artificial Sequence
  Synthetic
cuccaaacugaacccagagaau

SEQ ID NO: 4930 - RNA, 23 nt, Artificial Sequence
  Synthetic
ucuccaaacugaacccagagaau

SEQ ID NO: 4931 - RNA, 24 nt, Artificial Sequence
  Synthetic
cucuccaaacugaacccagagaau

SEQ ID NO: 4932 - RNA, 18 nt, Artificial Sequence
  Synthetic
gcaguuucuacguggaau

SEQ ID NO: 4933 - RNA, 19 nt, Artificial Sequence
  Synthetic
ugcaguuucuacguggaau

SEQ ID NO: 4934 - RNA, 20 nt, Artificial Sequence
  Synthetic
augcaguuucuacguggaau

SEQ ID NO: 4935 - RNA, 21 nt, Artificial Sequence
  Synthetic
aaugcaguuucuacguggaau

SEQ ID NO: 4936 - RNA, 22 nt, Artificial Sequence
  Synthetic
uaaugcaguuucuacguggaau

SEQ ID NO: 4937 - RNA, 23 nt, Artificial Sequence
  Synthetic
uuaaugcaguuucuacguggaau

SEQ ID NO: 4938 - RNA, 24 nt, Artificial Sequence
  Synthetic
uuuaaugcaguuucuacguggaau

SEQ ID NO: 4939 - RNA, 18 nt, Artificial Sequence
  Synthetic
caucaagcucuccaagau

SEQ ID NO: 4940 - RNA, 19 nt, Artificial Sequence
  Synthetic
acaucaagcucuccaagau

SEQ ID NO: 4941 - RNA, 21 nt, Artificial Sequence
  Synthetic
ugacaucaagcucuccaagau

SEQ ID NO: 4942 - RNA, 22 nt, Artificial Sequence
  Synthetic
augacaucaagcucuccaagau

SEQ ID NO: 4943 - RNA, 23 nt, Artificial Sequence
  Synthetic
uaugacaucaagcucuccaagau

SEQ ID NO: 4944 - RNA, 24 nt, Artificial Sequence
  Synthetic
uuaugacaucaagcucuccaagau

SEQ ID NO: 4945 - RNA, 18 nt, Artificial Sequence
  Synthetic
ccagaacugucauaagau

SEQ ID NO: 4946 - RNA, 19 nt, Artificial Sequence
  Synthetic
uccagaacugucauaagau

SEQ ID NO: 4947 - RNA, 21 nt, Artificial Sequence
  Synthetic
aguccagaacugucauaagau

SEQ ID NO: 4948 - RNA, 22 nt, Artificial Sequence
  Synthetic
gaguccagaacugucauaagau

SEQ ID NO: 4949 - RNA, 23 nt, Artificial Sequence
  Synthetic
ugaguccagaacugucauaagau

SEQ ID NO: 4950 - RNA, 24 nt, Artificial Sequence
  Synthetic
cugaguccagaacugucauaagau

SEQ ID NO: 4951 - RNA, 18 nt, Artificial Sequence
  Synthetic
uucugaauuuaccaggau

SEQ ID NO: 4952 - RNA, 19 nt, Artificial Sequence
  Synthetic
uuucugaauuuaccaggau

SEQ ID NO: 4953 - RNA, 20 nt, Artificial Sequence
  Synthetic
uuuucugaauuuaccaggau

SEQ ID NO: 4954 - RNA, 21 nt, Artificial Sequence
  Synthetic
cuuuucugaauuuaccaggau

SEQ ID NO: 4955 - RNA, 22 nt, Artificial Sequence
  Synthetic
ucuuuucugaauuuaccaggau

SEQ ID NO: 4956 - RNA, 23 nt, Artificial Sequence
  Synthetic
uucuuuucugaauuuaccaggau

SEQ ID NO: 4957 - RNA, 24 nt, Artificial Sequence
  Synthetic
uuucuuuucugaauuuaccaggau

SEQ ID NO: 4958 - RNA, 18 nt, Artificial Sequence
  Synthetic
caaguaugguguguggau

SEQ ID NO: 4959 - RNA, 19 nt, Artificial Sequence
  Synthetic
gcaaguaugguguguggau

SEQ ID NO: 4960 - RNA, 20 nt, Artificial Sequence
  Synthetic
ggcaaguaugguguguggau

SEQ ID NO: 4961 - RNA, 21 nt, Artificial Sequence
  Synthetic
uggcaaguaugguguguggau

SEQ ID NO: 4962 - RNA, 22 nt, Artificial Sequence
  Synthetic
cuggcaaguaugguguguggau

SEQ ID NO: 4963 - RNA, 23 nt, Artificial Sequence
  Synthetic
acuggcaaguaugguguguggau

SEQ ID NO: 4964 - RNA, 24 nt, Artificial Sequence
  Synthetic
uacuggcaaguaugguguguggau

SEQ ID NO: 4965 - RNA, 18 nt, Artificial Sequence
  Synthetic
uucaaguuuucuugugau

SEQ ID NO: 4966 - RNA, 19 nt, Artificial Sequence
  Synthetic
guucaaguuuucuugugau

SEQ ID NO: 4967 - RNA, 20 nt, Artificial Sequence
  Synthetic
aguucaaguuuucuugugau

SEQ ID NO: 4968 - RNA, 21 nt, Artificial Sequence
  Synthetic
uaguucaaguuuucuugugau

SEQ ID NO: 4969 - RNA, 22 nt, Artificial Sequence
  Synthetic
auaguucaaguuuucuugugau

SEQ ID NO: 4970 - RNA, 23 nt, Artificial Sequence
  Synthetic
cauaguucaaguuuucuugugau

SEQ ID NO: 4971 - RNA, 24 nt, Artificial Sequence
  Synthetic
acauaguucaaguuuucuugugau

SEQ ID NO: 4972 - RNA, 18 nt, Artificial Sequence
  Synthetic
cgggugcugugguguacu

SEQ ID NO: 4973 - RNA, 19 nt, Artificial Sequence
  Synthetic
acgggugcugugguguacu

SEQ ID NO: 4974 - RNA, 21 nt, Artificial Sequence
  Synthetic
gcacgggugcugugguguacu

SEQ ID NO: 4975 - RNA, 22 nt, Artificial Sequence
  Synthetic
agcacgggugcugugguguacu

SEQ ID NO: 4976 - RNA, 23 nt, Artificial Sequence
  Synthetic
aagcacgggugcugugguguacu

SEQ ID NO: 4977 - RNA, 24 nt, Artificial Sequence
  Synthetic
aaagcacgggugcugugguguacu

SEQ ID NO: 4978 - RNA, 18 nt, Artificial Sequence
  Synthetic
uggaacucgaacaaaccu

SEQ ID NO: 4979 - RNA, 19 nt, Artificial Sequence
  Synthetic
cuggaacucgaacaaaccu

SEQ ID NO: 4980 - RNA, 21 nt, Artificial Sequence
  Synthetic
aucuggaacucgaacaaaccu

SEQ ID NO: 4981 - RNA, 22 nt, Artificial Sequence
  Synthetic
aaucuggaacucgaacaaaccu

SEQ ID NO: 4982 - RNA, 23 nt, Artificial Sequence
  Synthetic
gaaucuggaacucgaacaaaccu

SEQ ID NO: 4983 - RNA, 24 nt, Artificial Sequence
  Synthetic
agaaucuggaacucgaacaaaccu

SEQ ID NO: 4984 - RNA, 18 nt, Artificial Sequence
  Synthetic
gagaugcucagggcuccu

SEQ ID NO: 4985 - RNA, 19 nt, Artificial Sequence
  Synthetic
ggagaugcucagggcuccu

SEQ ID NO: 4986 - RNA, 21 nt, Artificial Sequence
  Synthetic
aaggagaugcucagggcuccu

SEQ ID NO: 4987 - RNA, 22 nt, Artificial Sequence
  Synthetic
gaaggagaugcucagggcuccu

SEQ ID NO: 4988 - RNA, 23 nt, Artificial Sequence
  Synthetic
agaaggagaugcucagggcuccu

SEQ ID NO: 4989 - RNA, 24 nt, Artificial Sequence
  Synthetic
cagaaggagaugcucagggcuccu

SEQ ID NO: 4990 - RNA, 18 nt, Artificial Sequence
  Synthetic
aggagagccucucacgcu

SEQ ID NO: 4991 - RNA, 19 nt, Artificial Sequence
  Synthetic
uaggagagccucucacgcu

SEQ ID NO: 4992 - RNA, 20 nt, Artificial Sequence
  Synthetic
guaggagagccucucacgcu

SEQ ID NO: 4993 - RNA, 21 nt, Artificial Sequence
  Synthetic
gguaggagagccucucacgcu

SEQ ID NO: 4994 - RNA, 22 nt, Artificial Sequence
  Synthetic
ggguaggagagccucucacgcu

SEQ ID NO: 4995 - RNA, 23 nt, Artificial Sequence
  Synthetic
uggguaggagagccucucacgcu

SEQ ID NO: 4996 - RNA, 24 nt, Artificial Sequence
  Synthetic
uuggguaggagagccucucacgcu

SEQ ID NO: 4997 - RNA, 18 nt, Artificial Sequence
  Synthetic
ccaggagguagcaaggcu

SEQ ID NO: 4998 - RNA, 19 nt, Artificial Sequence
  Synthetic
gccaggagguagcaaggcu

SEQ ID NO: 4999 - RNA, 21 nt, Artificial Sequence
  Synthetic
cagccaggagguagcaaggcu

SEQ ID NO: 5000 - RNA, 22 nt, Artificial Sequence
  Synthetic
gcagccaggagguagcaaggcu

SEQ ID NO: 5001 - RNA, 23 nt, Artificial Sequence
  Synthetic
agcagccaggagguagcaaggcu

SEQ ID NO: 5002 - RNA, 24 nt, Artificial Sequence
  Synthetic
cagcagccaggagguagcaaggcu

SEQ ID NO: 5003 - RNA, 18 nt, Artificial Sequence
  Synthetic
accgagacagugaaggcu

SEQ ID NO: 5004 - RNA, 19 nt, Artificial Sequence
  Synthetic
uaccgagacagugaaggcu

SEQ ID NO: 5005 - RNA, 21 nt, Artificial Sequence
  Synthetic
aauaccgagacagugaaggcu

SEQ ID NO: 5006 - RNA, 22 nt, Artificial Sequence
  Synthetic
gaauaccgagacagugaaggcu

SEQ ID NO: 5007 - RNA, 23 nt, Artificial Sequence
  Synthetic
ugaauaccgagacagugaaggcu

SEQ ID NO: 5008 - RNA, 24 nt, Artificial Sequence
  Synthetic
cugaauaccgagacagugaaggcu

SEQ ID NO: 5009 - RNA, 18 nt, Artificial Sequence
  Synthetic
auggcagaaggagaugcu

SEQ ID NO: 5010 - RNA, 19 nt, Artificial Sequence
  Synthetic
aauggcagaaggagaugcu

SEQ ID NO: 5011 - RNA, 21 nt, Artificial Sequence
  Synthetic
gcaauggcagaaggagaugcu

SEQ ID NO: 5012 - RNA, 22 nt, Artificial Sequence
  Synthetic
ggcaauggcagaaggagaugcu

SEQ ID NO: 5013 - RNA, 23 nt, Artificial Sequence
  Synthetic
aggcaauggcagaaggagaugcu

SEQ ID NO: 5014 - RNA, 24 nt, Artificial Sequence
  Synthetic
caggcaauggcagaaggagaugcu

SEQ ID NO: 5015 - RNA, 18 nt, Artificial Sequence
  Synthetic
gagcccaucuggcuaucu

SEQ ID NO: 5016 - RNA, 19 nt, Artificial Sequence
  Synthetic
agagcccaucuggcuaucu

SEQ ID NO: 5017 - RNA, 20 nt, Artificial Sequence
  Synthetic
gagagcccaucuggcuaucu

SEQ ID NO: 5018 - RNA, 21 nt, Artificial Sequence
  Synthetic
ggagagcccaucuggcuaucu

SEQ ID NO: 5019 - RNA, 22 nt, Artificial Sequence
  Synthetic
aggagagcccaucuggcuaucu

SEQ ID NO: 5020 - RNA, 23 nt, Artificial Sequence
  Synthetic
aaggagagcccaucuggcuaucu

SEQ ID NO: 5021 - RNA, 24 nt, Artificial Sequence
  Synthetic
gaaggagagcccaucuggcuaucu

SEQ ID NO: 5022 - RNA, 18 nt, Artificial Sequence
  Synthetic
auucaggaauuguagucu

SEQ ID NO: 5023 - RNA, 19 nt, Artificial Sequence
  Synthetic
uauucaggaauuguagucu

SEQ ID NO: 5024 - RNA, 21 nt, Artificial Sequence
  Synthetic
acuauucaggaauuguagucu

SEQ ID NO: 5025 - RNA, 22 nt, Artificial Sequence
  Synthetic
aacuauucaggaauuguagucu

SEQ ID NO: 5026 - RNA, 23 nt, Artificial Sequence
  Synthetic
uaacuauucaggaauuguagucu

SEQ ID NO: 5027 - RNA, 24 nt, Artificial Sequence
  Synthetic
cuaacuauucaggaauuguagucu

SEQ ID NO: 5028 - RNA, 18 nt, Artificial Sequence
  Synthetic
ccuuccaggaacugaagu

SEQ ID NO: 5029 - RNA, 19 nt, Artificial Sequence
  Synthetic
gccuuccaggaacugaagu

SEQ ID NO: 5030 - RNA, 20 nt, Artificial Sequence
  Synthetic
ggccuuccaggaacugaagu

SEQ ID NO: 5031 - RNA, 21 nt, Artificial Sequence
  Synthetic
uggccuuccaggaacugaagu

SEQ ID NO: 5032 - RNA, 22 nt, Artificial Sequence
  Synthetic
uuggccuuccaggaacugaagu

SEQ ID NO: 5033 - RNA, 23 nt, Artificial Sequence
  Synthetic
uuuggccuuccaggaacugaagu

SEQ ID NO: 5034 - RNA, 24 nt, Artificial Sequence
  Synthetic
cuuuggccuuccaggaacugaagu

SEQ ID NO: 5035 - RNA, 18 nt, Artificial Sequence
  Synthetic
aagguaagaaugcagagu

SEQ ID NO: 5036 - RNA, 19 nt, Artificial Sequence
  Synthetic
gaagguaagaaugcagagu

SEQ ID NO: 5037 - RNA, 21 nt, Artificial Sequence
  Synthetic
gagaagguaagaaugcagagu

SEQ ID NO: 5038 - RNA, 22 nt, Artificial Sequence
  Synthetic
agagaagguaagaaugcagagu

SEQ ID NO: 5039 - RNA, 23 nt, Artificial Sequence
  Synthetic
cagagaagguaagaaugcagagu

SEQ ID NO: 5040 - RNA, 24 nt, Artificial Sequence
  Synthetic
ccagagaagguaagaaugcagagu

SEQ ID NO: 5041 - RNA, 18 nt, Artificial Sequence
  Synthetic
cuauucaggaauuguagu

SEQ ID NO: 5042 - RNA, 19 nt, Artificial Sequence
  Synthetic
acuauucaggaauuguagu

SEQ ID NO: 5043 - RNA, 21 nt, Artificial Sequence
  Synthetic
uaacuauucaggaauuguagu

SEQ ID NO: 5044 - RNA, 22 nt, Artificial Sequence
  Synthetic
cuaacuauucaggaauuguagu

SEQ ID NO: 5045 - RNA, 23 nt, Artificial Sequence
  Synthetic
ucuaacuauucaggaauuguagu

SEQ ID NO: 5046 - RNA, 24 nt, Artificial Sequence
  Synthetic
aucuaacuauucaggaauuguagu

SEQ ID NO: 5047 - RNA, 18 nt, Artificial Sequence
  Synthetic
ggagagggagacaccggu

SEQ ID NO: 5048 - RNA, 19 nt, Artificial Sequence
  Synthetic
uggagagggagacaccggu

SEQ ID NO: 5049 - RNA, 20 nt, Artificial Sequence
  Synthetic
guggagagggagacaccggu

SEQ ID NO: 5050 - RNA, 21 nt, Artificial Sequence
  Synthetic
aguggagagggagacaccggu

SEQ ID NO: 5051 - RNA, 22 nt, Artificial Sequence
  Synthetic
gaguggagagggagacaccggu

SEQ ID NO: 5052 - RNA, 23 nt, Artificial Sequence
  Synthetic
ggaguggagagggagacaccggu

SEQ ID NO: 5053 - RNA, 24 nt, Artificial Sequence
  Synthetic
aggaguggagagggagacaccggu

SEQ ID NO: 5054 - RNA, 18 nt, Artificial Sequence
  Synthetic
uggagaacuaguuugggu

SEQ ID NO: 5055 - RNA, 19 nt, Artificial Sequence
  Synthetic
guggagaacuaguuugggu

SEQ ID NO: 5056 - RNA, 21 nt, Artificial Sequence
  Synthetic
auguggagaacuaguuugggu

SEQ ID NO: 5057 - RNA, 22 nt, Artificial Sequence
  Synthetic
gauguggagaacuaguuugggu

SEQ ID NO: 5058 - RNA, 23 nt, Artificial Sequence
  Synthetic
ggauguggagaacuaguuugggu

SEQ ID NO: 5059 - RNA, 24 nt, Artificial Sequence
  Synthetic
aggauguggagaacuaguuugggu

SEQ ID NO: 5060 - RNA, 18 nt, Artificial Sequence
  Synthetic
guuccugcuucccgaauu

SEQ ID NO: 5061 - RNA, 19 nt, Artificial Sequence
  Synthetic
aguuccugcuucccgaauu

SEQ ID NO: 5062 - RNA, 20 nt, Artificial Sequence
  Synthetic
aaguuccugcuucccgaauu

SEQ ID NO: 5063 - RNA, 21 nt, Artificial Sequence
  Synthetic
gaaguuccugcuucccgaauu

SEQ ID NO: 5064 - RNA, 22 nt, Artificial Sequence
  Synthetic
ugaaguuccugcuucccgaauu

SEQ ID NO: 5065 - RNA, 23 nt, Artificial Sequence
  Synthetic
cugaaguuccugcuucccgaauu

SEQ ID NO: 5066 - RNA, 24 nt, Artificial Sequence
  Synthetic
acugaaguuccugcuucccgaauu

SEQ ID NO: 5067 - RNA, 18 nt, Artificial Sequence
  Synthetic
cacauaacccuuuacauu

SEQ ID NO: 5068 - RNA, 19 nt, Artificial Sequence
  Synthetic
ucacauaacccuuuacauu

SEQ ID NO: 5069 - RNA, 20 nt, Artificial Sequence
  Synthetic
cucacauaacccuuuacauu

SEQ ID NO: 5070 - RNA, 21 nt, Artificial Sequence
  Synthetic
ucucacauaacccuuuacauu

SEQ ID NO: 5071 - RNA, 22 nt, Artificial Sequence
  Synthetic
gucucacauaacccuuuacauu

SEQ ID NO: 5072 - RNA, 23 nt, Artificial Sequence
  Synthetic
ggucucacauaacccuuuacauu

SEQ ID NO: 5073 - RNA, 24 nt, Artificial Sequence
  Synthetic
gggucucacauaacccuuuacauu

SEQ ID NO: 5074 - RNA, 18 nt, Artificial Sequence
  Synthetic
ucaaguuuucuugugauu

SEQ ID NO: 5075 - RNA, 19 nt, Artificial Sequence
  Synthetic
uucaaguuuucuugugauu

SEQ ID NO: 5076 - RNA, 21 nt, Artificial Sequence
  Synthetic
aguucaaguuuucuugugauu

SEQ ID NO: 5077 - RNA, 22 nt, Artificial Sequence
  Synthetic
uaguucaaguuuucuugugauu

SEQ ID NO: 5078 - RNA, 23 nt, Artificial Sequence
  Synthetic
auaguucaaguuuucuugugauu

SEQ ID NO: 5079 - RNA, 24 nt, Artificial Sequence
  Synthetic
cauaguucaaguuuucuugugauu

SEQ ID NO: 5080 - RNA, 18 nt, Artificial Sequence
  Synthetic
ggucaccaucuaacuauu

SEQ ID NO: 5081 - RNA, 19 nt, Artificial Sequence
  Synthetic
uggucaccaucuaacuauu

SEQ ID NO: 5082 - RNA, 21 nt, Artificial Sequence
  Synthetic
cauggucaccaucuaacuauu

SEQ ID NO: 5083 - RNA, 22 nt, Artificial Sequence
  Synthetic
acauggucaccaucuaacuauu

SEQ ID NO: 5084 - RNA, 23 nt, Artificial Sequence
  Synthetic
aacauggucaccaucuaacuauu

SEQ ID NO: 5085 - RNA, 24 nt, Artificial Sequence
  Synthetic
gaacauggucaccaucuaacuauu

SEQ ID NO: 5086 - RNA, 18 nt, Artificial Sequence
  Synthetic
uaucuucugucagcauuu

SEQ ID NO: 5087 - RNA, 19 nt, Artificial Sequence
  Synthetic
uuaucuucugucagcauuu

SEQ ID NO: 5088 - RNA, 20 nt, Artificial Sequence
  Synthetic
uuuaucuucugucagcauuu

SEQ ID NO: 5089 - RNA, 21 nt, Artificial Sequence
  Synthetic
cuuuaucuucugucagcauuu

SEQ ID NO: 5090 - RNA, 22 nt, Artificial Sequence
  Synthetic
ccuuuaucuucugucagcauuu

SEQ ID NO: 5091 - RNA, 23 nt, Artificial Sequence
  Synthetic
uccuuuaucuucugucagcauuu

SEQ ID NO: 5092 - RNA, 24 nt, Artificial Sequence
  Synthetic
auccuuuaucuucugucagcauuu

SEQ ID NO: 5093 - RNA, 18 nt, Artificial Sequence
  Synthetic
uucucuuccuugaacuuu

SEQ ID NO: 5094 - RNA, 19 nt, Artificial Sequence
  Synthetic
guucucuuccuugaacuuu

SEQ ID NO: 5095 - RNA, 20 nt, Artificial Sequence
  Synthetic
cguucucuuccuugaacuuu

SEQ ID NO: 5096 - RNA, 21 nt, Artificial Sequence
  Synthetic
acguucucuuccuugaacuuu

SEQ ID NO: 5097 - RNA, 22 nt, Artificial Sequence
  Synthetic
aacguucucuuccuugaacuuu

SEQ ID NO: 5098 - RNA, 23 nt, Artificial Sequence
  Synthetic
caacguucucuuccuugaacuuu

SEQ ID NO: 5099 - RNA, 24 nt, Artificial Sequence
  Synthetic
ccaacguucucuuccuugaacuuu

SEQ ID NO: 5100 - RNA, 17 nt, Artificial Sequence
  Synthetic
gaugccagcuguccagc

SEQ ID NO: 5101 - RNA, 20 nt, Artificial Sequence
  Synthetic
gcacagaagaaccucauugc

SEQ ID NO: 5102 - RNA, 20 nt, Artificial Sequence
  Synthetic
gguucuucugugcacguugc

SEQ ID NO: 5103 - RNA, 17 nt, Artificial Sequence
  Synthetic
agagagacagcagcacc

SEQ ID NO: 5104 - RNA, 17 nt, Artificial Sequence
  Synthetic
cagaagaaccucauugc

SEQ ID NO: 5105 - RNA, 17 nt, Artificial Sequence
  Synthetic
ucuucugugcacguugc

SEQ ID NO: 5106 - RNA, 17 nt, Artificial Sequence
  Synthetic
ucauugcagaggcuugg

SEQ ID NO: 5107 - RNA, 20 nt, Artificial Sequence
  Synthetic
uacagagagacagcagcacc

SEQ ID NO: 5108 - RNA, 20 nt, Artificial Sequence
  Synthetic
accucauugcagaggcuugg

SEQ ID NO: 5109 - RNA, 20 nt, Artificial Sequence
  Synthetic
gauucucauuuucuugccuu

SEQ ID NO: 5110 - RNA, 17 nt, Artificial Sequence
  Synthetic
ucucauuuucuugccuu

SEQ ID NO: 5111 - RNA, 20 nt, Artificial Sequence
  Synthetic
ugagaugccagcuguccagc

SEQ ID NO: 5112 - RNA, 17 nt, Artificial Sequence
  Synthetic
gcagaugcuaccgucaa

SEQ ID NO: 5113 - RNA, 17 nt, Artificial Sequence
  Synthetic
aagaugcauuuacuaca

SEQ ID NO: 5114 - RNA, 17 nt, Artificial Sequence
  Synthetic
cagccagccagggccca

SEQ ID NO: 5115 - RNA, 17 nt, Artificial Sequence
  Synthetic
gcuggccagaggagcua

SEQ ID NO: 5116 - RNA, 17 nt, Artificial Sequence
  Synthetic
cgaguacaccacagcac

SEQ ID NO: 5117 - RNA, 17 nt, Artificial Sequence
  Synthetic
ccuugcuaccuccuggc

SEQ ID NO: 5118 - RNA, 17 nt, Artificial Sequence
  Synthetic
uuacuacaguuggcuuc

SEQ ID NO: 5119 - RNA, 17 nt, Artificial Sequence
  Synthetic
ucugcuuccuuuagaag

SEQ ID NO: 5120 - RNA, 17 nt, Artificial Sequence
  Synthetic
cuguaaaugacccagag

SEQ ID NO: 5121 - RNA, 17 nt, Artificial Sequence
  Synthetic
ccuggguguagggguag

SEQ ID NO: 5122 - RNA, 17 nt, Artificial Sequence
  Synthetic
ccuucugccauugccug

SEQ ID NO: 5123 - RNA, 17 nt, Artificial Sequence
  Synthetic
gaaguuaugcuuuuuau

SEQ ID NO: 5124 - RNA, 17 nt, Artificial Sequence
  Synthetic
ugaaggcauuggcgacu

SEQ ID NO: 5125 - RNA, 17 nt, Artificial Sequence
  Synthetic
aagaaacuauuaugccu

SEQ ID NO: 5126 - RNA, 17 nt, Artificial Sequence
  Synthetic
uccgagcuaacugaagu

SEQ ID NO: 5127 - RNA, 17 nt, Artificial Sequence
  Synthetic
cauugccuguacagcuu

SEQ ID NO: 5128 - RNA, 17 nt, Artificial Sequence
  Synthetic
agggcccaggcagcuuu

SEQ ID NO: 5129 - RNA, 20 nt, Artificial Sequence
  Synthetic
ucagcagaugcuaccgucaa

SEQ ID NO: 5130 - RNA, 20 nt, Artificial Sequence
  Synthetic
aguaagaugcauuuacuaca

SEQ ID NO: 5131 - RNA, 20 nt, Artificial Sequence
  Synthetic
agccagccagccagggccca

SEQ ID NO: 5132 - RNA, 20 nt, Artificial Sequence
  Synthetic
gaugcuggccagaggagcua

SEQ ID NO: 5133 - RNA, 20 nt, Artificial Sequence
  Synthetic
ccccgaguacaccacagcac

SEQ ID NO: 5134 - RNA, 20 nt, Artificial Sequence
  Synthetic
cagccuugcuaccuccuggc

SEQ ID NO: 5135 - RNA, 20 nt, Artificial Sequence
  Synthetic
cauuuacuacaguuggcuuc

SEQ ID NO: 5136 - RNA, 20 nt, Artificial Sequence
  Synthetic
uauucugcuuccuuuagaag

SEQ ID NO: 5137 - RNA, 20 nt, Artificial Sequence
  Synthetic
gugcuguaaaugacccagag

SEQ ID NO: 5138 - RNA, 20 nt, Artificial Sequence
  Synthetic
ucuccuucugccauugccug

SEQ ID NO: 5139 - RNA, 20 nt, Artificial Sequence
  Synthetic
uuagaaguuaugcuuuuuau

SEQ ID NO: 5140 - RNA, 20 nt, Artificial Sequence
  Synthetic
ugaugaaggcauuggcgacu

SEQ ID NO: 5141 - RNA, 20 nt, Artificial Sequence
  Synthetic
aggaagaaacuauuaugccu

SEQ ID NO: 5142 - RNA, 20 nt, Artificial Sequence
  Synthetic
aaguccgagcuaacugaagu

SEQ ID NO: 5143 - RNA, 20 nt, Artificial Sequence
  Synthetic
ugccauugccuguacagcuu

SEQ ID NO: 5144 - RNA, 20 nt, Artificial Sequence
  Synthetic
gccagggcccaggcagcuuu

SEQ ID NO: 5145 - RNA, 17 nt, Artificial Sequence
  Synthetic
cuucccgugaaucgucc

SEQ ID NO: 5146 - RNA, 17 nt, Artificial Sequence
  Synthetic
uguccuuguguucuggc

SEQ ID NO: 5147 - RNA, 17 nt, Artificial Sequence
  Synthetic
cuugaagcccccggcag

SEQ ID NO: 5148 - RNA, 17 nt, Artificial Sequence
  Synthetic
acgauucacgggaagcg

SEQ ID NO: 5149 - RNA, 20 nt, Artificial Sequence
  Synthetic
ucgcuucccgugaaucgucc

SEQ ID NO: 5150 - RNA, 20 nt, Artificial Sequence
  Synthetic
cgauucacgggaagcgaggc

SEQ ID NO: 5151 - RNA, 20 nt, Artificial Sequence
  Synthetic
aggacgauucacgggaagcg

SEQ ID NO: 5152 - RNA, 17 nt, Artificial Sequence
  Synthetic
cagccagccagaacaca

SEQ ID NO: 5153 - RNA, 20 nt, Artificial Sequence
  Synthetic
uaacagccagccagaacaca

SEQ ID NO: 5154 - RNA, 20 nt, Artificial Sequence
  Synthetic
ugcuguccuuguguucuggc

SEQ ID NO: 5155 - RNA, 17 nt, Artificial Sequence
  Synthetic
gagcaaagguucaaaaa

SEQ ID NO: 5156 - RNA, 17 nt, Artificial Sequence
  Synthetic
aggauaguuuuucaaaa

SEQ ID NO: 5157 - RNA, 17 nt, Artificial Sequence
  Synthetic
ucacaguccauagcaaa

SEQ ID NO: 5158 - RNA, 17 nt, Artificial Sequence
  Synthetic
gucauuuuaacaucaaa

SEQ ID NO: 5159 - RNA, 17 nt, Artificial Sequence
  Synthetic
aaggauaguuuuucaaa

SEQ ID NO: 5160 - RNA, 17 nt, Artificial Sequence
  Synthetic
gcagucucuaggagaaa

SEQ ID NO: 5161 - RNA, 17 nt, Artificial Sequence
  Synthetic
gcaaaaggagaaauaaa

SEQ ID NO: 5162 - RNA, 17 nt, Artificial Sequence
  Synthetic
aauaacaaucugagcaa

SEQ ID NO: 5163 - RNA, 17 nt, Artificial Sequence
  Synthetic
ugcagucucuaggagaa

SEQ ID NO: 5164 - RNA, 17 nt, Artificial Sequence
  Synthetic
gacugugaaaacugaca

SEQ ID NO: 5165 - RNA, 17 nt, Artificial Sequence
  Synthetic
aggagaaagggcaggca

SEQ ID NO: 5166 - RNA, 17 nt, Artificial Sequence
  Synthetic
gugaaaacugacaugga

SEQ ID NO: 5167 - RNA, 17 nt, Artificial Sequence
  Synthetic
uuacuaguaauacuuga

SEQ ID NO: 5168 - RNA, 17 nt, Artificial Sequence
  Synthetic
gaguucagcaggugaua

SEQ ID NO: 5169 - RNA, 17 nt, Artificial Sequence
  Synthetic
caguuguuuuaaagcua

SEQ ID NO: 5170 - RNA, 17 nt, Artificial Sequence
  Synthetic
uauuucuccuuuugcua

SEQ ID NO: 5171 - RNA, 17 nt, Artificial Sequence
  Synthetic
acaagacagaugaauua

SEQ ID NO: 5172 - RNA, 17 nt, Artificial Sequence
  Synthetic
gguaaugacaaaaucac

SEQ ID NO: 5173 - RNA, 17 nt, Artificial Sequence
  Synthetic
aggagaaauaaaaggac

SEQ ID NO: 5174 - RNA, 17 nt, Artificial Sequence
  Synthetic
ucguagugaccugcuac

SEQ ID NO: 5175 - RNA, 17 nt, Artificial Sequence
  Synthetic
ugcagacacaucucacc

SEQ ID NO: 5176 - RNA, 17 nt, Artificial Sequence
  Synthetic
ggagaaauaaaaggacc

SEQ ID NO: 5177 - RNA, 17 nt, Artificial Sequence
  Synthetic
gggcaggcagggaggcc

SEQ ID NO: 5178 - RNA, 17 nt, Artificial Sequence
  Synthetic
ccugcuacaggcgcucc

SEQ ID NO: 5179 - RNA, 17 nt, Artificial Sequence
  Synthetic
gggacucugaguucagc

SEQ ID NO: 5180 - RNA, 17 nt, Artificial Sequence
  Synthetic
ccuggagcgccuguagc

SEQ ID NO: 5181 - RNA, 17 nt, Artificial Sequence
  Synthetic
uaggagaaagggcaggc

SEQ ID NO: 5182 - RNA, 17 nt, Artificial Sequence
  Synthetic
ucucuaggagaaagggc

SEQ ID NO: 5183 - RNA, 17 nt, Artificial Sequence
  Synthetic
aaaaguuuaacaaucuc

SEQ ID NO: 5184 - RNA, 17 nt, Artificial Sequence
  Synthetic
aucuaaaugaagcucuc

SEQ ID NO: 5185 - RNA, 17 nt, Artificial Sequence
  Synthetic
ugaaaacugacauggag

SEQ ID NO: 5186 - RNA, 17 nt, Artificial Sequence
  Synthetic
aguuguuuuaaagcuag

SEQ ID NO: 5187 - RNA, 17 nt, Artificial Sequence
  Synthetic
agcuucauuuagauuag

SEQ ID NO: 5188 - RNA, 17 nt, Artificial Sequence
  Synthetic
agaaagggcaggcaggg

SEQ ID NO: 5189 - RNA, 17 nt, Artificial Sequence
  Synthetic
ugugaaaacugacaugg

SEQ ID NO: 5190 - RNA, 17 nt, Artificial Sequence
  Synthetic
cuagcugugcagucucu

SEQ ID NO: 5191 - RNA, 20 nt, Artificial Sequence
  Synthetic
ucugagcaaagguucaaaaa

SEQ ID NO: 5192 - RNA, 20 nt, Artificial Sequence
  Synthetic
aaaaggauaguuuuucaaaa

SEQ ID NO: 5193 - RNA, 20 nt, Artificial Sequence
  Synthetic
uuuucacaguccauagcaaa

SEQ ID NO: 5194 - RNA, 20 nt, Artificial Sequence
  Synthetic
aaggucauuuuaacaucaaa

SEQ ID NO: 5195 - RNA, 20 nt, Artificial Sequence
  Synthetic
aaaaaggauaguuuuucaaa

SEQ ID NO: 5196 - RNA, 20 nt, Artificial Sequence
  Synthetic
ugugcagucucuaggagaaa

SEQ ID NO: 5197 - RNA, 20 nt, Artificial Sequence
  Synthetic
auagcaaaaggagaaauaaa

SEQ ID NO: 5198 - RNA, 20 nt, Artificial Sequence
  Synthetic
acaaauaacaaucugagcaa

SEQ ID NO: 5199 - RNA, 20 nt, Artificial Sequence
  Synthetic
cugugcagucucuaggagaa

SEQ ID NO: 5200 - RNA, 20 nt, Artificial Sequence
  Synthetic
auggacugugaaaacugaca

SEQ ID NO: 5201 - RNA, 20 nt, Artificial Sequence
  Synthetic
ucuaggagaaagggcaggca

SEQ ID NO: 5202 - RNA, 20 nt, Artificial Sequence
  Synthetic
acugugaaaacugacaugga

SEQ ID NO: 5203 - RNA, 20 nt, Artificial Sequence
  Synthetic
aaauuacuaguaauacuuga

SEQ ID NO: 5204 - RNA, 20 nt, Artificial Sequence
  Synthetic
ucugaguucagcaggugaua

SEQ ID NO: 5205 - RNA, 20 nt, Artificial Sequence
  Synthetic
acacaguuguuuuaaagcua

SEQ ID NO: 5206 - RNA, 20 nt, Artificial Sequence
  Synthetic
uuuuauuucuccuuuugcua

SEQ ID NO: 5207 - RNA, 20 nt, Artificial Sequence
  Synthetic
agcacaagacagaugaauua

SEQ ID NO: 5208 - RNA, 20 nt, Artificial Sequence
  Synthetic
auugguaaugacaaaaucac

SEQ ID NO: 5209 - RNA, 20 nt, Artificial Sequence
  Synthetic
aaaaggagaaauaaaaggac

SEQ ID NO: 5210 - RNA, 20 nt, Artificial Sequence
  Synthetic
ggcucguagugaccugcuac

SEQ ID NO: 5211 - RNA, 20 nt, Artificial Sequence
  Synthetic
auaugcagacacaucucacc

SEQ ID NO: 5212 - RNA, 20 nt, Artificial Sequence
  Synthetic
aaaggagaaauaaaaggacc

SEQ ID NO: 5213 - RNA, 20 nt, Artificial Sequence
  Synthetic
aaagggcaggcagggaggcc

SEQ ID NO: 5214 - RNA, 20 nt, Artificial Sequence
  Synthetic
ugaccugcuacaggcgcucc

SEQ ID NO: 5215 - RNA, 20 nt, Artificial Sequence
  Synthetic
ggggggacucugaguucagc

SEQ ID NO: 5216 - RNA, 20 nt, Artificial Sequence
  Synthetic
aggccuggagcgccuguagc

SEQ ID NO: 5217 - RNA, 20 nt, Artificial Sequence
  Synthetic
cucuaggagaaagggcaggc

SEQ ID NO: 5218 - RNA, 20 nt, Artificial Sequence
  Synthetic
cagucucuaggagaaagggc

SEQ ID NO: 5219 - RNA, 20 nt, Artificial Sequence
  Synthetic
gugaaaaguuuaacaaucuc

SEQ ID NO: 5220 - RNA, 20 nt, Artificial Sequence
  Synthetic
cuaaucuaaaugaagcucuc

SEQ ID NO: 5221 - RNA, 20 nt, Artificial Sequence
  Synthetic
cugugaaaacugacauggag

SEQ ID NO: 5222 - RNA, 20 nt, Artificial Sequence
  Synthetic
cacaguuguuuuaaagcuag

SEQ ID NO: 5223 - RNA, 20 nt, Artificial Sequence
  Synthetic
gagagcuucauuuagauuag

SEQ ID NO: 5224 - RNA, 20 nt, Artificial Sequence
  Synthetic
aggagaaagggcaggcaggg

SEQ ID NO: 5225 - RNA, 20 nt, Artificial Sequence
  Synthetic
gacugugaaaacugacaugg

SEQ ID NO: 5226 - RNA, 20 nt, Artificial Sequence
  Synthetic
gugcuagcugugcagucucu

SEQ ID NO: 5227 - RNA, 18 nt, Artificial Sequence
  Synthetic
gaaagcaacaggucccua

SEQ ID NO: 5228 - RNA, 24 nt, Artificial Sequence
  Synthetic
gaaauagaaagcaacaggucccua

SEQ ID NO: 5229 - RNA, 21 nt, Artificial Sequence
  Synthetic
gcuagggagguggccuuguua

SEQ ID NO: 5230 - RNA, 23 nt, Artificial Sequence
  Synthetic
gcgcuagggagguggccuuguua

SEQ ID NO: 5231 - RNA, 24 nt, Artificial Sequence
  Synthetic
ggcgcuagggagguggccuuguua

SEQ ID NO: 5232 - RNA, 24 nt, Artificial Sequence
  Synthetic
gacuacuggugugcugauuucaac

SEQ ID NO: 5233 - RNA, 22 nt, Artificial Sequence
  Synthetic
guugcucaggacacccaggacc

SEQ ID NO: 5234 - RNA, 23 nt, Artificial Sequence
  Synthetic
gguugcucaggacacccaggacc

SEQ ID NO: 5235 - RNA, 18 nt, Artificial Sequence
  Synthetic
gaaaacccaugcacaccc

SEQ ID NO: 5236 - RNA, 19 nt, Artificial Sequence
  Synthetic
ggaaaacccaugcacaccc

SEQ ID NO: 5237 - RNA, 22 nt, Artificial Sequence
  Synthetic
gaaggaaaacccaugcacaccc

SEQ ID NO: 5238 - RNA, 24 nt, Artificial Sequence
  Synthetic
gugaaggaaaacccaugcacaccc

SEQ ID NO: 5239 - RNA, 19 nt, Artificial Sequence
  Synthetic
gacuccagucacuucuucc

SEQ ID NO: 5240 - RNA, 24 nt, Artificial Sequence
  Synthetic
gaaaagacuccagucacuucuucc

SEQ ID NO: 5241 - RNA, 22 nt, Artificial Sequence
  Synthetic
gcucugcugugcugagaggugc

SEQ ID NO: 5242 - RNA, 21 nt, Artificial Sequence
  Synthetic
gacagagguggccacgugagg

SEQ ID NO: 5243 - RNA, 24 nt, Artificial Sequence
  Synthetic
gaagacagagguggccacgugagg

SEQ ID NO: 5244 - RNA, 18 nt, Artificial Sequence
  Synthetic
gugcugagaggugccugg

SEQ ID NO: 5245 - RNA, 21 nt, Artificial Sequence
  Synthetic
gcugugcugagaggugccugg

SEQ ID NO: 5246 - RNA, 21 nt, Artificial Sequence
  Synthetic
gguucucaaugaguuugcaga

SEQ ID NO: 5247 - RNA, 24 nt, Artificial Sequence
  Synthetic
gcagguucucaaugaguuugcaga

SEQ ID NO: 5248 - RNA, 19 nt, Artificial Sequence
  Synthetic
gaagaagucuauuucauga

SEQ ID NO: 5249 - RNA, 21 nt, Artificial Sequence
  Synthetic
gagaagaagucuauuucauga

SEQ ID NO: 5250 - RNA, 22 nt, Artificial Sequence
  Synthetic
ggagaagaagucuauuucauga

SEQ ID NO: 5251 - RNA, 24 nt, Artificial Sequence
  Synthetic
gaggagaagaagucuauuucauga

SEQ ID NO: 5252 - RNA, 19 nt, Artificial Sequence
  Synthetic
guggggacgcuggggcuga

SEQ ID NO: 5253 - RNA, 21 nt, Artificial Sequence
  Synthetic
gaguggggacgcuggggcuga

SEQ ID NO: 5254 - RNA, 22 nt, Artificial Sequence
  Synthetic
ggaguggggacgcuggggcuga

SEQ ID NO: 5255 - RNA, 23 nt, Artificial Sequence
  Synthetic
gggaguggggacgcuggggcuga

SEQ ID NO: 5256 - RNA, 18 nt, Artificial Sequence
  Synthetic
gcauucauugacaauuua

SEQ ID NO: 5257 - RNA, 19 nt, Artificial Sequence
  Synthetic
ggcauucauugacaauuua

SEQ ID NO: 5258 - RNA, 22 nt, Artificial Sequence
  Synthetic
guuaauucacggaagaagugac

SEQ ID NO: 5259 - RNA, 18 nt, Artificial Sequence
  Synthetic
gggagcccugcaagcacc

SEQ ID NO: 5260 - RNA, 19 nt, Artificial Sequence
  Synthetic
ggggagcccugcaagcacc

SEQ ID NO: 5261 - RNA, 23 nt, Artificial Sequence
  Synthetic
gcugggggagcccugcaagcacc

SEQ ID NO: 5262 - RNA, 23 nt, Artificial Sequence
  Synthetic
gcagcuggccugccucgcuuccc

SEQ ID NO: 5263 - RNA, 18 nt, Artificial Sequence
  Synthetic
gcccggaggcccccaagc

SEQ ID NO: 5264 - RNA, 23 nt, Artificial Sequence
  Synthetic
gcuguuaaaauuccagggugugc

SEQ ID NO: 5265 - RNA, 21 nt, Artificial Sequence
  Synthetic
gcccugcaagcacccgggguc

SEQ ID NO: 5266 - RNA, 23 nt, Artificial Sequence
  Synthetic
gagcccugcaagcacccgggguc

SEQ ID NO: 5267 - RNA, 24 nt, Artificial Sequence
  Synthetic
ggagcccugcaagcacccgggguc

SEQ ID NO: 5268 - RNA, 21 nt, Artificial Sequence
  Synthetic
gaaaggggccuccacguccag

SEQ ID NO: 5269 - RNA, 22 nt, Artificial Sequence
  Synthetic
ggaaaggggccuccacguccag

SEQ ID NO: 5270 - RNA, 23 nt, Artificial Sequence
  Synthetic
gggaaaggggccuccacguccag

SEQ ID NO: 5271 - RNA, 19 nt, Artificial Sequence
  Synthetic
gagggaaacuagucuaacg

SEQ ID NO: 5272 - RNA, 21 nt, Artificial Sequence
  Synthetic
gagagggaaacuagucuaacg

SEQ ID NO: 5273 - RNA, 22 nt, Artificial Sequence
  Synthetic
ggagagggaaacuagucuaacg

SEQ ID NO: 5274 - RNA, 18 nt, Artificial Sequence
  Synthetic
gaaauaaacaccaucuug

SEQ ID NO: 5275 - RNA, 19 nt, Artificial Sequence
  Synthetic
ggaaauaaacaccaucuug

SEQ ID NO: 5276 - RNA, 23 nt, Artificial Sequence
  Synthetic
gaaaggaaauaaacaccaucuug

SEQ ID NO: 5277 - RNA, 22 nt, Artificial Sequence
  Synthetic
gugcagguucucaaugaguuug

SEQ ID NO: 5278 - RNA, 18 nt, Artificial Sequence
  Synthetic
ggguaugggugcauaaau

SEQ ID NO: 5279 - RNA, 19 nt, Artificial Sequence
  Synthetic
gggguaugggugcauaaau

SEQ ID NO: 5280 - RNA, 19 nt, Artificial Sequence
  Synthetic
gagauauaggaacuauuau

SEQ ID NO: 5281 - RNA, 22 nt, Artificial Sequence
  Synthetic
guggagauauaggaacuauuau

SEQ ID NO: 5282 - RNA, 23 nt, Artificial Sequence
  Synthetic
gguggagauauaggaacuauuau

SEQ ID NO: 5283 - RNA, 22 nt, Artificial Sequence
  Synthetic
guucaguguuguucacggggcu

SEQ ID NO: 5284 - RNA, 22 nt, Artificial Sequence
  Synthetic
gacuucuggaagguuauuuucu

SEQ ID NO: 5285 - RNA, 23 nt, Artificial Sequence
  Synthetic
gauauaggaacuauuauuggggu

SEQ ID NO: 5286 - RNA, 21 nt, Artificial Sequence
  Synthetic
gcuacgucuuaaaggacuugu

SEQ ID NO: 5287 - RNA, 18 nt, Artificial Sequence
  Synthetic
uucuggagccuggagcca

SEQ ID NO: 5288 - RNA, 19 nt, Artificial Sequence
  Synthetic
uuucuggagccuggagcca

SEQ ID NO: 5289 - RNA, 21 nt, Artificial Sequence
  Synthetic
ccuuucuggagccuggagcca

SEQ ID NO: 5290 - RNA, 22 nt, Artificial Sequence
  Synthetic
uccuuucuggagccuggagcca

SEQ ID NO: 5291 - RNA, 23 nt, Artificial Sequence
  Synthetic
uuccuuucuggagccuggagcca

SEQ ID NO: 5292 - RNA, 24 nt, Artificial Sequence
  Synthetic
uuuccuuucuggagccuggagcca

SEQ ID NO: 5293 - RNA, 19 nt, Artificial Sequence
  Synthetic
agaaagcaacaggucccua

SEQ ID NO: 5294 - RNA, 21 nt, Artificial Sequence
  Synthetic
auagaaagcaacaggucccua

SEQ ID NO: 5295 - RNA, 22 nt, Artificial Sequence
  Synthetic
aauagaaagcaacaggucccua

SEQ ID NO: 5296 - RNA, 23 nt, Artificial Sequence
  Synthetic
aaauagaaagcaacaggucccua

SEQ ID NO: 5297 - RNA, 18 nt, Artificial Sequence
  Synthetic
agggagguggccuuguua

SEQ ID NO: 5298 - RNA, 19 nt, Artificial Sequence
  Synthetic
uagggagguggccuuguua

SEQ ID NO: 5299 - RNA, 22 nt, Artificial Sequence
  Synthetic
cgcuagggagguggccuuguua

SEQ ID NO: 5300 - RNA, 21 nt, Artificial Sequence
  Synthetic
uacuggugugcugauuucaac

SEQ ID NO: 5301 - RNA, 22 nt, Artificial Sequence
  Synthetic
cuacuggugugcugauuucaac

SEQ ID NO: 5302 - RNA, 23 nt, Artificial Sequence
  Synthetic
acuacuggugugcugauuucaac

SEQ ID NO: 5303 - RNA, 21 nt, Artificial Sequence
  Synthetic
uugcucaggacacccaggacc

SEQ ID NO: 5304 - RNA, 24 nt, Artificial Sequence
  Synthetic
agguugcucaggacacccaggacc

SEQ ID NO: 5305 - RNA, 21 nt, Artificial Sequence
  Synthetic
aaggaaaacccaugcacaccc

SEQ ID NO: 5306 - RNA, 23 nt, Artificial Sequence
  Synthetic
ugaaggaaaacccaugcacaccc

SEQ ID NO: 5307 - RNA, 18 nt, Artificial Sequence
  Synthetic
acuccagucacuucuucc

SEQ ID NO: 5308 - RNA, 21 nt, Artificial Sequence
  Synthetic
aagacuccagucacuucuucc

SEQ ID NO: 5309 - RNA, 22 nt, Artificial Sequence
  Synthetic
aaagacuccagucacuucuucc

SEQ ID NO: 5310 - RNA, 23 nt, Artificial Sequence
  Synthetic
aaaagacuccagucacuucuucc

SEQ ID NO: 5311 - RNA, 18 nt, Artificial Sequence
  Synthetic
ugcugugcugagaggugc

SEQ ID NO: 5312 - RNA, 19 nt, Artificial Sequence
  Synthetic
cugcugugcugagaggugc

SEQ ID NO: 5313 - RNA, 21 nt, Artificial Sequence
  Synthetic
cucugcugugcugagaggugc

SEQ ID NO: 5314 - RNA, 23 nt, Artificial Sequence
  Synthetic
agcucugcugugcugagaggugc

SEQ ID NO: 5315 - RNA, 24 nt, Artificial Sequence
  Synthetic
aagcucugcugugcugagaggugc

SEQ ID NO: 5316 - RNA, 18 nt, Artificial Sequence
  Synthetic
agagguggccacgugagg

SEQ ID NO: 5317 - RNA, 19 nt, Artificial Sequence
  Synthetic
cagagguggccacgugagg

SEQ ID NO: 5318 - RNA, 22 nt, Artificial Sequence
  Synthetic
agacagagguggccacgugagg

SEQ ID NO: 5319 - RNA, 23 nt, Artificial Sequence
  Synthetic
aagacagagguggccacgugagg

SEQ ID NO: 5320 - RNA, 18 nt, Artificial Sequence
  Synthetic
uugucaaugaaugccugg

SEQ ID NO: 5321 - RNA, 19 nt, Artificial Sequence
  Synthetic
auugucaaugaaugccugg

SEQ ID NO: 5322 - RNA, 21 nt, Artificial Sequence
  Synthetic
aaauugucaaugaaugccugg

SEQ ID NO: 5323 - RNA, 22 nt, Artificial Sequence
  Synthetic
uaaauugucaaugaaugccugg

SEQ ID NO: 5324 - RNA, 23 nt, Artificial Sequence
  Synthetic
auaaauugucaaugaaugccugg

SEQ ID NO: 5325 - RNA, 24 nt, Artificial Sequence
  Synthetic
aauaaauugucaaugaaugccugg

SEQ ID NO: 5326 - RNA, 19 nt, Artificial Sequence
  Synthetic
ugugcugagaggugccugg

SEQ ID NO: 5327 - RNA, 22 nt, Artificial Sequence
  Synthetic
ugcugugcugagaggugccugg

SEQ ID NO: 5328 - RNA, 23 nt, Artificial Sequence
  Synthetic
cugcugugcugagaggugccugg

SEQ ID NO: 5329 - RNA, 24 nt, Artificial Sequence
  Synthetic
ucugcugugcugagaggugccugg

SEQ ID NO: 5330 - RNA, 18 nt, Artificial Sequence
  Synthetic
accuuccagaagucuguu

SEQ ID NO: 5331 - RNA, 19 nt, Artificial Sequence
  Synthetic
aaccuuccagaagucuguu

SEQ ID NO: 5332 - RNA, 21 nt, Artificial Sequence
  Synthetic
auaaccuuccagaagucuguu

SEQ ID NO: 5333 - RNA, 22 nt, Artificial Sequence
  Synthetic
aauaaccuuccagaagucuguu

SEQ ID NO: 5334 - RNA, 23 nt, Artificial Sequence
  Synthetic
aaauaaccuuccagaagucuguu

SEQ ID NO: 5335 - RNA, 24 nt, Artificial Sequence
  Synthetic
aaaauaaccuuccagaagucuguu

SEQ ID NO: 5336 - RNA, 18 nt, Artificial Sequence
  Synthetic
ucucaaugaguuugcaga

SEQ ID NO: 5337 - RNA, 19 nt, Artificial Sequence
  Synthetic
uucucaaugaguuugcaga

SEQ ID NO: 5338 - RNA, 22 nt, Artificial Sequence
  Synthetic
agguucucaaugaguuugcaga

SEQ ID NO: 5339 - RNA, 23 nt, Artificial Sequence
  Synthetic
cagguucucaaugaguuugcaga

SEQ ID NO: 5340 - RNA, 18 nt, Artificial Sequence
  Synthetic
aagaagucuauuucauga

SEQ ID NO: 5341 - RNA, 23 nt, Artificial Sequence
  Synthetic
aggagaagaagucuauuucauga

SEQ ID NO: 5342 - RNA, 18 nt, Artificial Sequence
  Synthetic
uggggacgcuggggcuga

SEQ ID NO: 5343 - RNA, 24 nt, Artificial Sequence
  Synthetic
agggaguggggacgcuggggcuga

SEQ ID NO: 5344 - RNA, 18 nt, Artificial Sequence
  Synthetic
auucacggaagaagugac

SEQ ID NO: 5345 - RNA, 19 nt, Artificial Sequence
  Synthetic
aauucacggaagaagugac

SEQ ID NO: 5346 - RNA, 21 nt, Artificial Sequence
  Synthetic
uuaauucacggaagaagugac

SEQ ID NO: 5347 - RNA, 23 nt, Artificial Sequence
  Synthetic
cguuaauucacggaagaagugac

SEQ ID NO: 5348 - RNA, 24 nt, Artificial Sequence
  Synthetic
ccguuaauucacggaagaagugac

SEQ ID NO: 5349 - RNA, 21 nt, Artificial Sequence
  Synthetic
ugggggagcccugcaagcacc

SEQ ID NO: 5350 - RNA, 22 nt, Artificial Sequence
  Synthetic
cugggggagcccugcaagcacc

SEQ ID NO: 5351 - RNA, 24 nt, Artificial Sequence
  Synthetic
agcugggggagcccugcaagcacc

SEQ ID NO: 5352 - RNA, 18 nt, Artificial Sequence
  Synthetic
uggccugccucgcuuccc

SEQ ID NO: 5353 - RNA, 19 nt, Artificial Sequence
  Synthetic
cuggccugccucgcuuccc

SEQ ID NO: 5354 - RNA, 21 nt, Artificial Sequence
  Synthetic
agcuggccugccucgcuuccc

SEQ ID NO: 5355 - RNA, 22 nt, Artificial Sequence
  Synthetic
cagcuggccugccucgcuuccc

SEQ ID NO: 5356 - RNA, 24 nt, Artificial Sequence
  Synthetic
ugcagcuggccugccucgcuuccc

SEQ ID NO: 5357 - RNA, 19 nt, Artificial Sequence
  Synthetic
ugcccggaggcccccaagc

SEQ ID NO: 5358 - RNA, 21 nt, Artificial Sequence
  Synthetic
cgugcccggaggcccccaagc

SEQ ID NO: 5359 - RNA, 22 nt, Artificial Sequence
  Synthetic
ucgugcccggaggcccccaagc

SEQ ID NO: 5360 - RNA, 23 nt, Artificial Sequence
  Synthetic
aucgugcccggaggcccccaagc

SEQ ID NO: 5361 - RNA, 24 nt, Artificial Sequence
  Synthetic
caucgugcccggaggcccccaagc

SEQ ID NO: 5362 - RNA, 18 nt, Artificial Sequence
  Synthetic
uaaaauuccagggugugc

SEQ ID NO: 5363 - RNA, 19 nt, Artificial Sequence
  Synthetic
uuaaaauuccagggugugc

SEQ ID NO: 5364 - RNA, 21 nt, Artificial Sequence
  Synthetic
uguuaaaauuccagggugugc

SEQ ID NO: 5365 - RNA, 22 nt, Artificial Sequence
  Synthetic
cuguuaaaauuccagggugugc

SEQ ID NO: 5366 - RNA, 24 nt, Artificial Sequence
  Synthetic
agcuguuaaaauuccagggugugc

SEQ ID NO: 5367 - RNA, 18 nt, Artificial Sequence
  Synthetic
cugcaagcacccgggguc

SEQ ID NO: 5368 - RNA, 19 nt, Artificial Sequence
  Synthetic
ccugcaagcacccgggguc

SEQ ID NO: 5369 - RNA, 22 nt, Artificial Sequence
  Synthetic
agcccugcaagcacccgggguc

SEQ ID NO: 5370 - RNA, 21 nt, Artificial Sequence
  Synthetic
uaaagucagcuguuaaaauuc

SEQ ID NO: 5371 - RNA, 22 nt, Artificial Sequence
  Synthetic
auaaagucagcuguuaaaauuc

SEQ ID NO: 5372 - RNA, 23 nt, Artificial Sequence
  Synthetic
cauaaagucagcuguuaaaauuc

SEQ ID NO: 5373 - RNA, 24 nt, Artificial Sequence
  Synthetic
ucauaaagucagcuguuaaaauuc

SEQ ID NO: 5374 - RNA, 18 nt, Artificial Sequence
  Synthetic
aggggccuccacguccag

SEQ ID NO: 5375 - RNA, 19 nt, Artificial Sequence
  Synthetic
aaggggccuccacguccag

SEQ ID NO: 5376 - RNA, 24 nt, Artificial Sequence
  Synthetic
agggaaaggggccuccacguccag

SEQ ID NO: 5377 - RNA, 18 nt, Artificial Sequence
  Synthetic
agggaaacuagucuaacg

SEQ ID NO: 5378 - RNA, 23 nt, Artificial Sequence
  Synthetic
uggagagggaaacuagucuaacg

SEQ ID NO: 5379 - RNA, 24 nt, Artificial Sequence
  Synthetic
auggagagggaaacuagucuaacg

SEQ ID NO: 5380 - RNA, 21 nt, Artificial Sequence
  Synthetic
aaggaaauaaacaccaucuug

SEQ ID NO: 5381 - RNA, 22 nt, Artificial Sequence
  Synthetic
aaaggaaauaaacaccaucuug

SEQ ID NO: 5382 - RNA, 24 nt, Artificial Sequence
  Synthetic
agaaaggaaauaaacaccaucuug

SEQ ID NO: 5383 - RNA, 18 nt, Artificial Sequence
  Synthetic
agguucucaaugaguuug

SEQ ID NO: 5384 - RNA, 19 nt, Artificial Sequence
  Synthetic
cagguucucaaugaguuug

SEQ ID NO: 5385 - RNA, 21 nt, Artificial Sequence
  Synthetic
ugcagguucucaaugaguuug

SEQ ID NO: 5386 - RNA, 23 nt, Artificial Sequence
  Synthetic
agugcagguucucaaugaguuug

SEQ ID NO: 5387 - RNA, 24 nt, Artificial Sequence
  Synthetic
cagugcagguucucaaugaguuug

SEQ ID NO: 5388 - RNA, 18 nt, Artificial Sequence
  Synthetic
cgaaggccuuuauuuaau

SEQ ID NO: 5389 - RNA, 19 nt, Artificial Sequence
  Synthetic
acgaaggccuuuauuuaau

SEQ ID NO: 5390 - RNA, 21 nt, Artificial Sequence
  Synthetic
ucacgaaggccuuuauuuaau

SEQ ID NO: 5391 - RNA, 22 nt, Artificial Sequence
  Synthetic
uucacgaaggccuuuauuuaau

SEQ ID NO: 5392 - RNA, 23 nt, Artificial Sequence
  Synthetic
cuucacgaaggccuuuauuuaau

SEQ ID NO: 5393 - RNA, 24 nt, Artificial Sequence
  Synthetic
ccuucacgaaggccuuuauuuaau

SEQ ID NO: 5394 - RNA, 18 nt, Artificial Sequence
  Synthetic
agauauaggaacuauuau

SEQ ID NO: 5395 - RNA, 21 nt, Artificial Sequence
  Synthetic
uggagauauaggaacuauuau

SEQ ID NO: 5396 - RNA, 24 nt, Artificial Sequence
  Synthetic
agguggagauauaggaacuauuau

SEQ ID NO: 5397 - RNA, 18 nt, Artificial Sequence
  Synthetic
aguguuguucacggggcu

SEQ ID NO: 5398 - RNA, 19 nt, Artificial Sequence
  Synthetic
caguguuguucacggggcu

SEQ ID NO: 5399 - RNA, 21 nt, Artificial Sequence
  Synthetic
uucaguguuguucacggggcu

SEQ ID NO: 5400 - RNA, 23 nt, Artificial Sequence
  Synthetic
uguucaguguuguucacggggcu

SEQ ID NO: 5401 - RNA, 24 nt, Artificial Sequence
  Synthetic
auguucaguguuguucacggggcu

SEQ ID NO: 5402 - RNA, 18 nt, Artificial Sequence
  Synthetic
ucuggaagguuauuuucu

SEQ ID NO: 5403 - RNA, 19 nt, Artificial Sequence
  Synthetic
uucuggaagguuauuuucu

SEQ ID NO: 5404 - RNA, 21 nt, Artificial Sequence
  Synthetic
acuucuggaagguuauuuucu

SEQ ID NO: 5405 - RNA, 23 nt, Artificial Sequence
  Synthetic
agacuucuggaagguuauuuucu

SEQ ID NO: 5406 - RNA, 24 nt, Artificial Sequence
  Synthetic
cagacuucuggaagguuauuuucu

SEQ ID NO: 5407 - RNA, 18 nt, Artificial Sequence
  Synthetic
aggaacuauuauuggggu

SEQ ID NO: 5408 - RNA, 19 nt, Artificial Sequence
  Synthetic
uaggaacuauuauuggggu

SEQ ID NO: 5409 - RNA, 21 nt, Artificial Sequence
  Synthetic
uauaggaacuauuauuggggu

SEQ ID NO: 5410 - RNA, 22 nt, Artificial Sequence
  Synthetic
auauaggaacuauuauuggggu

SEQ ID NO: 5411 - RNA, 24 nt, Artificial Sequence
  Synthetic
agauauaggaacuauuauuggggu

SEQ ID NO: 5412 - RNA, 18 nt, Artificial Sequence
  Synthetic
acgucuuaaaggacuugu

SEQ ID NO: 5413 - RNA, 19 nt, Artificial Sequence
  Synthetic
uacgucuuaaaggacuugu

SEQ ID NO: 5414 - RNA, 22 nt, Artificial Sequence
  Synthetic
ugcuacgucuuaaaggacuugu

SEQ ID NO: 5415 - RNA, 23 nt, Artificial Sequence
  Synthetic
cugcuacgucuuaaaggacuugu

SEQ ID NO: 5416 - RNA, 24 nt, Artificial Sequence
  Synthetic
ccugcuacgucuuaaaggacuugu

SEQ ID NO: 5417 - RNA, 18 nt, Artificial Sequence
  Synthetic
auuuccuuucuuucagca

SEQ ID NO: 5418 - RNA, 19 nt, Artificial Sequence
  Synthetic
uauuuccuuucuuucagca

SEQ ID NO: 5419 - RNA, 21 nt, Artificial Sequence
  Synthetic
uuuauuuccuuucuuucagca

SEQ ID NO: 5420 - RNA, 22 nt, Artificial Sequence
  Synthetic
guuuauuuccuuucuuucagca

SEQ ID NO: 5421 - RNA, 23 nt, Artificial Sequence
  Synthetic
uguuuauuuccuuucuuucagca

SEQ ID NO: 5422 - RNA, 24 nt, Artificial Sequence
  Synthetic
guguuuauuuccuuucuuucagca

SEQ ID NO: 5423 - RNA, 18 nt, Artificial Sequence
  Synthetic
guacucaauaaauuguca

SEQ ID NO: 5424 - RNA, 19 nt, Artificial Sequence
  Synthetic
aguacucaauaaauuguca

SEQ ID NO: 5425 - RNA, 21 nt, Artificial Sequence
  Synthetic
uaaguacucaauaaauuguca

SEQ ID NO: 5426 - RNA, 22 nt, Artificial Sequence
  Synthetic
auaaguacucaauaaauuguca

SEQ ID NO: 5427 - RNA, 23 nt, Artificial Sequence
  Synthetic
uauaaguacucaauaaauuguca

SEQ ID NO: 5428 - RNA, 24 nt, Artificial Sequence
  Synthetic
auauaaguacucaauaaauuguca

SEQ ID NO: 5429 - RNA, 18 nt, Artificial Sequence
  Synthetic
gaaugccuggaugaauga

SEQ ID NO: 5430 - RNA, 19 nt, Artificial Sequence
  Synthetic
ugaaugccuggaugaauga

SEQ ID NO: 5431 - RNA, 21 nt, Artificial Sequence
  Synthetic
aaugaaugccuggaugaauga

SEQ ID NO: 5432 - RNA, 22 nt, Artificial Sequence
  Synthetic
caaugaaugccuggaugaauga

SEQ ID NO: 5433 - RNA, 23 nt, Artificial Sequence
  Synthetic
ucaaugaaugccuggaugaauga

SEQ ID NO: 5434 - RNA, 24 nt, Artificial Sequence
  Synthetic
gucaaugaaugccuggaugaauga

SEQ ID NO: 5435 - RNA, 18 nt, Artificial Sequence
  Synthetic
uggugugcugauuucaac

SEQ ID NO: 5436 - RNA, 19 nt, Artificial Sequence
  Synthetic
cuggugugcugauuucaac

SEQ ID NO: 5437 - RNA, 18 nt, Artificial Sequence
  Synthetic
cucaggacacccaggacc

SEQ ID NO: 5438 - RNA, 19 nt, Artificial Sequence
  Synthetic
gcucaggacacccaggacc

SEQ ID NO: 5439 - RNA, 18 nt, Artificial Sequence
  Synthetic
ccugcaguccccaccucc

SEQ ID NO: 5440 - RNA, 19 nt, Artificial Sequence
  Synthetic
cccugcaguccccaccucc

SEQ ID NO: 5441 - RNA, 21 nt, Artificial Sequence
  Synthetic
cucccugcaguccccaccucc

SEQ ID NO: 5442 - RNA, 22 nt, Artificial Sequence
  Synthetic
acucccugcaguccccaccucc

SEQ ID NO: 5443 - RNA, 23 nt, Artificial Sequence
  Synthetic
cacucccugcaguccccaccucc

SEQ ID NO: 5444 - RNA, 24 nt, Artificial Sequence
  Synthetic
ccacucccugcaguccccaccucc

SEQ ID NO: 5445 - RNA, 18 nt, Artificial Sequence
  Synthetic
uaaauugucaaugaaugc

SEQ ID NO: 5446 - RNA, 19 nt, Artificial Sequence
  Synthetic
auaaauugucaaugaaugc

SEQ ID NO: 5447 - RNA, 21 nt, Artificial Sequence
  Synthetic
caauaaauugucaaugaaugc

SEQ ID NO: 5448 - RNA, 22 nt, Artificial Sequence
  Synthetic
ucaauaaauugucaaugaaugc

SEQ ID NO: 5449 - RNA, 23 nt, Artificial Sequence
  Synthetic
cucaauaaauugucaaugaaugc

SEQ ID NO: 5450 - RNA, 24 nt, Artificial Sequence
  Synthetic
acucaauaaauugucaaugaaugc

SEQ ID NO: 5451 - RNA, 18 nt, Artificial Sequence
  Synthetic
ggguggggcugugcacag

SEQ ID NO: 5452 - RNA, 19 nt, Artificial Sequence
  Synthetic
uggguggggcugugcacag

SEQ ID NO: 5453 - RNA, 21 nt, Artificial Sequence
  Synthetic
gcuggguggggcugugcacag

SEQ ID NO: 5454 - RNA, 22 nt, Artificial Sequence
  Synthetic
ggcuggguggggcugugcacag

SEQ ID NO: 5455 - RNA, 23 nt, Artificial Sequence
  Synthetic
aggcuggguggggcugugcacag

SEQ ID NO: 5456 - RNA, 24 nt, Artificial Sequence
  Synthetic
gaggcuggguggggcugugcacag

SEQ ID NO: 5457 - RNA, 18 nt, Artificial Sequence
  Synthetic
caggagguggggacugca

SEQ ID NO: 5458 - RNA, 19 nt, Artificial Sequence
  Synthetic
ccaggagguggggacugca

SEQ ID NO: 5459 - RNA, 21 nt, Artificial Sequence
  Synthetic
uuccaggagguggggacugca

SEQ ID NO: 5460 - RNA, 22 nt, Artificial Sequence
  Synthetic
auuccaggagguggggacugca

SEQ ID NO: 5461 - RNA, 23 nt, Artificial Sequence
  Synthetic
aauuccaggagguggggacugca

SEQ ID NO: 5462 - RNA, 24 nt, Artificial Sequence
  Synthetic
gaauuccaggagguggggacugca

SEQ ID NO: 5463 - RNA, 18 nt, Artificial Sequence
  Synthetic
gcacagugcagguucuca

SEQ ID NO: 5464 - RNA, 19 nt, Artificial Sequence
  Synthetic
ggcacagugcagguucuca

SEQ ID NO: 5465 - RNA, 21 nt, Artificial Sequence
  Synthetic
cuggcacagugcagguucuca

SEQ ID NO: 5466 - RNA, 22 nt, Artificial Sequence
  Synthetic
ccuggcacagugcagguucuca

SEQ ID NO: 5467 - RNA, 23 nt, Artificial Sequence
  Synthetic
gccuggcacagugcagguucuca

SEQ ID NO: 5468 - RNA, 24 nt, Artificial Sequence
  Synthetic
ugccuggcacagugcagguucuca

SEQ ID NO: 5469 - RNA, 21 nt, Artificial Sequence
  Synthetic
caggcauucauugacaauuua

SEQ ID NO: 5470 - RNA, 22 nt, Artificial Sequence
  Synthetic
ccaggcauucauugacaauuua

SEQ ID NO: 5471 - RNA, 23 nt, Artificial Sequence
  Synthetic
uccaggcauucauugacaauuua

SEQ ID NO: 5472 - RNA, 24 nt, Artificial Sequence
  Synthetic
auccaggcauucauugacaauuua

SEQ ID NO: 5473 - RNA, 18 nt, Artificial Sequence
  Synthetic
agucagcuguuaaaauuc

SEQ ID NO: 5474 - RNA, 19 nt, Artificial Sequence
  Synthetic
aagucagcuguuaaaauuc

SEQ ID NO: 5475 - RNA, 21 nt, Artificial Sequence
  Synthetic
uugggguaugggugcauaaau

SEQ ID NO: 5476 - RNA, 22 nt, Artificial Sequence
  Synthetic
auugggguaugggugcauaaau

SEQ ID NO: 5477 - RNA, 23 nt, Artificial Sequence
  Synthetic
uauugggguaugggugcauaaau

SEQ ID NO: 5478 - RNA, 24 nt, Artificial Sequence
  Synthetic
uuauugggguaugggugcauaaau

SEQ ID NO: 5479 - RNA, 18 nt, Artificial Sequence
  Synthetic
gaacgagucacacagaaa

SEQ ID NO: 5480 - RNA, 19 nt, Artificial Sequence
  Synthetic
ugaacgagucacacagaaa

SEQ ID NO: 5481 - RNA, 21 nt, Artificial Sequence
  Synthetic
aaugaacgagucacacagaaa

SEQ ID NO: 5482 - RNA, 22 nt, Artificial Sequence
  Synthetic
gaaugaacgagucacacagaaa

SEQ ID NO: 5483 - RNA, 23 nt, Artificial Sequence
  Synthetic
ugaaugaacgagucacacagaaa

SEQ ID NO: 5484 - RNA, 24 nt, Artificial Sequence
  Synthetic
augaaugaacgagucacacagaaa

SEQ ID NO: 5485 - RNA, 18 nt, Artificial Sequence
  Synthetic
uuggaguuucuuuuuaaa

SEQ ID NO: 5486 - RNA, 19 nt, Artificial Sequence
  Synthetic
uuuggaguuucuuuuuaaa

SEQ ID NO: 5487 - RNA, 21 nt, Artificial Sequence
  Synthetic
uguuuggaguuucuuuuuaaa

SEQ ID NO: 5488 - RNA, 22 nt, Artificial Sequence
  Synthetic
cuguuuggaguuucuuuuuaaa

SEQ ID NO: 5489 - RNA, 23 nt, Artificial Sequence
  Synthetic
ucuguuuggaguuucuuuuuaaa

SEQ ID NO: 5490 - RNA, 24 nt, Artificial Sequence
  Synthetic
gucuguuuggaguuucuuuuuaaa

SEQ ID NO: 5491 - RNA, 18 nt, Artificial Sequence
  Synthetic
aaggcucacaggaagcaa

SEQ ID NO: 5492 - RNA, 19 nt, Artificial Sequence
  Synthetic
aaaggcucacaggaagcaa

SEQ ID NO: 5493 - RNA, 21 nt, Artificial Sequence
  Synthetic
aaaaaggcucacaggaagcaa

SEQ ID NO: 5494 - RNA, 22 nt, Artificial Sequence
  Synthetic
uaaaaaggcucacaggaagcaa

SEQ ID NO: 5495 - RNA, 23 nt, Artificial Sequence
  Synthetic
auaaaaaggcucacaggaagcaa

SEQ ID NO: 5496 - RNA, 24 nt, Artificial Sequence
  Synthetic
gauaaaaaggcucacaggaagcaa

SEQ ID NO: 5497 - RNA, 18 nt, Artificial Sequence
  Synthetic
gaauuaacggccuaggaa

SEQ ID NO: 5498 - RNA, 19 nt, Artificial Sequence
  Synthetic
ugaauuaacggccuaggaa

SEQ ID NO: 5499 - RNA, 21 nt, Artificial Sequence
  Synthetic
cgugaauuaacggccuaggaa

SEQ ID NO: 5500 - RNA, 22 nt, Artificial Sequence
  Synthetic
ccgugaauuaacggccuaggaa

SEQ ID NO: 5501 - RNA, 23 nt, Artificial Sequence
  Synthetic
uccgugaauuaacggccuaggaa

SEQ ID NO: 5502 - RNA, 24 nt, Artificial Sequence
  Synthetic
uuccgugaauuaacggccuaggaa

SEQ ID NO: 5503 - RNA, 18 nt, Artificial Sequence
  Synthetic
caggcacuaugcuaggaa

SEQ ID NO: 5504 - RNA, 19 nt, Artificial Sequence
  Synthetic
ccaggcacuaugcuaggaa

SEQ ID NO: 5505 - RNA, 21 nt, Artificial Sequence
  Synthetic
ugccaggcacuaugcuaggaa

SEQ ID NO: 5506 - RNA, 22 nt, Artificial Sequence
  Synthetic
gugccaggcacuaugcuaggaa

SEQ ID NO: 5507 - RNA, 23 nt, Artificial Sequence
  Synthetic
ugugccaggcacuaugcuaggaa

SEQ ID NO: 5508 - RNA, 24 nt, Artificial Sequence
  Synthetic
cugugccaggcacuaugcuaggaa

SEQ ID NO: 5509 - RNA, 18 nt, Artificial Sequence
  Synthetic
caggacgauucacgggaa

SEQ ID NO: 5510 - RNA, 19 nt, Artificial Sequence
  Synthetic
ccaggacgauucacgggaa

SEQ ID NO: 5511 - RNA, 21 nt, Artificial Sequence
  Synthetic
caccaggacgauucacgggaa

SEQ ID NO: 5512 - RNA, 22 nt, Artificial Sequence
  Synthetic
gcaccaggacgauucacgggaa

SEQ ID NO: 5513 - RNA, 23 nt, Artificial Sequence
  Synthetic
ugcaccaggacgauucacgggaa

SEQ ID NO: 5514 - RNA, 24 nt, Artificial Sequence
  Synthetic
augcaccaggacgauucacgggaa

SEQ ID NO: 5515 - RNA, 18 nt, Artificial Sequence
  Synthetic
ccagccccgugaacaaca

SEQ ID NO: 5516 - RNA, 19 nt, Artificial Sequence
  Synthetic
cccagccccgugaacaaca

SEQ ID NO: 5517 - RNA, 21 nt, Artificial Sequence
  Synthetic
cucccagccccgugaacaaca

SEQ ID NO: 5518 - RNA, 22 nt, Artificial Sequence
  Synthetic
acucccagccccgugaacaaca

SEQ ID NO: 5519 - RNA, 23 nt, Artificial Sequence
  Synthetic
aacucccagccccgugaacaaca

SEQ ID NO: 5520 - RNA, 24 nt, Artificial Sequence
  Synthetic
aaacucccagccccgugaacaaca

SEQ ID NO: 5521 - RNA, 18 nt, Artificial Sequence
  Synthetic
uggguggggcugugcaca

SEQ ID NO: 5522 - RNA, 19 nt, Artificial Sequence
  Synthetic
cuggguggggcugugcaca

SEQ ID NO: 5523 - RNA, 21 nt, Artificial Sequence
  Synthetic
ggcuggguggggcugugcaca

SEQ ID NO: 5524 - RNA, 22 nt, Artificial Sequence
  Synthetic
aggcuggguggggcugugcaca

SEQ ID NO: 5525 - RNA, 23 nt, Artificial Sequence
  Synthetic
gaggcuggguggggcugugcaca

SEQ ID NO: 5526 - RNA, 24 nt, Artificial Sequence
  Synthetic
ugaggcuggguggggcugugcaca

SEQ ID NO: 5527 - RNA, 18 nt, Artificial Sequence
  Synthetic
augaaugaacgagucaca

SEQ ID NO: 5528 - RNA, 19 nt, Artificial Sequence
  Synthetic
gaugaaugaacgagucaca

SEQ ID NO: 5529 - RNA, 21 nt, Artificial Sequence
  Synthetic
uggaugaaugaacgagucaca

SEQ ID NO: 5530 - RNA, 22 nt, Artificial Sequence
  Synthetic
cuggaugaaugaacgagucaca

SEQ ID NO: 5531 - RNA, 23 nt, Artificial Sequence
  Synthetic
ccuggaugaaugaacgagucaca

SEQ ID NO: 5532 - RNA, 24 nt, Artificial Sequence
  Synthetic
gccuggaugaaugaacgagucaca

SEQ ID NO: 5533 - RNA, 18 nt, Artificial Sequence
  Synthetic
uaagacguagcagggaca

SEQ ID NO: 5534 - RNA, 19 nt, Artificial Sequence
  Synthetic
uuaagacguagcagggaca

SEQ ID NO: 5535 - RNA, 21 nt, Artificial Sequence
  Synthetic
cuuuaagacguagcagggaca

SEQ ID NO: 5536 - RNA, 22 nt, Artificial Sequence
  Synthetic
ccuuuaagacguagcagggaca

SEQ ID NO: 5537 - RNA, 23 nt, Artificial Sequence
  Synthetic
uccuuuaagacguagcagggaca

SEQ ID NO: 5538 - RNA, 24 nt, Artificial Sequence
  Synthetic
guccuuuaagacguagcagggaca

SEQ ID NO: 5539 - RNA, 18 nt, Artificial Sequence
  Synthetic
gcucaugcccgagcucca

SEQ ID NO: 5540 - RNA, 19 nt, Artificial Sequence
  Synthetic
ggcucaugcccgagcucca

SEQ ID NO: 5541 - RNA, 21 nt, Artificial Sequence
  Synthetic
cuggcucaugcccgagcucca

SEQ ID NO: 5542 - RNA, 22 nt, Artificial Sequence
  Synthetic
gcuggcucaugcccgagcucca

SEQ ID NO: 5543 - RNA, 23 nt, Artificial Sequence
  Synthetic
ugcuggcucaugcccgagcucca

SEQ ID NO: 5544 - RNA, 24 nt, Artificial Sequence
  Synthetic
uugcuggcucaugcccgagcucca

SEQ ID NO: 5545 - RNA, 18 nt, Artificial Sequence
  Synthetic
cuucuucuccuccaagca

SEQ ID NO: 5546 - RNA, 19 nt, Artificial Sequence
  Synthetic
acuucuucuccuccaagca

SEQ ID NO: 5547 - RNA, 21 nt, Artificial Sequence
  Synthetic
agacuucuucuccuccaagca

SEQ ID NO: 5548 - RNA, 22 nt, Artificial Sequence
  Synthetic
uagacuucuucuccuccaagca

SEQ ID NO: 5549 - RNA, 23 nt, Artificial Sequence
  Synthetic
auagacuucuucuccuccaagca

SEQ ID NO: 5550 - RNA, 24 nt, Artificial Sequence
  Synthetic
aauagacuucuucuccuccaagca

SEQ ID NO: 5551 - RNA, 18 nt, Artificial Sequence
  Synthetic
aaaggcucacaggaagca

SEQ ID NO: 5552 - RNA, 19 nt, Artificial Sequence
  Synthetic
aaaaggcucacaggaagca

SEQ ID NO: 5553 - RNA, 21 nt, Artificial Sequence
  Synthetic
uaaaaaggcucacaggaagca

SEQ ID NO: 5554 - RNA, 22 nt, Artificial Sequence
  Synthetic
auaaaaaggcucacaggaagca

SEQ ID NO: 5555 - RNA, 23 nt, Artificial Sequence
  Synthetic
gauaaaaaggcucacaggaagca

SEQ ID NO: 5556 - RNA, 24 nt, Artificial Sequence
  Synthetic
agauaaaaaggcucacaggaagca

SEQ ID NO: 5557 - RNA, 18 nt, Artificial Sequence
  Synthetic
ggcacgauggaggcagca

SEQ ID NO: 5558 - RNA, 19 nt, Artificial Sequence
  Synthetic
gggcacgauggaggcagca

SEQ ID NO: 5559 - RNA, 21 nt, Artificial Sequence
  Synthetic
ccgggcacgauggaggcagca

SEQ ID NO: 5560 - RNA, 22 nt, Artificial Sequence
  Synthetic
uccgggcacgauggaggcagca

SEQ ID NO: 5561 - RNA, 23 nt, Artificial Sequence
  Synthetic
cuccgggcacgauggaggcagca

SEQ ID NO: 5562 - RNA, 24 nt, Artificial Sequence
  Synthetic
ccuccgggcacgauggaggcagca

SEQ ID NO: 5563 - RNA, 18 nt, Artificial Sequence
  Synthetic
gcuggguggggcugugca

SEQ ID NO: 5564 - RNA, 19 nt, Artificial Sequence
  Synthetic
ggcuggguggggcugugca

SEQ ID NO: 5565 - RNA, 21 nt, Artificial Sequence
  Synthetic
gaggcuggguggggcugugca

SEQ ID NO: 5566 - RNA, 22 nt, Artificial Sequence
  Synthetic
ugaggcuggguggggcugugca

SEQ ID NO: 5567 - RNA, 23 nt, Artificial Sequence
  Synthetic
gugaggcuggguggggcugugca

SEQ ID NO: 5568 - RNA, 24 nt, Artificial Sequence
  Synthetic
cgugaggcuggguggggcugugca

SEQ ID NO: 5569 - RNA, 18 nt, Artificial Sequence
  Synthetic
auucacucugcaaacuca

SEQ ID NO: 5570 - RNA, 19 nt, Artificial Sequence
  Synthetic
cauucacucugcaaacuca

SEQ ID NO: 5571 - RNA, 21 nt, Artificial Sequence
  Synthetic
uccauucacucugcaaacuca

SEQ ID NO: 5572 - RNA, 22 nt, Artificial Sequence
  Synthetic
uuccauucacucugcaaacuca

SEQ ID NO: 5573 - RNA, 23 nt, Artificial Sequence
  Synthetic
uuuccauucacucugcaaacuca

SEQ ID NO: 5574 - RNA, 24 nt, Artificial Sequence
  Synthetic
auuuccauucacucugcaaacuca

SEQ ID NO: 5575 - RNA, 18 nt, Artificial Sequence
  Synthetic
aaaagauaaaaaggcuca

SEQ ID NO: 5576 - RNA, 19 nt, Artificial Sequence
  Synthetic
gaaaagauaaaaaggcuca

SEQ ID NO: 5577 - RNA, 21 nt, Artificial Sequence
  Synthetic
gagaaaagauaaaaaggcuca

SEQ ID NO: 5578 - RNA, 22 nt, Artificial Sequence
  Synthetic
agagaaaagauaaaaaggcuca

SEQ ID NO: 5579 - RNA, 23 nt, Artificial Sequence
  Synthetic
cagagaaaagauaaaaaggcuca

SEQ ID NO: 5580 - RNA, 24 nt, Artificial Sequence
  Synthetic
gcagagaaaagauaaaaaggcuca

SEQ ID NO: 5581 - RNA, 18 nt, Artificial Sequence
  Synthetic
augcaccaggacgauuca

SEQ ID NO: 5582 - RNA, 19 nt, Artificial Sequence
  Synthetic
gaugcaccaggacgauuca

SEQ ID NO: 5583 - RNA, 21 nt, Artificial Sequence
  Synthetic
cagaugcaccaggacgauuca

SEQ ID NO: 5584 - RNA, 22 nt, Artificial Sequence
  Synthetic
ucagaugcaccaggacgauuca

SEQ ID NO: 5585 - RNA, 23 nt, Artificial Sequence
  Synthetic
cucagaugcaccaggacgauuca

SEQ ID NO: 5586 - RNA, 24 nt, Artificial Sequence
  Synthetic
gcucagaugcaccaggacgauuca

SEQ ID NO: 5587 - RNA, 18 nt, Artificial Sequence
  Synthetic
uggggagccagcccuuca

SEQ ID NO: 5588 - RNA, 19 nt, Artificial Sequence
  Synthetic
cuggggagccagcccuuca

SEQ ID NO: 5589 - RNA, 21 nt, Artificial Sequence
  Synthetic
uacuggggagccagcccuuca

SEQ ID NO: 5590 - RNA, 22 nt, Artificial Sequence
  Synthetic
auacuggggagccagcccuuca

SEQ ID NO: 5591 - RNA, 23 nt, Artificial Sequence
  Synthetic
uauacuggggagccagcccuuca

SEQ ID NO: 5592 - RNA, 24 nt, Artificial Sequence
  Synthetic
auauacuggggagccagcccuuca

SEQ ID NO: 5593 - RNA, 18 nt, Artificial Sequence
  Synthetic
gcccuucaugggggaaga

SEQ ID NO: 5594 - RNA, 19 nt, Artificial Sequence
  Synthetic
agcccuucaugggggaaga

SEQ ID NO: 5595 - RNA, 21 nt, Artificial Sequence
  Synthetic
ccagcccuucaugggggaaga

SEQ ID NO: 5596 - RNA, 22 nt, Artificial Sequence
  Synthetic
gccagcccuucaugggggaaga

SEQ ID NO: 5597 - RNA, 23 nt, Artificial Sequence
  Synthetic
agccagcccuucaugggggaaga

SEQ ID NO: 5598 - RNA, 24 nt, Artificial Sequence
  Synthetic
gagccagcccuucaugggggaaga

SEQ ID NO: 5599 - RNA, 18 nt, Artificial Sequence
  Synthetic
gggggccuccgggcacga

SEQ ID NO: 5600 - RNA, 19 nt, Artificial Sequence
  Synthetic
ugggggccuccgggcacga

SEQ ID NO: 5601 - RNA, 21 nt, Artificial Sequence
  Synthetic
cuugggggccuccgggcacga

SEQ ID NO: 5602 - RNA, 22 nt, Artificial Sequence
  Synthetic
gcuugggggccuccgggcacga

SEQ ID NO: 5603 - RNA, 23 nt, Artificial Sequence
  Synthetic
ggcuugggggccuccgggcacga

SEQ ID NO: 5604 - RNA, 24 nt, Artificial Sequence
  Synthetic
gggcuugggggccuccgggcacga

SEQ ID NO: 5605 - RNA, 18 nt, Artificial Sequence
  Synthetic
uuuaagacguagcaggga

SEQ ID NO: 5606 - RNA, 19 nt, Artificial Sequence
  Synthetic
cuuuaagacguagcaggga

SEQ ID NO: 5607 - RNA, 21 nt, Artificial Sequence
  Synthetic
uccuuuaagacguagcaggga

SEQ ID NO: 5608 - RNA, 22 nt, Artificial Sequence
  Synthetic
guccuuuaagacguagcaggga

SEQ ID NO: 5609 - RNA, 23 nt, Artificial Sequence
  Synthetic
aguccuuuaagacguagcaggga

SEQ ID NO: 5610 - RNA, 24 nt, Artificial Sequence
  Synthetic
aaguccuuuaagacguagcaggga

SEQ ID NO: 5611 - RNA, 18 nt, Artificial Sequence
  Synthetic
agggcucccccagcugga

SEQ ID NO: 5612 - RNA, 19 nt, Artificial Sequence
  Synthetic
cagggcucccccagcugga

SEQ ID NO: 5613 - RNA, 21 nt, Artificial Sequence
  Synthetic
ugcagggcucccccagcugga

SEQ ID NO: 5614 - RNA, 22 nt, Artificial Sequence
  Synthetic
uugcagggcucccccagcugga

SEQ ID NO: 5615 - RNA, 23 nt, Artificial Sequence
  Synthetic
cuugcagggcucccccagcugga

SEQ ID NO: 5616 - RNA, 24 nt, Artificial Sequence
  Synthetic
gcuugcagggcucccccagcugga

SEQ ID NO: 5617 - RNA, 18 nt, Artificial Sequence
  Synthetic
guugcccagaagacauga

SEQ ID NO: 5618 - RNA, 19 nt, Artificial Sequence
  Synthetic
aguugcccagaagacauga

SEQ ID NO: 5619 - RNA, 21 nt, Artificial Sequence
  Synthetic
guaguugcccagaagacauga

SEQ ID NO: 5620 - RNA, 22 nt, Artificial Sequence
  Synthetic
aguaguugcccagaagacauga

SEQ ID NO: 5621 - RNA, 23 nt, Artificial Sequence
  Synthetic
gaguaguugcccagaagacauga

SEQ ID NO: 5622 - RNA, 24 nt, Artificial Sequence
  Synthetic
ugaguaguugcccagaagacauga

SEQ ID NO: 5623 - RNA, 18 nt, Artificial Sequence
  Synthetic
caaugaaugccuggauga

SEQ ID NO: 5624 - RNA, 19 nt, Artificial Sequence
  Synthetic
ucaaugaaugccuggauga

SEQ ID NO: 5625 - RNA, 21 nt, Artificial Sequence
  Synthetic
ugucaaugaaugccuggauga

SEQ ID NO: 5626 - RNA, 22 nt, Artificial Sequence
  Synthetic
uugucaaugaaugccuggauga

SEQ ID NO: 5627 - RNA, 23 nt, Artificial Sequence
  Synthetic
auugucaaugaaugccuggauga

SEQ ID NO: 5628 - RNA, 24 nt, Artificial Sequence
  Synthetic
aauugucaaugaaugccuggauga

SEQ ID NO: 5629 - RNA, 18 nt, Artificial Sequence
  Synthetic
cugcagcgcugugacuga

SEQ ID NO: 5630 - RNA, 19 nt, Artificial Sequence
  Synthetic
gcugcagcgcugugacuga

SEQ ID NO: 5631 - RNA, 21 nt, Artificial Sequence
  Synthetic
cagcugcagcgcugugacuga

SEQ ID NO: 5632 - RNA, 22 nt, Artificial Sequence
  Synthetic
ccagcugcagcgcugugacuga

SEQ ID NO: 5633 - RNA, 23 nt, Artificial Sequence
  Synthetic
gccagcugcagcgcugugacuga

SEQ ID NO: 5634 - RNA, 24 nt, Artificial Sequence
  Synthetic
ggccagcugcagcgcugugacuga

SEQ ID NO: 5635 - RNA, 18 nt, Artificial Sequence
  Synthetic
aaauaaaggccuucguga

SEQ ID NO: 5636 - RNA, 19 nt, Artificial Sequence
  Synthetic
uaaauaaaggccuucguga

SEQ ID NO: 5637 - RNA, 21 nt, Artificial Sequence
  Synthetic
auuaaauaaaggccuucguga

SEQ ID NO: 5638 - RNA, 22 nt, Artificial Sequence
  Synthetic
cauuaaauaaaggccuucguga

SEQ ID NO: 5639 - RNA, 23 nt, Artificial Sequence
  Synthetic
ccauuaaauaaaggccuucguga

SEQ ID NO: 5640 - RNA, 24 nt, Artificial Sequence
  Synthetic
cccauuaaauaaaggccuucguga

SEQ ID NO: 5641 - RNA, 18 nt, Artificial Sequence
  Synthetic
cagagagguuuauauaua

SEQ ID NO: 5642 - RNA, 19 nt, Artificial Sequence
  Synthetic
ccagagagguuuauauaua

SEQ ID NO: 5643 - RNA, 21 nt, Artificial Sequence
  Synthetic
cuccagagagguuuauauaua

SEQ ID NO: 5644 - RNA, 22 nt, Artificial Sequence
  Synthetic
gcuccagagagguuuauauaua

SEQ ID NO: 5645 - RNA, 23 nt, Artificial Sequence
  Synthetic
agcuccagagagguuuauauaua

SEQ ID NO: 5646 - RNA, 24 nt, Artificial Sequence
  Synthetic
gagcuccagagagguuuauauaua

SEQ ID NO: 5647 - RNA, 18 nt, Artificial Sequence
  Synthetic
aggcagcagggggcgcua

SEQ ID NO: 5648 - RNA, 19 nt, Artificial Sequence
  Synthetic
gaggcagcagggggcgcua

SEQ ID NO: 5649 - RNA, 21 nt, Artificial Sequence
  Synthetic
uggaggcagcagggggcgcua

SEQ ID NO: 5650 - RNA, 22 nt, Artificial Sequence
  Synthetic
auggaggcagcagggggcgcua

SEQ ID NO: 5651 - RNA, 23 nt, Artificial Sequence
  Synthetic
gauggaggcagcagggggcgcua

SEQ ID NO: 5652 - RNA, 24 nt, Artificial Sequence
  Synthetic
cgauggaggcagcagggggcgcua

SEQ ID NO: 5653 - RNA, 18 nt, Artificial Sequence
  Synthetic
aggcacuaugcuaggaac

SEQ ID NO: 5654 - RNA, 19 nt, Artificial Sequence
  Synthetic
caggcacuaugcuaggaac

SEQ ID NO: 5655 - RNA, 21 nt, Artificial Sequence
  Synthetic
gccaggcacuaugcuaggaac

SEQ ID NO: 5656 - RNA, 22 nt, Artificial Sequence
  Synthetic
ugccaggcacuaugcuaggaac

SEQ ID NO: 5657 - RNA, 23 nt, Artificial Sequence
  Synthetic
gugccaggcacuaugcuaggaac

SEQ ID NO: 5658 - RNA, 24 nt, Artificial Sequence
  Synthetic
ugugccaggcacuaugcuaggaac

SEQ ID NO: 5659 - RNA, 18 nt, Artificial Sequence
  Synthetic
aacagccagccagaacac

SEQ ID NO: 5660 - RNA, 19 nt, Artificial Sequence
  Synthetic
uaacagccagccagaacac

SEQ ID NO: 5661 - RNA, 21 nt, Artificial Sequence
  Synthetic
aauaacagccagccagaacac

SEQ ID NO: 5662 - RNA, 22 nt, Artificial Sequence
  Synthetic
aaauaacagccagccagaacac

SEQ ID NO: 5663 - RNA, 23 nt, Artificial Sequence
  Synthetic
aaaauaacagccagccagaacac

SEQ ID NO: 5664 - RNA, 24 nt, Artificial Sequence
  Synthetic
aaaaauaacagccagccagaacac

SEQ ID NO: 5665 - RNA, 18 nt, Artificial Sequence
  Synthetic
acguacacacacuuacac

SEQ ID NO: 5666 - RNA, 19 nt, Artificial Sequence
  Synthetic
cacguacacacacuuacac

SEQ ID NO: 5667 - RNA, 21 nt, Artificial Sequence
  Synthetic
cacacguacacacacuuacac

SEQ ID NO: 5668 - RNA, 22 nt, Artificial Sequence
  Synthetic
acacacguacacacacuuacac

SEQ ID NO: 5669 - RNA, 23 nt, Artificial Sequence
  Synthetic
cacacacguacacacacuuacac

SEQ ID NO: 5670 - RNA, 24 nt, Artificial Sequence
  Synthetic
acacacacguacacacacuuacac

SEQ ID NO: 5671 - RNA, 18 nt, Artificial Sequence
  Synthetic
gaagacagagguggccac

SEQ ID NO: 5672 - RNA, 19 nt, Artificial Sequence
  Synthetic
ggaagacagagguggccac

SEQ ID NO: 5673 - RNA, 21 nt, Artificial Sequence
  Synthetic
ggggaagacagagguggccac

SEQ ID NO: 5674 - RNA, 22 nt, Artificial Sequence
  Synthetic
gggggaagacagagguggccac

SEQ ID NO: 5675 - RNA, 23 nt, Artificial Sequence
  Synthetic
ugggggaagacagagguggccac

SEQ ID NO: 5676 - RNA, 24 nt, Artificial Sequence
  Synthetic
augggggaagacagagguggccac

SEQ ID NO: 5677 - RNA, 18 nt, Artificial Sequence
  Synthetic
ucuccagcucagaugcac

SEQ ID NO: 5678 - RNA, 19 nt, Artificial Sequence
  Synthetic
gucuccagcucagaugcac

SEQ ID NO: 5679 - RNA, 21 nt, Artificial Sequence
  Synthetic
gagucuccagcucagaugcac

SEQ ID NO: 5680 - RNA, 22 nt, Artificial Sequence
  Synthetic
ggagucuccagcucagaugcac

SEQ ID NO: 5681 - RNA, 23 nt, Artificial Sequence
  Synthetic
aggagucuccagcucagaugcac

SEQ ID NO: 5682 - RNA, 24 nt, Artificial Sequence
  Synthetic
aaggagucuccagcucagaugcac

SEQ ID NO: 5683 - RNA, 18 nt, Artificial Sequence
  Synthetic
cuggguggggcugugcac

SEQ ID NO: 5684 - RNA, 19 nt, Artificial Sequence
  Synthetic
gcuggguggggcugugcac

SEQ ID NO: 5685 - RNA, 21 nt, Artificial Sequence
  Synthetic
aggcuggguggggcugugcac

SEQ ID NO: 5686 - RNA, 22 nt, Artificial Sequence
  Synthetic
gaggcuggguggggcugugcac

SEQ ID NO: 5687 - RNA, 23 nt, Artificial Sequence
  Synthetic
ugaggcuggguggggcugugcac

SEQ ID NO: 5688 - RNA, 24 nt, Artificial Sequence
  Synthetic
gugaggcuggguggggcugugcac

SEQ ID NO: 5689 - RNA, 18 nt, Artificial Sequence
  Synthetic
aaagauaaaaaggcucac

SEQ ID NO: 5690 - RNA, 19 nt, Artificial Sequence
  Synthetic
aaaagauaaaaaggcucac

SEQ ID NO: 5691 - RNA, 21 nt, Artificial Sequence
  Synthetic
agaaaagauaaaaaggcucac

SEQ ID NO: 5692 - RNA, 22 nt, Artificial Sequence
  Synthetic
gagaaaagauaaaaaggcucac

SEQ ID NO: 5693 - RNA, 23 nt, Artificial Sequence
  Synthetic
agagaaaagauaaaaaggcucac

SEQ ID NO: 5694 - RNA, 24 nt, Artificial Sequence
  Synthetic
cagagaaaagauaaaaaggcucac

SEQ ID NO: 5695 - RNA, 18 nt, Artificial Sequence
  Synthetic
ugcaccaggacgauucac

SEQ ID NO: 5696 - RNA, 19 nt, Artificial Sequence
  Synthetic
augcaccaggacgauucac

SEQ ID NO: 5697 - RNA, 21 nt, Artificial Sequence
  Synthetic
agaugcaccaggacgauucac

SEQ ID NO: 5698 - RNA, 22 nt, Artificial Sequence
  Synthetic
cagaugcaccaggacgauucac

SEQ ID NO: 5699 - RNA, 23 nt, Artificial Sequence
  Synthetic
ucagaugcaccaggacgauucac

SEQ ID NO: 5700 - RNA, 24 nt, Artificial Sequence
  Synthetic
cucagaugcaccaggacgauucac

SEQ ID NO: 5701 - RNA, 18 nt, Artificial Sequence
  Synthetic
aguaguugcccagaagac

SEQ ID NO: 5702 - RNA, 19 nt, Artificial Sequence
  Synthetic
gaguaguugcccagaagac

SEQ ID NO: 5703 - RNA, 18 nt, Artificial Sequence
  Synthetic
ggaggaggcuuggaagac

SEQ ID NO: 5704 - RNA, 19 nt, Artificial Sequence
  Synthetic
aggaggaggcuuggaagac

SEQ ID NO: 5705 - RNA, 21 nt, Artificial Sequence
  Synthetic
ggaggaggaggcuuggaagac

SEQ ID NO: 5706 - RNA, 22 nt, Artificial Sequence
  Synthetic
uggaggaggaggcuuggaagac

SEQ ID NO: 5707 - RNA, 23 nt, Artificial Sequence
  Synthetic
auggaggaggaggcuuggaagac

SEQ ID NO: 5708 - RNA, 24 nt, Artificial Sequence
  Synthetic
gauggaggaggaggcuuggaagac

SEQ ID NO: 5709 - RNA, 18 nt, Artificial Sequence
  Synthetic
ccuggaauucuccuggac

SEQ ID NO: 5710 - RNA, 19 nt, Artificial Sequence
  Synthetic
uccuggaauucuccuggac

SEQ ID NO: 5711 - RNA, 21 nt, Artificial Sequence
  Synthetic
ccuccuggaauucuccuggac

SEQ ID NO: 5712 - RNA, 22 nt, Artificial Sequence
  Synthetic
accuccuggaauucuccuggac

SEQ ID NO: 5713 - RNA, 23 nt, Artificial Sequence
  Synthetic
caccuccuggaauucuccuggac

SEQ ID NO: 5714 - RNA, 24 nt, Artificial Sequence
  Synthetic
ccaccuccuggaauucuccuggac

SEQ ID NO: 5715 - RNA, 18 nt, Artificial Sequence
  Synthetic
agagagguuuauauauac

SEQ ID NO: 5716 - RNA, 19 nt, Artificial Sequence
  Synthetic
cagagagguuuauauauac

SEQ ID NO: 5717 - RNA, 21 nt, Artificial Sequence
  Synthetic
uccagagagguuuauauauac

SEQ ID NO: 5718 - RNA, 22 nt, Artificial Sequence
  Synthetic
cuccagagagguuuauauauac

SEQ ID NO: 5719 - RNA, 23 nt, Artificial Sequence
  Synthetic
gcuccagagagguuuauauauac

SEQ ID NO: 5720 - RNA, 24 nt, Artificial Sequence
  Synthetic
agcuccagagagguuuauauauac

SEQ ID NO: 5721 - RNA, 18 nt, Artificial Sequence
  Synthetic
ggaaaacccaugcacacc

SEQ ID NO: 5722 - RNA, 19 nt, Artificial Sequence
  Synthetic
aggaaaacccaugcacacc

SEQ ID NO: 5723 - RNA, 21 nt, Artificial Sequence
  Synthetic
gaaggaaaacccaugcacacc

SEQ ID NO: 5724 - RNA, 22 nt, Artificial Sequence
  Synthetic
ugaaggaaaacccaugcacacc

SEQ ID NO: 5725 - RNA, 23 nt, Artificial Sequence
  Synthetic
gugaaggaaaacccaugcacacc

SEQ ID NO: 5726 - RNA, 24 nt, Artificial Sequence
  Synthetic
cgugaaggaaaacccaugcacacc

SEQ ID NO: 5727 - RNA, 18 nt, Artificial Sequence
  Synthetic
cagguugcucaggacacc

SEQ ID NO: 5728 - RNA, 19 nt, Artificial Sequence
  Synthetic
gcagguugcucaggacacc

SEQ ID NO: 5729 - RNA, 21 nt, Artificial Sequence
  Synthetic
uggcagguugcucaggacacc

SEQ ID NO: 5730 - RNA, 22 nt, Artificial Sequence
  Synthetic
cuggcagguugcucaggacacc

SEQ ID NO: 5731 - RNA, 23 nt, Artificial Sequence
  Synthetic
gcuggcagguugcucaggacacc

SEQ ID NO: 5732 - RNA, 24 nt, Artificial Sequence
  Synthetic
ggcuggcagguugcucaggacacc

SEQ ID NO: 5733 - RNA, 18 nt, Artificial Sequence
  Synthetic
cggaaaacucccagcccc

SEQ ID NO: 5734 - RNA, 19 nt, Artificial Sequence
  Synthetic
acggaaaacucccagcccc

SEQ ID NO: 5735 - RNA, 21 nt, Artificial Sequence
  Synthetic
caacggaaaacucccagcccc

SEQ ID NO: 5736 - RNA, 22 nt, Artificial Sequence
  Synthetic
gcaacggaaaacucccagcccc

SEQ ID NO: 5737 - RNA, 23 nt, Artificial Sequence
  Synthetic
agcaacggaaaacucccagcccc

SEQ ID NO: 5738 - RNA, 24 nt, Artificial Sequence
  Synthetic
aagcaacggaaaacucccagcccc

SEQ ID NO: 5739 - RNA, 18 nt, Artificial Sequence
  Synthetic
uagaaagcaacagguccc

SEQ ID NO: 5740 - RNA, 19 nt, Artificial Sequence
  Synthetic
auagaaagcaacagguccc

SEQ ID NO: 5741 - RNA, 21 nt, Artificial Sequence
  Synthetic
aaauagaaagcaacagguccc

SEQ ID NO: 5742 - RNA, 22 nt, Artificial Sequence
  Synthetic
gaaauagaaagcaacagguccc

SEQ ID NO: 5743 - RNA, 23 nt, Artificial Sequence
  Synthetic
agaaauagaaagcaacagguccc

SEQ ID NO: 5744 - RNA, 24 nt, Artificial Sequence
  Synthetic
cagaaauagaaagcaacagguccc

SEQ ID NO: 5745 - RNA, 18 nt, Artificial Sequence
  Synthetic
uuucuggagccuggagcc

SEQ ID NO: 5746 - RNA, 19 nt, Artificial Sequence
  Synthetic
cuuucuggagccuggagcc

SEQ ID NO: 5747 - RNA, 21 nt, Artificial Sequence
  Synthetic
uccuuucuggagccuggagcc

SEQ ID NO: 5748 - RNA, 22 nt, Artificial Sequence
  Synthetic
uuccuuucuggagccuggagcc

SEQ ID NO: 5749 - RNA, 23 nt, Artificial Sequence
  Synthetic
uuuccuuucuggagccuggagcc

SEQ ID NO: 5750 - RNA, 24 nt, Artificial Sequence
  Synthetic
auuuccuuucuggagccuggagcc

SEQ ID NO: 5751 - RNA, 18 nt, Artificial Sequence
  Synthetic
cauuuccuuucuggagcc

SEQ ID NO: 5752 - RNA, 19 nt, Artificial Sequence
  Synthetic
ccauuuccuuucuggagcc

SEQ ID NO: 5753 - RNA, 21 nt, Artificial Sequence
  Synthetic
cuccauuuccuuucuggagcc

SEQ ID NO: 5754 - RNA, 22 nt, Artificial Sequence
  Synthetic
ucuccauuuccuuucuggagcc

SEQ ID NO: 5755 - RNA, 23 nt, Artificial Sequence
  Synthetic
cucuccauuuccuuucuggagcc

SEQ ID NO: 5756 - RNA, 24 nt, Artificial Sequence
  Synthetic
ccucuccauuuccuuucuggagcc

SEQ ID NO: 5757 - RNA, 18 nt, Artificial Sequence
  Synthetic
uuccgugaauuaacggcc

SEQ ID NO: 5758 - RNA, 19 nt, Artificial Sequence
  Synthetic
cuuccgugaauuaacggcc

SEQ ID NO: 5759 - RNA, 21 nt, Artificial Sequence
  Synthetic
uucuuccgugaauuaacggcc

SEQ ID NO: 5760 - RNA, 22 nt, Artificial Sequence
  Synthetic
cuucuuccgugaauuaacggcc

SEQ ID NO: 5761 - RNA, 23 nt, Artificial Sequence
  Synthetic
acuucuuccgugaauuaacggcc

SEQ ID NO: 5762 - RNA, 24 nt, Artificial Sequence
  Synthetic
cacuucuuccgugaauuaacggcc

SEQ ID NO: 5763 - RNA, 18 nt, Artificial Sequence
  Synthetic
ggagaggaaaccucugcc

SEQ ID NO: 5764 - RNA, 19 nt, Artificial Sequence
  Synthetic
uggagaggaaaccucugcc

SEQ ID NO: 5765 - RNA, 21 nt, Artificial Sequence
  Synthetic
gcuggagaggaaaccucugcc

SEQ ID NO: 5766 - RNA, 22 nt, Artificial Sequence
  Synthetic
agcuggagaggaaaccucugcc

SEQ ID NO: 5767 - RNA, 23 nt, Artificial Sequence
  Synthetic
cagcuggagaggaaaccucugcc

SEQ ID NO: 5768 - RNA, 24 nt, Artificial Sequence
  Synthetic
ccagcuggagaggaaaccucugcc

SEQ ID NO: 5769 - RNA, 18 nt, Artificial Sequence
  Synthetic
ugagaaacugucaccucc

SEQ ID NO: 5770 - RNA, 19 nt, Artificial Sequence
  Synthetic
augagaaacugucaccucc

SEQ ID NO: 5771 - RNA, 21 nt, Artificial Sequence
  Synthetic
ccaugagaaacugucaccucc

SEQ ID NO: 5772 - RNA, 22 nt, Artificial Sequence
  Synthetic
uccaugagaaacugucaccucc

SEQ ID NO: 5773 - RNA, 23 nt, Artificial Sequence
  Synthetic
uuccaugagaaacugucaccucc

SEQ ID NO: 5774 - RNA, 24 nt, Artificial Sequence
  Synthetic
cuuccaugagaaacugucaccucc

SEQ ID NO: 5775 - RNA, 18 nt, Artificial Sequence
  Synthetic
uucuucugcacgucuucc

SEQ ID NO: 5776 - RNA, 19 nt, Artificial Sequence
  Synthetic
uuucuucugcacgucuucc

SEQ ID NO: 5777 - RNA, 21 nt, Artificial Sequence
  Synthetic
auuuucuucugcacgucuucc

SEQ ID NO: 5778 - RNA, 22 nt, Artificial Sequence
  Synthetic
aauuuucuucugcacgucuucc

SEQ ID NO: 5779 - RNA, 23 nt, Artificial Sequence
  Synthetic
uaauuuucuucugcacgucuucc

SEQ ID NO: 5780 - RNA, 24 nt, Artificial Sequence
  Synthetic
uuaauuuucuucugcacgucuucc

SEQ ID NO: 5781 - RNA, 18 nt, Artificial Sequence
  Synthetic
uugcagggcucccccagc

SEQ ID NO: 5782 - RNA, 19 nt, Artificial Sequence
  Synthetic
cuugcagggcucccccagc

SEQ ID NO: 5783 - RNA, 21 nt, Artificial Sequence
  Synthetic
ugcuugcagggcucccccagc

SEQ ID NO: 5784 - RNA, 22 nt, Artificial Sequence
  Synthetic
gugcuugcagggcucccccagc

SEQ ID NO: 5785 - RNA, 23 nt, Artificial Sequence
  Synthetic
ggugcuugcagggcucccccagc

SEQ ID NO: 5786 - RNA, 24 nt, Artificial Sequence
  Synthetic
gggugcuugcagggcucccccagc

SEQ ID NO: 5787 - RNA, 18 nt, Artificial Sequence
  Synthetic
agaaaaauaacagccagc

SEQ ID NO: 5788 - RNA, 19 nt, Artificial Sequence
  Synthetic
gagaaaaauaacagccagc

SEQ ID NO: 5789 - RNA, 21 nt, Artificial Sequence
  Synthetic
cagagaaaaauaacagccagc

SEQ ID NO: 5790 - RNA, 22 nt, Artificial Sequence
  Synthetic
acagagaaaaauaacagccagc

SEQ ID NO: 5791 - RNA, 23 nt, Artificial Sequence
  Synthetic
gacagagaaaaauaacagccagc

SEQ ID NO: 5792 - RNA, 24 nt, Artificial Sequence
  Synthetic
ggacagagaaaaauaacagccagc

SEQ ID NO: 5793 - RNA, 18 nt, Artificial Sequence
  Synthetic
gggcacgauggaggcagc

SEQ ID NO: 5794 - RNA, 19 nt, Artificial Sequence
  Synthetic
cgggcacgauggaggcagc

SEQ ID NO: 5795 - RNA, 21 nt, Artificial Sequence
  Synthetic
uccgggcacgauggaggcagc

SEQ ID NO: 5796 - RNA, 22 nt, Artificial Sequence
  Synthetic
cuccgggcacgauggaggcagc

SEQ ID NO: 5797 - RNA, 23 nt, Artificial Sequence
  Synthetic
ccuccgggcacgauggaggcagc

SEQ ID NO: 5798 - RNA, 24 nt, Artificial Sequence
  Synthetic
gccuccgggcacgauggaggcagc

SEQ ID NO: 5799 - RNA, 18 nt, Artificial Sequence
  Synthetic
ccauuuccuuucuggagc

SEQ ID NO: 5800 - RNA, 19 nt, Artificial Sequence
  Synthetic
uccauuuccuuucuggagc

SEQ ID NO: 5801 - RNA, 21 nt, Artificial Sequence
  Synthetic
ucuccauuuccuuucuggagc

SEQ ID NO: 5802 - RNA, 22 nt, Artificial Sequence
  Synthetic
cucuccauuuccuuucuggagc

SEQ ID NO: 5803 - RNA, 23 nt, Artificial Sequence
  Synthetic
ccucuccauuuccuuucuggagc

SEQ ID NO: 5804 - RNA, 24 nt, Artificial Sequence
  Synthetic
cccucuccauuuccuuucuggagc

SEQ ID NO: 5805 - RNA, 18 nt, Artificial Sequence
  Synthetic
aguccuuuaagacguagc

SEQ ID NO: 5806 - RNA, 19 nt, Artificial Sequence
  Synthetic
aaguccuuuaagacguagc

SEQ ID NO: 5807 - RNA, 21 nt, Artificial Sequence
  Synthetic
acaaguccuuuaagacguagc

SEQ ID NO: 5808 - RNA, 22 nt, Artificial Sequence
  Synthetic
aacaaguccuuuaagacguagc

SEQ ID NO: 5809 - RNA, 23 nt, Artificial Sequence
  Synthetic
aaacaaguccuuuaagacguagc

SEQ ID NO: 5810 - RNA, 24 nt, Artificial Sequence
  Synthetic
caaacaaguccuuuaagacguagc

SEQ ID NO: 5811 - RNA, 18 nt, Artificial Sequence
  Synthetic
ggaggcagcagggggcgc

SEQ ID NO: 5812 - RNA, 19 nt, Artificial Sequence
  Synthetic
uggaggcagcagggggcgc

SEQ ID NO: 5813 - RNA, 21 nt, Artificial Sequence
  Synthetic
gauggaggcagcagggggcgc

SEQ ID NO: 5814 - RNA, 22 nt, Artificial Sequence
  Synthetic
cgauggaggcagcagggggcgc

SEQ ID NO: 5815 - RNA, 23 nt, Artificial Sequence
  Synthetic
acgauggaggcagcagggggcgc

SEQ ID NO: 5816 - RNA, 24 nt, Artificial Sequence
  Synthetic
cacgauggaggcagcagggggcgc

SEQ ID NO: 5817 - RNA, 18 nt, Artificial Sequence
  Synthetic
acugauggaggaggaggc

SEQ ID NO: 5818 - RNA, 19 nt, Artificial Sequence
  Synthetic
gacugauggaggaggaggc

SEQ ID NO: 5819 - RNA, 21 nt, Artificial Sequence
  Synthetic
gugacugauggaggaggaggc

SEQ ID NO: 5820 - RNA, 22 nt, Artificial Sequence
  Synthetic
ugugacugauggaggaggaggc

SEQ ID NO: 5821 - RNA, 23 nt, Artificial Sequence
  Synthetic
cugugacugauggaggaggaggc

SEQ ID NO: 5822 - RNA, 24 nt, Artificial Sequence
  Synthetic
gcugugacugauggaggaggaggc

SEQ ID NO: 5823 - RNA, 18 nt, Artificial Sequence
  Synthetic
ggcuuggaagacucgggc

SEQ ID NO: 5824 - RNA, 19 nt, Artificial Sequence
  Synthetic
aggcuuggaagacucgggc

SEQ ID NO: 5825 - RNA, 21 nt, Artificial Sequence
  Synthetic
ggaggcuuggaagacucgggc

SEQ ID NO: 5826 - RNA, 22 nt, Artificial Sequence
  Synthetic
aggaggcuuggaagacucgggc

SEQ ID NO: 5827 - RNA, 23 nt, Artificial Sequence
  Synthetic
gaggaggcuuggaagacucgggc

SEQ ID NO: 5828 - RNA, 24 nt, Artificial Sequence
  Synthetic
ggaggaggcuuggaagacucgggc

SEQ ID NO: 5829 - RNA, 18 nt, Artificial Sequence
  Synthetic
aacaaaacaaccaguggc

SEQ ID NO: 5830 - RNA, 19 nt, Artificial Sequence
  Synthetic
uaacaaaacaaccaguggc

SEQ ID NO: 5831 - RNA, 21 nt, Artificial Sequence
  Synthetic
gauaacaaaacaaccaguggc

SEQ ID NO: 5832 - RNA, 22 nt, Artificial Sequence
  Synthetic
ugauaacaaaacaaccaguggc

SEQ ID NO: 5833 - RNA, 23 nt, Artificial Sequence
  Synthetic
gugauaacaaaacaaccaguggc

SEQ ID NO: 5834 - RNA, 24 nt, Artificial Sequence
  Synthetic
agugauaacaaaacaaccaguggc

SEQ ID NO: 5835 - RNA, 18 nt, Artificial Sequence
  Synthetic
ggccuugcuggcucaugc

SEQ ID NO: 5836 - RNA, 19 nt, Artificial Sequence
  Synthetic
uggccuugcuggcucaugc

SEQ ID NO: 5837 - RNA, 21 nt, Artificial Sequence
  Synthetic
gguggccuugcuggcucaugc

SEQ ID NO: 5838 - RNA, 22 nt, Artificial Sequence
  Synthetic
ggguggccuugcuggcucaugc

SEQ ID NO: 5839 - RNA, 23 nt, Artificial Sequence
  Synthetic
uggguggccuugcuggcucaugc

SEQ ID NO: 5840 - RNA, 24 nt, Artificial Sequence
  Synthetic
auggguggccuugcuggcucaugc

SEQ ID NO: 5841 - RNA, 18 nt, Artificial Sequence
  Synthetic
cugugccaggcacuaugc

SEQ ID NO: 5842 - RNA, 19 nt, Artificial Sequence
  Synthetic
acugugccaggcacuaugc

SEQ ID NO: 5843 - RNA, 21 nt, Artificial Sequence
  Synthetic
gcacugugccaggcacuaugc

SEQ ID NO: 5844 - RNA, 22 nt, Artificial Sequence
  Synthetic
ugcacugugccaggcacuaugc

SEQ ID NO: 5845 - RNA, 23 nt, Artificial Sequence
  Synthetic
cugcacugugccaggcacuaugc

SEQ ID NO: 5846 - RNA, 24 nt, Artificial Sequence
  Synthetic
ccugcacugugccaggcacuaugc

SEQ ID NO: 5847 - RNA, 18 nt, Artificial Sequence
  Synthetic
uggagaggaaaccucugc

SEQ ID NO: 5848 - RNA, 19 nt, Artificial Sequence
  Synthetic
cuggagaggaaaccucugc

SEQ ID NO: 5849 - RNA, 21 nt, Artificial Sequence
  Synthetic
agcuggagaggaaaccucugc

SEQ ID NO: 5850 - RNA, 22 nt, Artificial Sequence
  Synthetic
cagcuggagaggaaaccucugc

SEQ ID NO: 5851 - RNA, 23 nt, Artificial Sequence
  Synthetic
ccagcuggagaggaaaccucugc

SEQ ID NO: 5852 - RNA, 24 nt, Artificial Sequence
  Synthetic
cccagcuggagaggaaaccucugc

SEQ ID NO: 5853 - RNA, 18 nt, Artificial Sequence
  Synthetic
cccugcaguccccaccuc

SEQ ID NO: 5854 - RNA, 19 nt, Artificial Sequence
  Synthetic
ucccugcaguccccaccuc

SEQ ID NO: 5855 - RNA, 21 nt, Artificial Sequence
  Synthetic
acucccugcaguccccaccuc

SEQ ID NO: 5856 - RNA, 22 nt, Artificial Sequence
  Synthetic
cacucccugcaguccccaccuc

SEQ ID NO: 5857 - RNA, 23 nt, Artificial Sequence
  Synthetic
ccacucccugcaguccccaccuc

SEQ ID NO: 5858 - RNA, 24 nt, Artificial Sequence
  Synthetic
cccacucccugcaguccccaccuc

SEQ ID NO: 5859 - RNA, 18 nt, Artificial Sequence
  Synthetic
uggcucaugcccgagcuc

SEQ ID NO: 5860 - RNA, 19 nt, Artificial Sequence
  Synthetic
cuggcucaugcccgagcuc

SEQ ID NO: 5861 - RNA, 21 nt, Artificial Sequence
  Synthetic
ugcuggcucaugcccgagcuc

SEQ ID NO: 5862 - RNA, 22 nt, Artificial Sequence
  Synthetic
uugcuggcucaugcccgagcuc

SEQ ID NO: 5863 - RNA, 23 nt, Artificial Sequence
  Synthetic
cuugcuggcucaugcccgagcuc

SEQ ID NO: 5864 - RNA, 24 nt, Artificial Sequence
  Synthetic
ccuugcuggcucaugcccgagcuc

SEQ ID NO: 5865 - RNA, 18 nt, Artificial Sequence
  Synthetic
ccaccuccuggaauucuc

SEQ ID NO: 5866 - RNA, 19 nt, Artificial Sequence
  Synthetic
cccaccuccuggaauucuc

SEQ ID NO: 5867 - RNA, 21 nt, Artificial Sequence
  Synthetic
uccccaccuccuggaauucuc

SEQ ID NO: 5868 - RNA, 22 nt, Artificial Sequence
  Synthetic
guccccaccuccuggaauucuc

SEQ ID NO: 5869 - RNA, 23 nt, Artificial Sequence
  Synthetic
aguccccaccuccuggaauucuc

SEQ ID NO: 5870 - RNA, 24 nt, Artificial Sequence
  Synthetic
caguccccaccuccuggaauucuc

SEQ ID NO: 5871 - RNA, 18 nt, Artificial Sequence
  Synthetic
gaugcaccaggacgauuc

SEQ ID NO: 5872 - RNA, 19 nt, Artificial Sequence
  Synthetic
agaugcaccaggacgauuc

SEQ ID NO: 5873 - RNA, 21 nt, Artificial Sequence
  Synthetic
ucagaugcaccaggacgauuc

SEQ ID NO: 5874 - RNA, 22 nt, Artificial Sequence
  Synthetic
cucagaugcaccaggacgauuc

SEQ ID NO: 5875 - RNA, 23 nt, Artificial Sequence
  Synthetic
gcucagaugcaccaggacgauuc

SEQ ID NO: 5876 - RNA, 24 nt, Artificial Sequence
  Synthetic
agcucagaugcaccaggacgauuc

SEQ ID NO: 5877 - RNA, 18 nt, Artificial Sequence
  Synthetic
ucuuagaaaauaaccuuc

SEQ ID NO: 5878 - RNA, 19 nt, Artificial Sequence
  Synthetic
uucuuagaaaauaaccuuc

SEQ ID NO: 5879 - RNA, 21 nt, Artificial Sequence
  Synthetic
gauucuuagaaaauaaccuuc

SEQ ID NO: 5880 - RNA, 22 nt, Artificial Sequence
  Synthetic
agauucuuagaaaauaaccuuc

SEQ ID NO: 5881 - RNA, 23 nt, Artificial Sequence
  Synthetic
aagauucuuagaaaauaaccuuc

SEQ ID NO: 5882 - RNA, 24 nt, Artificial Sequence
  Synthetic
caagauucuuagaaaauaaccuuc

SEQ ID NO: 5883 - RNA, 18 nt, Artificial Sequence
  Synthetic
cuggggagccagcccuuc

SEQ ID NO: 5884 - RNA, 19 nt, Artificial Sequence
  Synthetic
acuggggagccagcccuuc

SEQ ID NO: 5885 - RNA, 21 nt, Artificial Sequence
  Synthetic
auacuggggagccagcccuuc

SEQ ID NO: 5886 - RNA, 22 nt, Artificial Sequence
  Synthetic
uauacuggggagccagcccuuc

SEQ ID NO: 5887 - RNA, 23 nt, Artificial Sequence
  Synthetic
auauacuggggagccagcccuuc

SEQ ID NO: 5888 - RNA, 24 nt, Artificial Sequence
  Synthetic
uauauacuggggagccagcccuuc

SEQ ID NO: 5889 - RNA, 18 nt, Artificial Sequence
  Synthetic
augaaacugcaucccuuc

SEQ ID NO: 5890 - RNA, 19 nt, Artificial Sequence
  Synthetic
uaugaaacugcaucccuuc

SEQ ID NO: 5891 - RNA, 21 nt, Artificial Sequence
  Synthetic
uuuaugaaacugcaucccuuc

SEQ ID NO: 5892 - RNA, 22 nt, Artificial Sequence
  Synthetic
cuuuaugaaacugcaucccuuc

SEQ ID NO: 5893 - RNA, 23 nt, Artificial Sequence
  Synthetic
acuuuaugaaacugcaucccuuc

SEQ ID NO: 5894 - RNA, 24 nt, Artificial Sequence
  Synthetic
gacuuuaugaaacugcaucccuuc

SEQ ID NO: 5895 - RNA, 18 nt, Artificial Sequence
  Synthetic
cauuaaauaaaggccuuc

SEQ ID NO: 5896 - RNA, 19 nt, Artificial Sequence
  Synthetic
ccauuaaauaaaggccuuc

SEQ ID NO: 5897 - RNA, 21 nt, Artificial Sequence
  Synthetic
ucccauuaaauaaaggccuuc

SEQ ID NO: 5898 - RNA, 22 nt, Artificial Sequence
  Synthetic
uucccauuaaauaaaggccuuc

SEQ ID NO: 5899 - RNA, 23 nt, Artificial Sequence
  Synthetic
auucccauuaaauaaaggccuuc

SEQ ID NO: 5900 - RNA, 24 nt, Artificial Sequence
  Synthetic
uauucccauuaaauaaaggccuuc

SEQ ID NO: 5901 - RNA, 18 nt, Artificial Sequence
  Synthetic
cccucuccauuuccuuuc

SEQ ID NO: 5902 - RNA, 19 nt, Artificial Sequence
  Synthetic
ucccucuccauuuccuuuc

SEQ ID NO: 5903 - RNA, 21 nt, Artificial Sequence
  Synthetic
uuucccucuccauuuccuuuc

SEQ ID NO: 5904 - RNA, 22 nt, Artificial Sequence
  Synthetic
guuucccucuccauuuccuuuc

SEQ ID NO: 5905 - RNA, 23 nt, Artificial Sequence
  Synthetic
aguuucccucuccauuuccuuuc

SEQ ID NO: 5906 - RNA, 24 nt, Artificial Sequence
  Synthetic
uaguuucccucuccauuuccuuuc

SEQ ID NO: 5907 - RNA, 18 nt, Artificial Sequence
  Synthetic
gacuucuucuccuccaag

SEQ ID NO: 5908 - RNA, 19 nt, Artificial Sequence
  Synthetic
agacuucuucuccuccaag

SEQ ID NO: 5909 - RNA, 21 nt, Artificial Sequence
  Synthetic
auagacuucuucuccuccaag

SEQ ID NO: 5910 - RNA, 22 nt, Artificial Sequence
  Synthetic
aauagacuucuucuccuccaag

SEQ ID NO: 5911 - RNA, 23 nt, Artificial Sequence
  Synthetic
aaauagacuucuucuccuccaag

SEQ ID NO: 5912 - RNA, 24 nt, Artificial Sequence
  Synthetic
gaaauagacuucuucuccuccaag

SEQ ID NO: 5913 - RNA, 18 nt, Artificial Sequence
  Synthetic
cuugcagggcucccccag

SEQ ID NO: 5914 - RNA, 19 nt, Artificial Sequence
  Synthetic
gcuugcagggcucccccag

SEQ ID NO: 5915 - RNA, 21 nt, Artificial Sequence
  Synthetic
gugcuugcagggcucccccag

SEQ ID NO: 5916 - RNA, 22 nt, Artificial Sequence
  Synthetic
ggugcuugcagggcucccccag

SEQ ID NO: 5917 - RNA, 23 nt, Artificial Sequence
  Synthetic
gggugcuugcagggcucccccag

SEQ ID NO: 5918 - RNA, 24 nt, Artificial Sequence
  Synthetic
cgggugcuugcagggcucccccag

SEQ ID NO: 5919 - RNA, 18 nt, Artificial Sequence
  Synthetic
cgggcacgauggaggcag

SEQ ID NO: 5920 - RNA, 19 nt, Artificial Sequence
  Synthetic
ccgggcacgauggaggcag

SEQ ID NO: 5921 - RNA, 21 nt, Artificial Sequence
  Synthetic
cuccgggcacgauggaggcag

SEQ ID NO: 5922 - RNA, 22 nt, Artificial Sequence
  Synthetic
ccuccgggcacgauggaggcag

SEQ ID NO: 5923 - RNA, 23 nt, Artificial Sequence
  Synthetic
gccuccgggcacgauggaggcag

SEQ ID NO: 5924 - RNA, 24 nt, Artificial Sequence
  Synthetic
ggccuccgggcacgauggaggcag

SEQ ID NO: 5925 - RNA, 18 nt, Artificial Sequence
  Synthetic
gcgcugugacugauggag

SEQ ID NO: 5926 - RNA, 19 nt, Artificial Sequence
  Synthetic
agcgcugugacugauggag

SEQ ID NO: 5927 - RNA, 21 nt, Artificial Sequence
  Synthetic
gcagcgcugugacugauggag

SEQ ID NO: 5928 - RNA, 22 nt, Artificial Sequence
  Synthetic
ugcagcgcugugacugauggag

SEQ ID NO: 5929 - RNA, 23 nt, Artificial Sequence
  Synthetic
cugcagcgcugugacugauggag

SEQ ID NO: 5930 - RNA, 24 nt, Artificial Sequence
  Synthetic
gcugcagcgcugugacugauggag

SEQ ID NO: 5931 - RNA, 18 nt, Artificial Sequence
  Synthetic
gggcucccccagcuggag

SEQ ID NO: 5932 - RNA, 19 nt, Artificial Sequence
  Synthetic
agggcucccccagcuggag

SEQ ID NO: 5933 - RNA, 21 nt, Artificial Sequence
  Synthetic
gcagggcucccccagcuggag

SEQ ID NO: 5934 - RNA, 22 nt, Artificial Sequence
  Synthetic
ugcagggcucccccagcuggag

SEQ ID NO: 5935 - RNA, 23 nt, Artificial Sequence
  Synthetic
uugcagggcucccccagcuggag

SEQ ID NO: 5936 - RNA, 24 nt, Artificial Sequence
  Synthetic
cuugcagggcucccccagcuggag

SEQ ID NO: 5937 - RNA, 18 nt, Artificial Sequence
  Synthetic
aaguccuuuaagacguag

SEQ ID NO: 5938 - RNA, 19 nt, Artificial Sequence
  Synthetic
caaguccuuuaagacguag

SEQ ID NO: 5939 - RNA, 21 nt, Artificial Sequence
  Synthetic
aacaaguccuuuaagacguag

SEQ ID NO: 5940 - RNA, 22 nt, Artificial Sequence
  Synthetic
aaacaaguccuuuaagacguag

SEQ ID NO: 5941 - RNA, 23 nt, Artificial Sequence
  Synthetic
caaacaaguccuuuaagacguag

SEQ ID NO: 5942 - RNA, 24 nt, Artificial Sequence
  Synthetic
ccaaacaaguccuuuaagacguag

SEQ ID NO: 5943 - RNA, 18 nt, Artificial Sequence
  Synthetic
ugggggccuccgggcacg

SEQ ID NO: 5944 - RNA, 19 nt, Artificial Sequence
  Synthetic
uugggggccuccgggcacg

SEQ ID NO: 5945 - RNA, 21 nt, Artificial Sequence
  Synthetic
gcuugggggccuccgggcacg

SEQ ID NO: 5946 - RNA, 22 nt, Artificial Sequence
  Synthetic
ggcuugggggccuccgggcacg

SEQ ID NO: 5947 - RNA, 23 nt, Artificial Sequence
  Synthetic
gggcuugggggccuccgggcacg

SEQ ID NO: 5948 - RNA, 24 nt, Artificial Sequence
  Synthetic
cgggcuugggggccuccgggcacg

SEQ ID NO: 5949 - RNA, 18 nt, Artificial Sequence
  Synthetic
cuggaauucuccuggacg

SEQ ID NO: 5950 - RNA, 19 nt, Artificial Sequence
  Synthetic
ccuggaauucuccuggacg

SEQ ID NO: 5951 - RNA, 21 nt, Artificial Sequence
  Synthetic
cuccuggaauucuccuggacg

SEQ ID NO: 5952 - RNA, 22 nt, Artificial Sequence
  Synthetic
ccuccuggaauucuccuggacg

SEQ ID NO: 5953 - RNA, 23 nt, Artificial Sequence
  Synthetic
accuccuggaauucuccuggacg

SEQ ID NO: 5954 - RNA, 24 nt, Artificial Sequence
  Synthetic
caccuccuggaauucuccuggacg

SEQ ID NO: 5955 - RNA, 18 nt, Artificial Sequence
  Synthetic
cugucaccuccacgaagg

SEQ ID NO: 5956 - RNA, 19 nt, Artificial Sequence
  Synthetic
acugucaccuccacgaagg

SEQ ID NO: 5957 - RNA, 21 nt, Artificial Sequence
  Synthetic
aaacugucaccuccacgaagg

SEQ ID NO: 5958 - RNA, 22 nt, Artificial Sequence
  Synthetic
gaaacugucaccuccacgaagg

SEQ ID NO: 5959 - RNA, 23 nt, Artificial Sequence
  Synthetic
agaaacugucaccuccacgaagg

SEQ ID NO: 5960 - RNA, 24 nt, Artificial Sequence
  Synthetic
gagaaacugucaccuccacgaagg

SEQ ID NO: 5961 - RNA, 18 nt, Artificial Sequence
  Synthetic
cgcugugacugauggagg

SEQ ID NO: 5962 - RNA, 19 nt, Artificial Sequence
  Synthetic
gcgcugugacugauggagg

SEQ ID NO: 5963 - RNA, 21 nt, Artificial Sequence
  Synthetic
cagcgcugugacugauggagg

SEQ ID NO: 5964 - RNA, 22 nt, Artificial Sequence
  Synthetic
gcagcgcugugacugauggagg

SEQ ID NO: 5965 - RNA, 23 nt, Artificial Sequence
  Synthetic
ugcagcgcugugacugauggagg

SEQ ID NO: 5966 - RNA, 24 nt, Artificial Sequence
  Synthetic
cugcagcgcugugacugauggagg

SEQ ID NO: 5967 - RNA, 18 nt, Artificial Sequence
  Synthetic
uggccacgugaggcuggg

SEQ ID NO: 5968 - RNA, 19 nt, Artificial Sequence
  Synthetic
guggccacgugaggcuggg

SEQ ID NO: 5969 - RNA, 21 nt, Artificial Sequence
  Synthetic
agguggccacgugaggcuggg

SEQ ID NO: 5970 - RNA, 22 nt, Artificial Sequence
  Synthetic
gagguggccacgugaggcuggg

SEQ ID NO: 5971 - RNA, 23 nt, Artificial Sequence
  Synthetic
agagguggccacgugaggcuggg

SEQ ID NO: 5972 - RNA, 24 nt, Artificial Sequence
  Synthetic
cagagguggccacgugaggcuggg

SEQ ID NO: 5973 - RNA, 18 nt, Artificial Sequence
  Synthetic
ggagccagcccuucaugg

SEQ ID NO: 5974 - RNA, 19 nt, Artificial Sequence
  Synthetic
gggagccagcccuucaugg

SEQ ID NO: 5975 - RNA, 21 nt, Artificial Sequence
  Synthetic
uggggagccagcccuucaugg

SEQ ID NO: 5976 - RNA, 22 nt, Artificial Sequence
  Synthetic
cuggggagccagcccuucaugg

SEQ ID NO: 5977 - RNA, 23 nt, Artificial Sequence
  Synthetic
acuggggagccagcccuucaugg

SEQ ID NO: 5978 - RNA, 24 nt, Artificial Sequence
  Synthetic
uacuggggagccagcccuucaugg

SEQ ID NO: 5979 - RNA, 18 nt, Artificial Sequence
  Synthetic
cagcgcugugacugaugg

SEQ ID NO: 5980 - RNA, 19 nt, Artificial Sequence
  Synthetic
gcagcgcugugacugaugg

SEQ ID NO: 5981 - RNA, 21 nt, Artificial Sequence
  Synthetic
cugcagcgcugugacugaugg

SEQ ID NO: 5982 - RNA, 22 nt, Artificial Sequence
  Synthetic
gcugcagcgcugugacugaugg

SEQ ID NO: 5983 - RNA, 23 nt, Artificial Sequence
  Synthetic
agcugcagcgcugugacugaugg

SEQ ID NO: 5984 - RNA, 24 nt, Artificial Sequence
  Synthetic
cagcugcagcgcugugacugaugg

SEQ ID NO: 5985 - RNA, 18 nt, Artificial Sequence
  Synthetic
guggccacgugaggcugg

SEQ ID NO: 5986 - RNA, 19 nt, Artificial Sequence
  Synthetic
gguggccacgugaggcugg

SEQ ID NO: 5987 - RNA, 21 nt, Artificial Sequence
  Synthetic
gagguggccacgugaggcugg

SEQ ID NO: 5988 - RNA, 22 nt, Artificial Sequence
  Synthetic
agagguggccacgugaggcugg

SEQ ID NO: 5989 - RNA, 23 nt, Artificial Sequence
  Synthetic
cagagguggccacgugaggcugg

SEQ ID NO: 5990 - RNA, 24 nt, Artificial Sequence
  Synthetic
acagagguggccacgugaggcugg

SEQ ID NO: 5991 - RNA, 18 nt, Artificial Sequence
  Synthetic
gggagccagcccuucaug

SEQ ID NO: 5992 - RNA, 19 nt, Artificial Sequence
  Synthetic
ggggagccagcccuucaug

SEQ ID NO: 5993 - RNA, 21 nt, Artificial Sequence
  Synthetic
cuggggagccagcccuucaug

SEQ ID NO: 5994 - RNA, 22 nt, Artificial Sequence
  Synthetic
acuggggagccagcccuucaug

SEQ ID NO: 5995 - RNA, 23 nt, Artificial Sequence
  Synthetic
uacuggggagccagcccuucaug

SEQ ID NO: 5996 - RNA, 24 nt, Artificial Sequence
  Synthetic
auacuggggagccagcccuucaug

SEQ ID NO: 5997 - RNA, 18 nt, Artificial Sequence
  Synthetic
gcagcgcugugacugaug

SEQ ID NO: 5998 - RNA, 19 nt, Artificial Sequence
  Synthetic
ugcagcgcugugacugaug

SEQ ID NO: 5999 - RNA, 21 nt, Artificial Sequence
  Synthetic
gcugcagcgcugugacugaug

SEQ ID NO: 6000 - RNA, 22 nt, Artificial Sequence
  Synthetic
agcugcagcgcugugacugaug

SEQ ID NO: 6001 - RNA, 23 nt, Artificial Sequence
  Synthetic
cagcugcagcgcugugacugaug

SEQ ID NO: 6002 - RNA, 24 nt, Artificial Sequence
  Synthetic
ccagcugcagcgcugugacugaug

SEQ ID NO: 6003 - RNA, 18 nt, Artificial Sequence
  Synthetic
gcugcagcgcugugacug

SEQ ID NO: 6004 - RNA, 19 nt, Artificial Sequence
  Synthetic
agcugcagcgcugugacug

SEQ ID NO: 6005 - RNA, 21 nt, Artificial Sequence
  Synthetic
ccagcugcagcgcugugacug

SEQ ID NO: 6006 - RNA, 22 nt, Artificial Sequence
  Synthetic
gccagcugcagcgcugugacug

SEQ ID NO: 6007 - RNA, 23 nt, Artificial Sequence
  Synthetic
ggccagcugcagcgcugugacug

SEQ ID NO: 6008 - RNA, 24 nt, Artificial Sequence
  Synthetic
aggccagcugcagcgcugugacug

SEQ ID NO: 6009 - RNA, 18 nt, Artificial Sequence
  Synthetic
agagguuuauauauacug

SEQ ID NO: 6010 - RNA, 19 nt, Artificial Sequence
  Synthetic
gagagguuuauauauacug

SEQ ID NO: 6011 - RNA, 21 nt, Artificial Sequence
  Synthetic
cagagagguuuauauauacug

SEQ ID NO: 6012 - RNA, 22 nt, Artificial Sequence
  Synthetic
ccagagagguuuauauauacug

SEQ ID NO: 6013 - RNA, 23 nt, Artificial Sequence
  Synthetic
uccagagagguuuauauauacug

SEQ ID NO: 6014 - RNA, 24 nt, Artificial Sequence
  Synthetic
cuccagagagguuuauauauacug

SEQ ID NO: 6015 - RNA, 18 nt, Artificial Sequence
  Synthetic
gcagggcucccccagcug

SEQ ID NO: 6016 - RNA, 19 nt, Artificial Sequence
  Synthetic
ugcagggcucccccagcug

SEQ ID NO: 6017 - RNA, 21 nt, Artificial Sequence
  Synthetic
cuugcagggcucccccagcug

SEQ ID NO: 6018 - RNA, 22 nt, Artificial Sequence
  Synthetic
gcuugcagggcucccccagcug

SEQ ID NO: 6019 - RNA, 23 nt, Artificial Sequence
  Synthetic
ugcuugcagggcucccccagcug

SEQ ID NO: 6020 - RNA, 24 nt, Artificial Sequence
  Synthetic
gugcuugcagggcucccccagcug

SEQ ID NO: 6021 - RNA, 18 nt, Artificial Sequence
  Synthetic
cuggagaggaaaccucug

SEQ ID NO: 6022 - RNA, 19 nt, Artificial Sequence
  Synthetic
gcuggagaggaaaccucug

SEQ ID NO: 6023 - RNA, 21 nt, Artificial Sequence
  Synthetic
cagcuggagaggaaaccucug

SEQ ID NO: 6024 - RNA, 22 nt, Artificial Sequence
  Synthetic
ccagcuggagaggaaaccucug

SEQ ID NO: 6025 - RNA, 23 nt, Artificial Sequence
  Synthetic
cccagcuggagaggaaaccucug

SEQ ID NO: 6026 - RNA, 24 nt, Artificial Sequence
  Synthetic
ccccagcuggagaggaaaccucug

SEQ ID NO: 6027 - RNA, 18 nt, Artificial Sequence
  Synthetic
gaggccccuuucccucug

SEQ ID NO: 6028 - RNA, 19 nt, Artificial Sequence
  Synthetic
ggaggccccuuucccucug

SEQ ID NO: 6029 - RNA, 21 nt, Artificial Sequence
  Synthetic
guggaggccccuuucccucug

SEQ ID NO: 6030 - RNA, 22 nt, Artificial Sequence
  Synthetic
cguggaggccccuuucccucug

SEQ ID NO: 6031 - RNA, 23 nt, Artificial Sequence
  Synthetic
acguggaggccccuuucccucug

SEQ ID NO: 6032 - RNA, 24 nt, Artificial Sequence
  Synthetic
gacguggaggccccuuucccucug

SEQ ID NO: 6033 - RNA, 18 nt, Artificial Sequence
  Synthetic
uaaauaaaggccuucgug

SEQ ID NO: 6034 - RNA, 19 nt, Artificial Sequence
  Synthetic
uuaaauaaaggccuucgug

SEQ ID NO: 6035 - RNA, 21 nt, Artificial Sequence
  Synthetic
cauuaaauaaaggccuucgug

SEQ ID NO: 6036 - RNA, 22 nt, Artificial Sequence
  Synthetic
ccauuaaauaaaggccuucgug

SEQ ID NO: 6037 - RNA, 23 nt, Artificial Sequence
  Synthetic
cccauuaaauaaaggccuucgug

SEQ ID NO: 6038 - RNA, 24 nt, Artificial Sequence
  Synthetic
ucccauuaaauaaaggccuucgug

SEQ ID NO: 6039 - RNA, 18 nt, Artificial Sequence
  Synthetic
cuggaaagcucugcugug

SEQ ID NO: 6040 - RNA, 19 nt, Artificial Sequence
  Synthetic
ucuggaaagcucugcugug

SEQ ID NO: 6041 - RNA, 21 nt, Artificial Sequence
  Synthetic
ccucuggaaagcucugcugug

SEQ ID NO: 6042 - RNA, 22 nt, Artificial Sequence
  Synthetic
uccucuggaaagcucugcugug

SEQ ID NO: 6043 - RNA, 23 nt, Artificial Sequence
  Synthetic
uuccucuggaaagcucugcugug

SEQ ID NO: 6044 - RNA, 24 nt, Artificial Sequence
  Synthetic
cuuccucuggaaagcucugcugug

SEQ ID NO: 6045 - RNA, 18 nt, Artificial Sequence
  Synthetic
caggaccccgggugcuug

SEQ ID NO: 6046 - RNA, 19 nt, Artificial Sequence
  Synthetic
ccaggaccccgggugcuug

SEQ ID NO: 6047 - RNA, 21 nt, Artificial Sequence
  Synthetic
acccaggaccccgggugcuug

SEQ ID NO: 6048 - RNA, 22 nt, Artificial Sequence
  Synthetic
cacccaggaccccgggugcuug

SEQ ID NO: 6049 - RNA, 23 nt, Artificial Sequence
  Synthetic
acacccaggaccccgggugcuug

SEQ ID NO: 6050 - RNA, 24 nt, Artificial Sequence
  Synthetic
gacacccaggaccccgggugcuug

SEQ ID NO: 6051 - RNA, 18 nt, Artificial Sequence
  Synthetic
gugaacaacacugaacau

SEQ ID NO: 6052 - RNA, 19 nt, Artificial Sequence
  Synthetic
cgugaacaacacugaacau

SEQ ID NO: 6053 - RNA, 21 nt, Artificial Sequence
  Synthetic
cccgugaacaacacugaacau

SEQ ID NO: 6054 - RNA, 22 nt, Artificial Sequence
  Synthetic
ccccgugaacaacacugaacau

SEQ ID NO: 6055 - RNA, 23 nt, Artificial Sequence
  Synthetic
gccccgugaacaacacugaacau

SEQ ID NO: 6056 - RNA, 24 nt, Artificial Sequence
  Synthetic
agccccgugaacaacacugaacau

SEQ ID NO: 6057 - RNA, 18 nt, Artificial Sequence
  Synthetic
cuucugcacgucuuccau

SEQ ID NO: 6058 - RNA, 19 nt, Artificial Sequence
  Synthetic
ucuucugcacgucuuccau

SEQ ID NO: 6059 - RNA, 21 nt, Artificial Sequence
  Synthetic
uuucuucugcacgucuuccau

SEQ ID NO: 6060 - RNA, 22 nt, Artificial Sequence
  Synthetic
uuuucuucugcacgucuuccau

SEQ ID NO: 6061 - RNA, 23 nt, Artificial Sequence
  Synthetic
auuuucuucugcacgucuuccau

SEQ ID NO: 6062 - RNA, 24 nt, Artificial Sequence
  Synthetic
aauuuucuucugcacgucuuccau

SEQ ID NO: 6063 - RNA, 18 nt, Artificial Sequence
  Synthetic
ggggagccagcccuucau

SEQ ID NO: 6064 - RNA, 19 nt, Artificial Sequence
  Synthetic
uggggagccagcccuucau

SEQ ID NO: 6065 - RNA, 21 nt, Artificial Sequence
  Synthetic
acuggggagccagcccuucau

SEQ ID NO: 6066 - RNA, 22 nt, Artificial Sequence
  Synthetic
uacuggggagccagcccuucau

SEQ ID NO: 6067 - RNA, 23 nt, Artificial Sequence
  Synthetic
auacuggggagccagcccuucau

SEQ ID NO: 6068 - RNA, 24 nt, Artificial Sequence
  Synthetic
uauacuggggagccagcccuucau

SEQ ID NO: 6069 - RNA, 18 nt, Artificial Sequence
  Synthetic
gagagguuuauauauacu

SEQ ID NO: 6070 - RNA, 19 nt, Artificial Sequence
  Synthetic
agagagguuuauauauacu

SEQ ID NO: 6071 - RNA, 21 nt, Artificial Sequence
  Synthetic
ccagagagguuuauauauacu

SEQ ID NO: 6072 - RNA, 22 nt, Artificial Sequence
  Synthetic
uccagagagguuuauauauacu

SEQ ID NO: 6073 - RNA, 23 nt, Artificial Sequence
  Synthetic
cuccagagagguuuauauauacu

SEQ ID NO: 6074 - RNA, 24 nt, Artificial Sequence
  Synthetic
gcuccagagagguuuauauauacu

SEQ ID NO: 6075 - RNA, 18 nt, Artificial Sequence
  Synthetic
guggaggccccuuucccu

SEQ ID NO: 6076 - RNA, 19 nt, Artificial Sequence
  Synthetic
cguggaggccccuuucccu

SEQ ID NO: 6077 - RNA, 21 nt, Artificial Sequence
  Synthetic
gacguggaggccccuuucccu

SEQ ID NO: 6078 - RNA, 22 nt, Artificial Sequence
  Synthetic
ggacguggaggccccuuucccu

SEQ ID NO: 6079 - RNA, 23 nt, Artificial Sequence
  Synthetic
uggacguggaggccccuuucccu

SEQ ID NO: 6080 - RNA, 24 nt, Artificial Sequence
  Synthetic
cuggacguggaggccccuuucccu

SEQ ID NO: 6081 - RNA, 18 nt, Artificial Sequence
  Synthetic
uccgugaauuaacggccu

SEQ ID NO: 6082 - RNA, 19 nt, Artificial Sequence
  Synthetic
uuccgugaauuaacggccu

SEQ ID NO: 6083 - RNA, 21 nt, Artificial Sequence
  Synthetic
ucuuccgugaauuaacggccu

SEQ ID NO: 6084 - RNA, 22 nt, Artificial Sequence
  Synthetic
uucuuccgugaauuaacggccu

SEQ ID NO: 6085 - RNA, 23 nt, Artificial Sequence
  Synthetic
cuucuuccgugaauuaacggccu

SEQ ID NO: 6086 - RNA, 24 nt, Artificial Sequence
  Synthetic
acuucuuccgugaauuaacggccu

SEQ ID NO: 6087 - RNA, 18 nt, Artificial Sequence
  Synthetic
acucgggcuugggggccu

SEQ ID NO: 6088 - RNA, 19 nt, Artificial Sequence
  Synthetic
gacucgggcuugggggccu

SEQ ID NO: 6089 - RNA, 21 nt, Artificial Sequence
  Synthetic
aagacucgggcuugggggccu

SEQ ID NO: 6090 - RNA, 22 nt, Artificial Sequence
  Synthetic
gaagacucgggcuugggggccu

SEQ ID NO: 6091 - RNA, 23 nt, Artificial Sequence
  Synthetic
ggaagacucgggcuugggggccu

SEQ ID NO: 6092 - RNA, 24 nt, Artificial Sequence
  Synthetic
uggaagacucgggcuugggggccu

SEQ ID NO: 6093 - RNA, 18 nt, Artificial Sequence
  Synthetic
gaggcagcagggggcgcu

SEQ ID NO: 6094 - RNA, 19 nt, Artificial Sequence
  Synthetic
ggaggcagcagggggcgcu

SEQ ID NO: 6095 - RNA, 21 nt, Artificial Sequence
  Synthetic
auggaggcagcagggggcgcu

SEQ ID NO: 6096 - RNA, 22 nt, Artificial Sequence
  Synthetic
gauggaggcagcagggggcgcu

SEQ ID NO: 6097 - RNA, 23 nt, Artificial Sequence
  Synthetic
cgauggaggcagcagggggcgcu

SEQ ID NO: 6098 - RNA, 24 nt, Artificial Sequence
  Synthetic
acgauggaggcagcagggggcgcu

SEQ ID NO: 6099 - RNA, 18 nt, Artificial Sequence
  Synthetic
cugauggaggaggaggcu

SEQ ID NO: 6100 - RNA, 19 nt, Artificial Sequence
  Synthetic
acugauggaggaggaggcu

SEQ ID NO: 6101 - RNA, 21 nt, Artificial Sequence
  Synthetic
ugacugauggaggaggaggcu

SEQ ID NO: 6102 - RNA, 22 nt, Artificial Sequence
  Synthetic
gugacugauggaggaggaggcu

SEQ ID NO: 6103 - RNA, 23 nt, Artificial Sequence
  Synthetic
ugugacugauggaggaggaggcu

SEQ ID NO: 6104 - RNA, 24 nt, Artificial Sequence
  Synthetic
cugugacugauggaggaggaggcu

SEQ ID NO: 6105 - RNA, 18 nt, Artificial Sequence
  Synthetic
gcuuggaagacucgggcu

SEQ ID NO: 6106 - RNA, 19 nt, Artificial Sequence
  Synthetic
ggcuuggaagacucgggcu

SEQ ID NO: 6107 - RNA, 21 nt, Artificial Sequence
  Synthetic
gaggcuuggaagacucgggcu

SEQ ID NO: 6108 - RNA, 22 nt, Artificial Sequence
  Synthetic
ggaggcuuggaagacucgggcu

SEQ ID NO: 6109 - RNA, 23 nt, Artificial Sequence
  Synthetic
aggaggcuuggaagacucgggcu

SEQ ID NO: 6110 - RNA, 24 nt, Artificial Sequence
  Synthetic
gaggaggcuuggaagacucgggcu

SEQ ID NO: 6111 - RNA, 18 nt, Artificial Sequence
  Synthetic
ugugccaggcacuaugcu

SEQ ID NO: 6112 - RNA, 19 nt, Artificial Sequence
  Synthetic
cugugccaggcacuaugcu

SEQ ID NO: 6113 - RNA, 21 nt, Artificial Sequence
  Synthetic
cacugugccaggcacuaugcu

SEQ ID NO: 6114 - RNA, 22 nt, Artificial Sequence
  Synthetic
gcacugugccaggcacuaugcu

SEQ ID NO: 6115 - RNA, 23 nt, Artificial Sequence
  Synthetic
ugcacugugccaggcacuaugcu

SEQ ID NO: 6116 - RNA, 24 nt, Artificial Sequence
  Synthetic
cugcacugugccaggcacuaugcu

SEQ ID NO: 6117 - RNA, 18 nt, Artificial Sequence
  Synthetic
ggaaagcucugcugugcu

SEQ ID NO: 6118 - RNA, 19 nt, Artificial Sequence
  Synthetic
uggaaagcucugcugugcu

SEQ ID NO: 6119 - RNA, 21 nt, Artificial Sequence
  Synthetic
ucuggaaagcucugcugugcu

SEQ ID NO: 6120 - RNA, 22 nt, Artificial Sequence
  Synthetic
cucuggaaagcucugcugugcu

SEQ ID NO: 6121 - RNA, 23 nt, Artificial Sequence
  Synthetic
ccucuggaaagcucugcugugcu

SEQ ID NO: 6122 - RNA, 24 nt, Artificial Sequence
  Synthetic
uccucuggaaagcucugcugugcu

SEQ ID NO: 6123 - RNA, 18 nt, Artificial Sequence
  Synthetic
acgggcuggcagguugcu

SEQ ID NO: 6124 - RNA, 19 nt, Artificial Sequence
  Synthetic
cacgggcuggcagguugcu

SEQ ID NO: 6125 - RNA, 21 nt, Artificial Sequence
  Synthetic
ggcacgggcuggcagguugcu

SEQ ID NO: 6126 - RNA, 22 nt, Artificial Sequence
  Synthetic
uggcacgggcuggcagguugcu

SEQ ID NO: 6127 - RNA, 23 nt, Artificial Sequence
  Synthetic
guggcacgggcuggcagguugcu

SEQ ID NO: 6128 - RNA, 24 nt, Artificial Sequence
  Synthetic
aguggcacgggcuggcagguugcu

SEQ ID NO: 6129 - RNA, 18 nt, Artificial Sequence
  Synthetic
ggaggccccuuucccucu

SEQ ID NO: 6130 - RNA, 19 nt, Artificial Sequence
  Synthetic
uggaggccccuuucccucu

SEQ ID NO: 6131 - RNA, 21 nt, Artificial Sequence
  Synthetic
cguggaggccccuuucccucu

SEQ ID NO: 6132 - RNA, 22 nt, Artificial Sequence
  Synthetic
acguggaggccccuuucccucu

SEQ ID NO: 6133 - RNA, 23 nt, Artificial Sequence
  Synthetic
gacguggaggccccuuucccucu

SEQ ID NO: 6134 - RNA, 24 nt, Artificial Sequence
  Synthetic
ggacguggaggccccuuucccucu

SEQ ID NO: 6135 - RNA, 18 nt, Artificial Sequence
  Synthetic
cgcugccagcaagauucu

SEQ ID NO: 6136 - RNA, 19 nt, Artificial Sequence
  Synthetic
acgcugccagcaagauucu

SEQ ID NO: 6137 - RNA, 21 nt, Artificial Sequence
  Synthetic
ucacgcugccagcaagauucu

SEQ ID NO: 6138 - RNA, 22 nt, Artificial Sequence
  Synthetic
uucacgcugccagcaagauucu

SEQ ID NO: 6139 - RNA, 23 nt, Artificial Sequence
  Synthetic
cuucacgcugccagcaagauucu

SEQ ID NO: 6140 - RNA, 24 nt, Artificial Sequence
  Synthetic
ccuucacgcugccagcaagauucu

SEQ ID NO: 6141 - RNA, 18 nt, Artificial Sequence
  Synthetic
aaccuuccagaagucugu

SEQ ID NO: 6142 - RNA, 19 nt, Artificial Sequence
  Synthetic
uaaccuuccagaagucugu

SEQ ID NO: 6143 - RNA, 21 nt, Artificial Sequence
  Synthetic
aauaaccuuccagaagucugu

SEQ ID NO: 6144 - RNA, 22 nt, Artificial Sequence
  Synthetic
aaauaaccuuccagaagucugu

SEQ ID NO: 6145 - RNA, 23 nt, Artificial Sequence
  Synthetic
aaaauaaccuuccagaagucugu

SEQ ID NO: 6146 - RNA, 24 nt, Artificial Sequence
  Synthetic
gaaaauaaccuuccagaagucugu

SEQ ID NO: 6147 - RNA, 18 nt, Artificial Sequence
  Synthetic
ucacucugcaaacucauu

SEQ ID NO: 6148 - RNA, 19 nt, Artificial Sequence
  Synthetic
uucacucugcaaacucauu

SEQ ID NO: 6149 - RNA, 21 nt, Artificial Sequence
  Synthetic
cauucacucugcaaacucauu

SEQ ID NO: 6150 - RNA, 22 nt, Artificial Sequence
  Synthetic
ccauucacucugcaaacucauu

SEQ ID NO: 6151 - RNA, 23 nt, Artificial Sequence
  Synthetic
uccauucacucugcaaacucauu

SEQ ID NO: 6152 - RNA, 24 nt, Artificial Sequence
  Synthetic
uuccauucacucugcaaacucauu

SEQ ID NO: 6153 - RNA, 18 nt, Artificial Sequence
  Synthetic
cuuggaagacucgggcuu

SEQ ID NO: 6154 - RNA, 19 nt, Artificial Sequence
  Synthetic
gcuuggaagacucgggcuu

SEQ ID NO: 6155 - RNA, 21 nt, Artificial Sequence
  Synthetic
aggcuuggaagacucgggcuu

SEQ ID NO: 6156 - RNA, 22 nt, Artificial Sequence
  Synthetic
gaggcuuggaagacucgggcuu

SEQ ID NO: 6157 - RNA, 23 nt, Artificial Sequence
  Synthetic
ggaggcuuggaagacucgggcuu

SEQ ID NO: 6158 - RNA, 24 nt, Artificial Sequence
  Synthetic
aggaggcuuggaagacucgggcuu

SEQ ID NO: 6159 - RNA, 18 nt, Artificial Sequence
  Synthetic
uagggagguggccuuguu

SEQ ID NO: 6160 - RNA, 19 nt, Artificial Sequence
  Synthetic
cuagggagguggccuuguu

SEQ ID NO: 6161 - RNA, 21 nt, Artificial Sequence
  Synthetic
cgcuagggagguggccuuguu

SEQ ID NO: 6162 - RNA, 22 nt, Artificial Sequence
  Synthetic
gcgcuagggagguggccuuguu

SEQ ID NO: 6163 - RNA, 23 nt, Artificial Sequence
  Synthetic
ggcgcuagggagguggccuuguu

SEQ ID NO: 6164 - RNA, 24 nt, Artificial Sequence
  Synthetic
gggcgcuagggagguggccuuguu

SEQ ID NO: 6165 - RNA, 18 nt, Artificial Sequence
  Synthetic
auuuuaacagcugacuuu

SEQ ID NO: 6166 - RNA, 19 nt, Artificial Sequence
  Synthetic
aauuuuaacagcugacuuu

SEQ ID NO: 6167 - RNA, 21 nt, Artificial Sequence
  Synthetic
ggaauuuuaacagcugacuuu

SEQ ID NO: 6168 - RNA, 22 nt, Artificial Sequence
  Synthetic
uggaauuuuaacagcugacuuu

SEQ ID NO: 6169 - RNA, 23 nt, Artificial Sequence
  Synthetic
cuggaauuuuaacagcugacuuu

SEQ ID NO: 6170 - RNA, 24 nt, Artificial Sequence
  Synthetic
ccuggaauuuuaacagcugacuuu

SEQ ID NO: 6171 - RNA, 18 nt, Artificial Sequence
  Synthetic
ucccucuccauuuccuuu

SEQ ID NO: 6172 - RNA, 19 nt, Artificial Sequence
  Synthetic
uucccucuccauuuccuuu

SEQ ID NO: 6173 - RNA, 21 nt, Artificial Sequence
  Synthetic
guuucccucuccauuuccuuu

SEQ ID NO: 6174 - RNA, 22 nt, Artificial Sequence
  Synthetic
aguuucccucuccauuuccuuu

SEQ ID NO: 6175 - RNA, 23 nt, Artificial Sequence
  Synthetic
uaguuucccucuccauuuccuuu

SEQ ID NO: 6176 - RNA, 24 nt, Artificial Sequence
  Synthetic
cuaguuucccucuccauuuccuuu

SEQ ID NO: 6177 - RNA, 18 nt, Artificial Sequence
  Synthetic
caggcuccagaaaggaaa

SEQ ID NO: 6178 - RNA, 19 nt, Artificial Sequence
  Synthetic
ccaggcuccagaaaggaaa

SEQ ID NO: 6179 - RNA, 21 nt, Artificial Sequence
  Synthetic
cuccaggcuccagaaaggaaa

SEQ ID NO: 6180 - RNA, 22 nt, Artificial Sequence
  Synthetic
gcuccaggcuccagaaaggaaa

SEQ ID NO: 6181 - RNA, 23 nt, Artificial Sequence
  Synthetic
ggcuccaggcuccagaaaggaaa

SEQ ID NO: 6182 - RNA, 24 nt, Artificial Sequence
  Synthetic
uggcuccaggcuccagaaaggaaa

SEQ ID NO: 6183 - RNA, 18 nt, Artificial Sequence
  Synthetic
gggguaugggugcauaaa

SEQ ID NO: 6184 - RNA, 19 nt, Artificial Sequence
  Synthetic
ugggguaugggugcauaaa

SEQ ID NO: 6185 - RNA, 21 nt, Artificial Sequence
  Synthetic
auugggguaugggugcauaaa

SEQ ID NO: 6186 - RNA, 22 nt, Artificial Sequence
  Synthetic
uauugggguaugggugcauaaa

SEQ ID NO: 6187 - RNA, 23 nt, Artificial Sequence
  Synthetic
uuauugggguaugggugcauaaa

SEQ ID NO: 6188 - RNA, 24 nt, Artificial Sequence
  Synthetic
auuauugggguaugggugcauaaa

SEQ ID NO: 6189 - RNA, 18 nt, Artificial Sequence
  Synthetic
ugggauguucuuuuuaaa

SEQ ID NO: 6190 - RNA, 19 nt, Artificial Sequence
  Synthetic
uugggauguucuuuuuaaa

SEQ ID NO: 6191 - RNA, 21 nt, Artificial Sequence
  Synthetic
aauugggauguucuuuuuaaa

SEQ ID NO: 6192 - RNA, 22 nt, Artificial Sequence
  Synthetic
aaauugggauguucuuuuuaaa

SEQ ID NO: 6193 - RNA, 23 nt, Artificial Sequence
  Synthetic
uaaauugggauguucuuuuuaaa

SEQ ID NO: 6194 - RNA, 24 nt, Artificial Sequence
  Synthetic
auaaauugggauguucuuuuuaaa

SEQ ID NO: 6195 - RNA, 18 nt, Artificial Sequence
  Synthetic
aacccagugcugaaagaa

SEQ ID NO: 6196 - RNA, 19 nt, Artificial Sequence
  Synthetic
aaacccagugcugaaagaa

SEQ ID NO: 6197 - RNA, 21 nt, Artificial Sequence
  Synthetic
uuaaacccagugcugaaagaa

SEQ ID NO: 6198 - RNA, 22 nt, Artificial Sequence
  Synthetic
cuuaaacccagugcugaaagaa

SEQ ID NO: 6199 - RNA, 23 nt, Artificial Sequence
  Synthetic
acuuaaacccagugcugaaagaa

SEQ ID NO: 6200 - RNA, 24 nt, Artificial Sequence
  Synthetic
aacuuaaacccagugcugaaagaa

SEQ ID NO: 6201 - RNA, 18 nt, Artificial Sequence
  Synthetic
uggcuccaggcuccagaa

SEQ ID NO: 6202 - RNA, 19 nt, Artificial Sequence
  Synthetic
uuggcuccaggcuccagaa

SEQ ID NO: 6203 - RNA, 21 nt, Artificial Sequence
  Synthetic
ccuuggcuccaggcuccagaa

SEQ ID NO: 6204 - RNA, 22 nt, Artificial Sequence
  Synthetic
uccuuggcuccaggcuccagaa

SEQ ID NO: 6205 - RNA, 23 nt, Artificial Sequence
  Synthetic
cuccuuggcuccaggcuccagaa

SEQ ID NO: 6206 - RNA, 24 nt, Artificial Sequence
  Synthetic
acuccuuggcuccaggcuccagaa

SEQ ID NO: 6207 - RNA, 18 nt, Artificial Sequence
  Synthetic
ccaggcuccagaaaggaa

SEQ ID NO: 6208 - RNA, 19 nt, Artificial Sequence
  Synthetic
uccaggcuccagaaaggaa

SEQ ID NO: 6209 - RNA, 21 nt, Artificial Sequence
  Synthetic
gcuccaggcuccagaaaggaa

SEQ ID NO: 6210 - RNA, 22 nt, Artificial Sequence
  Synthetic
ggcuccaggcuccagaaaggaa

SEQ ID NO: 6211 - RNA, 23 nt, Artificial Sequence
  Synthetic
uggcuccaggcuccagaaaggaa

SEQ ID NO: 6212 - RNA, 24 nt, Artificial Sequence
  Synthetic
uuggcuccaggcuccagaaaggaa

SEQ ID NO: 6213 - RNA, 18 nt, Artificial Sequence
  Synthetic
uuaaugggaauauaggaa

SEQ ID NO: 6214 - RNA, 19 nt, Artificial Sequence
  Synthetic
uuuaaugggaauauaggaa

SEQ ID NO: 6215 - RNA, 21 nt, Artificial Sequence
  Synthetic
uauuuaaugggaauauaggaa

SEQ ID NO: 6216 - RNA, 22 nt, Artificial Sequence
  Synthetic
uuauuuaaugggaauauaggaa

SEQ ID NO: 6217 - RNA, 23 nt, Artificial Sequence
  Synthetic
uuuauuuaaugggaauauaggaa

SEQ ID NO: 6218 - RNA, 24 nt, Artificial Sequence
  Synthetic
cuuuauuuaaugggaauauaggaa

SEQ ID NO: 6219 - RNA, 18 nt, Artificial Sequence
  Synthetic
guguuuccucagagggaa

SEQ ID NO: 6220 - RNA, 19 nt, Artificial Sequence
  Synthetic
aguguuuccucagagggaa

SEQ ID NO: 6221 - RNA, 21 nt, Artificial Sequence
  Synthetic
acaguguuuccucagagggaa

SEQ ID NO: 6222 - RNA, 22 nt, Artificial Sequence
  Synthetic
gacaguguuuccucagagggaa

SEQ ID NO: 6223 - RNA, 23 nt, Artificial Sequence
  Synthetic
ggacaguguuuccucagagggaa

SEQ ID NO: 6224 - RNA, 24 nt, Artificial Sequence
  Synthetic
gggacaguguuuccucagagggaa

SEQ ID NO: 6225 - RNA, 18 nt, Artificial Sequence
  Synthetic
augaguuugcagagugaa

SEQ ID NO: 6226 - RNA, 19 nt, Artificial Sequence
  Synthetic
aaugaguuugcagagugaa

SEQ ID NO: 6227 - RNA, 21 nt, Artificial Sequence
  Synthetic
ucaaugaguuugcagagugaa

SEQ ID NO: 6228 - RNA, 22 nt, Artificial Sequence
  Synthetic
cucaaugaguuugcagagugaa

SEQ ID NO: 6229 - RNA, 23 nt, Artificial Sequence
  Synthetic
ucucaaugaguuugcagagugaa

SEQ ID NO: 6230 - RNA, 24 nt, Artificial Sequence
  Synthetic
uucucaaugaguuugcagagugaa

SEQ ID NO: 6231 - RNA, 18 nt, Artificial Sequence
  Synthetic
gaaaggcaggaaggugaa

SEQ ID NO: 6232 - RNA, 19 nt, Artificial Sequence
  Synthetic
ugaaaggcaggaaggugaa

SEQ ID NO: 6233 - RNA, 21 nt, Artificial Sequence
  Synthetic
gcugaaaggcaggaaggugaa

SEQ ID NO: 6234 - RNA, 22 nt, Artificial Sequence
  Synthetic
ugcugaaaggcaggaaggugaa

SEQ ID NO: 6235 - RNA, 23 nt, Artificial Sequence
  Synthetic
gugcugaaaggcaggaaggugaa

SEQ ID NO: 6236 - RNA, 24 nt, Artificial Sequence
  Synthetic
ggugcugaaaggcaggaaggugaa

SEQ ID NO: 6237 - RNA, 18 nt, Artificial Sequence
  Synthetic
agagggaaacuagucuaa

SEQ ID NO: 6238 - RNA, 19 nt, Artificial Sequence
  Synthetic
gagagggaaacuagucuaa

SEQ ID NO: 6239 - RNA, 21 nt, Artificial Sequence
  Synthetic
uggagagggaaacuagucuaa

SEQ ID NO: 6240 - RNA, 22 nt, Artificial Sequence
  Synthetic
auggagagggaaacuagucuaa

SEQ ID NO: 6241 - RNA, 23 nt, Artificial Sequence
  Synthetic
aauggagagggaaacuagucuaa

SEQ ID NO: 6242 - RNA, 24 nt, Artificial Sequence
  Synthetic
aaauggagagggaaacuagucuaa

SEQ ID NO: 6243 - RNA, 18 nt, Artificial Sequence
  Synthetic
acgaaggccuuuauuuaa

SEQ ID NO: 6244 - RNA, 19 nt, Artificial Sequence
  Synthetic
cacgaaggccuuuauuuaa

SEQ ID NO: 6245 - RNA, 21 nt, Artificial Sequence
  Synthetic
uucacgaaggccuuuauuuaa

SEQ ID NO: 6246 - RNA, 22 nt, Artificial Sequence
  Synthetic
cuucacgaaggccuuuauuuaa

SEQ ID NO: 6247 - RNA, 23 nt, Artificial Sequence
  Synthetic
ccuucacgaaggccuuuauuuaa

SEQ ID NO: 6248 - RNA, 24 nt, Artificial Sequence
  Synthetic
uccuucacgaaggccuuuauuuaa

SEQ ID NO: 6249 - RNA, 18 nt, Artificial Sequence
  Synthetic
gcacagcagagcuuucca

SEQ ID NO: 6250 - RNA, 19 nt, Artificial Sequence
  Synthetic
agcacagcagagcuuucca

SEQ ID NO: 6251 - RNA, 21 nt, Artificial Sequence
  Synthetic
ucagcacagcagagcuuucca

SEQ ID NO: 6252 - RNA, 22 nt, Artificial Sequence
  Synthetic
cucagcacagcagagcuuucca

SEQ ID NO: 6253 - RNA, 23 nt, Artificial Sequence
  Synthetic
ucucagcacagcagagcuuucca

SEQ ID NO: 6254 - RNA, 24 nt, Artificial Sequence
  Synthetic
cucucagcacagcagagcuuucca

SEQ ID NO: 6255 - RNA, 18 nt, Artificial Sequence
  Synthetic
ggggacaguguuuccuca

SEQ ID NO: 6256 - RNA, 19 nt, Artificial Sequence
  Synthetic
aggggacaguguuuccuca

SEQ ID NO: 6257 - RNA, 21 nt, Artificial Sequence
  Synthetic
ggaggggacaguguuuccuca

SEQ ID NO: 6258 - RNA, 22 nt, Artificial Sequence
  Synthetic
uggaggggacaguguuuccuca

SEQ ID NO: 6259 - RNA, 23 nt, Artificial Sequence
  Synthetic
cuggaggggacaguguuuccuca

SEQ ID NO: 6260 - RNA, 24 nt, Artificial Sequence
  Synthetic
ucuggaggggacaguguuuccuca

SEQ ID NO: 6261 - RNA, 18 nt, Artificial Sequence
  Synthetic
ggaggugacaguuucuca

SEQ ID NO: 6262 - RNA, 19 nt, Artificial Sequence
  Synthetic
uggaggugacaguuucuca

SEQ ID NO: 6263 - RNA, 21 nt, Artificial Sequence
  Synthetic
cguggaggugacaguuucuca

SEQ ID NO: 6264 - RNA, 22 nt, Artificial Sequence
  Synthetic
ucguggaggugacaguuucuca

SEQ ID NO: 6265 - RNA, 23 nt, Artificial Sequence
  Synthetic
uucguggaggugacaguuucuca

SEQ ID NO: 6266 - RNA, 24 nt, Artificial Sequence
  Synthetic
cuucguggaggugacaguuucuca

SEQ ID NO: 6267 - RNA, 18 nt, Artificial Sequence
  Synthetic
uccuaggccguuaauuca

SEQ ID NO: 6268 - RNA, 19 nt, Artificial Sequence
  Synthetic
uuccuaggccguuaauuca

SEQ ID NO: 6269 - RNA, 21 nt, Artificial Sequence
  Synthetic
auuuccuaggccguuaauuca

SEQ ID NO: 6270 - RNA, 22 nt, Artificial Sequence
  Synthetic
cauuuccuaggccguuaauuca

SEQ ID NO: 6271 - RNA, 23 nt, Artificial Sequence
  Synthetic
ucauuuccuaggccguuaauuca

SEQ ID NO: 6272 - RNA, 24 nt, Artificial Sequence
  Synthetic
cucauuuccuaggccguuaauuca

SEQ ID NO: 6273 - RNA, 18 nt, Artificial Sequence
  Synthetic
gauguucaguguuguuca

SEQ ID NO: 6274 - RNA, 19 nt, Artificial Sequence
  Synthetic
agauguucaguguuguuca

SEQ ID NO: 6275 - RNA, 21 nt, Artificial Sequence
  Synthetic
ccagauguucaguguuguuca

SEQ ID NO: 6276 - RNA, 22 nt, Artificial Sequence
  Synthetic
cccagauguucaguguuguuca

SEQ ID NO: 6277 - RNA, 23 nt, Artificial Sequence
  Synthetic
gcccagauguucaguguuguuca

SEQ ID NO: 6278 - RNA, 24 nt, Artificial Sequence
  Synthetic
ugcccagauguucaguguuguuca

SEQ ID NO: 6279 - RNA, 18 nt, Artificial Sequence
  Synthetic
aaacccagugcugaaaga

SEQ ID NO: 6280 - RNA, 19 nt, Artificial Sequence
  Synthetic
uaaacccagugcugaaaga

SEQ ID NO: 6281 - RNA, 21 nt, Artificial Sequence
  Synthetic
cuuaaacccagugcugaaaga

SEQ ID NO: 6282 - RNA, 22 nt, Artificial Sequence
  Synthetic
acuuaaacccagugcugaaaga

SEQ ID NO: 6283 - RNA, 23 nt, Artificial Sequence
  Synthetic
aacuuaaacccagugcugaaaga

SEQ ID NO: 6284 - RNA, 24 nt, Artificial Sequence
  Synthetic
caacuuaaacccagugcugaaaga

SEQ ID NO: 6285 - RNA, 18 nt, Artificial Sequence
  Synthetic
uuggcuccaggcuccaga

SEQ ID NO: 6286 - RNA, 19 nt, Artificial Sequence
  Synthetic
cuuggcuccaggcuccaga

SEQ ID NO: 6287 - RNA, 21 nt, Artificial Sequence
  Synthetic
uccuuggcuccaggcuccaga

SEQ ID NO: 6288 - RNA, 22 nt, Artificial Sequence
  Synthetic
cuccuuggcuccaggcuccaga

SEQ ID NO: 6289 - RNA, 23 nt, Artificial Sequence
  Synthetic
acuccuuggcuccaggcuccaga

SEQ ID NO: 6290 - RNA, 24 nt, Artificial Sequence
  Synthetic
gacuccuuggcuccaggcuccaga

SEQ ID NO: 6291 - RNA, 18 nt, Artificial Sequence
  Synthetic
ggacaguguuuccucaga

SEQ ID NO: 6292 - RNA, 19 nt, Artificial Sequence
  Synthetic
gggacaguguuuccucaga

SEQ ID NO: 6293 - RNA, 21 nt, Artificial Sequence
  Synthetic
aggggacaguguuuccucaga

SEQ ID NO: 6294 - RNA, 22 nt, Artificial Sequence
  Synthetic
gaggggacaguguuuccucaga

SEQ ID NO: 6295 - RNA, 23 nt, Artificial Sequence
  Synthetic
ggaggggacaguguuuccucaga

SEQ ID NO: 6296 - RNA, 24 nt, Artificial Sequence
  Synthetic
uggaggggacaguguuuccucaga

SEQ ID NO: 6297 - RNA, 18 nt, Artificial Sequence
  Synthetic
ccagaaaggaaauggaga

SEQ ID NO: 6298 - RNA, 19 nt, Artificial Sequence
  Synthetic
uccagaaaggaaauggaga

SEQ ID NO: 6299 - RNA, 21 nt, Artificial Sequence
  Synthetic
gcuccagaaaggaaauggaga

SEQ ID NO: 6300 - RNA, 22 nt, Artificial Sequence
  Synthetic
ggcuccagaaaggaaauggaga

SEQ ID NO: 6301 - RNA, 23 nt, Artificial Sequence
  Synthetic
aggcuccagaaaggaaauggaga

SEQ ID NO: 6302 - RNA, 24 nt, Artificial Sequence
  Synthetic
caggcuccagaaaggaaauggaga

SEQ ID NO: 6303 - RNA, 18 nt, Artificial Sequence
  Synthetic
agguggggacugcaggga

SEQ ID NO: 6304 - RNA, 19 nt, Artificial Sequence
  Synthetic
gagguggggacugcaggga

SEQ ID NO: 6305 - RNA, 21 nt, Artificial Sequence
  Synthetic
aggagguggggacugcaggga

SEQ ID NO: 6306 - RNA, 22 nt, Artificial Sequence
  Synthetic
caggagguggggacugcaggga

SEQ ID NO: 6307 - RNA, 23 nt, Artificial Sequence
  Synthetic
ccaggagguggggacugcaggga

SEQ ID NO: 6308 - RNA, 24 nt, Artificial Sequence
  Synthetic
uccaggagguggggacugcaggga

SEQ ID NO: 6309 - RNA, 18 nt, Artificial Sequence
  Synthetic
aguguuuccucagaggga

SEQ ID NO: 6310 - RNA, 19 nt, Artificial Sequence
  Synthetic
caguguuuccucagaggga

SEQ ID NO: 6311 - RNA, 21 nt, Artificial Sequence
  Synthetic
gacaguguuuccucagaggga

SEQ ID NO: 6312 - RNA, 22 nt, Artificial Sequence
  Synthetic
ggacaguguuuccucagaggga

SEQ ID NO: 6313 - RNA, 23 nt, Artificial Sequence
  Synthetic
gggacaguguuuccucagaggga

SEQ ID NO: 6314 - RNA, 24 nt, Artificial Sequence
  Synthetic
ggggacaguguuuccucagaggga

SEQ ID NO: 6315 - RNA, 18 nt, Artificial Sequence
  Synthetic
cuccagaaaggaaaugga

SEQ ID NO: 6316 - RNA, 19 nt, Artificial Sequence
  Synthetic
gcuccagaaaggaaaugga

SEQ ID NO: 6317 - RNA, 21 nt, Artificial Sequence
  Synthetic
aggcuccagaaaggaaaugga

SEQ ID NO: 6318 - RNA, 22 nt, Artificial Sequence
  Synthetic
caggcuccagaaaggaaaugga

SEQ ID NO: 6319 - RNA, 23 nt, Artificial Sequence
  Synthetic
ccaggcuccagaaaggaaaugga

SEQ ID NO: 6320 - RNA, 24 nt, Artificial Sequence
  Synthetic
uccaggcuccagaaaggaaaugga

SEQ ID NO: 6321 - RNA, 18 nt, Artificial Sequence
  Synthetic
ucuaacggagaaucugga

SEQ ID NO: 6322 - RNA, 19 nt, Artificial Sequence
  Synthetic
gucuaacggagaaucugga

SEQ ID NO: 6323 - RNA, 21 nt, Artificial Sequence
  Synthetic
uagucuaacggagaaucugga

SEQ ID NO: 6324 - RNA, 22 nt, Artificial Sequence
  Synthetic
cuagucuaacggagaaucugga

SEQ ID NO: 6325 - RNA, 23 nt, Artificial Sequence
  Synthetic
acuagucuaacggagaaucugga

SEQ ID NO: 6326 - RNA, 24 nt, Artificial Sequence
  Synthetic
aacuagucuaacggagaaucugga

SEQ ID NO: 6327 - RNA, 18 nt, Artificial Sequence
  Synthetic
acuuaaacccagugcuga

SEQ ID NO: 6328 - RNA, 19 nt, Artificial Sequence
  Synthetic
aacuuaaacccagugcuga

SEQ ID NO: 6329 - RNA, 21 nt, Artificial Sequence
  Synthetic
ccaacuuaaacccagugcuga

SEQ ID NO: 6330 - RNA, 22 nt, Artificial Sequence
  Synthetic
gccaacuuaaacccagugcuga

SEQ ID NO: 6331 - RNA, 23 nt, Artificial Sequence
  Synthetic
agccaacuuaaacccagugcuga

SEQ ID NO: 6332 - RNA, 24 nt, Artificial Sequence
  Synthetic
cagccaacuuaaacccagugcuga

SEQ ID NO: 6333 - RNA, 18 nt, Artificial Sequence
  Synthetic
aauucacggaagaaguga

SEQ ID NO: 6334 - RNA, 19 nt, Artificial Sequence
  Synthetic
uaauucacggaagaaguga

SEQ ID NO: 6335 - RNA, 21 nt, Artificial Sequence
  Synthetic
guuaauucacggaagaaguga

SEQ ID NO: 6336 - RNA, 22 nt, Artificial Sequence
  Synthetic
cguuaauucacggaagaaguga

SEQ ID NO: 6337 - RNA, 23 nt, Artificial Sequence
  Synthetic
ccguuaauucacggaagaaguga

SEQ ID NO: 6338 - RNA, 24 nt, Artificial Sequence
  Synthetic
gccguuaauucacggaagaaguga

SEQ ID NO: 6339 - RNA, 18 nt, Artificial Sequence
  Synthetic
aaugaguuugcagaguga

SEQ ID NO: 6340 - RNA, 19 nt, Artificial Sequence
  Synthetic
caaugaguuugcagaguga

SEQ ID NO: 6341 - RNA, 21 nt, Artificial Sequence
  Synthetic
cucaaugaguuugcagaguga

SEQ ID NO: 6342 - RNA, 22 nt, Artificial Sequence
  Synthetic
ucucaaugaguuugcagaguga

SEQ ID NO: 6343 - RNA, 23 nt, Artificial Sequence
  Synthetic
uucucaaugaguuugcagaguga

SEQ ID NO: 6344 - RNA, 24 nt, Artificial Sequence
  Synthetic
guucucaaugaguuugcagaguga

SEQ ID NO: 6345 - RNA, 18 nt, Artificial Sequence
  Synthetic
cuuuauuuaaugggaaua

SEQ ID NO: 6346 - RNA, 19 nt, Artificial Sequence
  Synthetic
ccuuuauuuaaugggaaua

SEQ ID NO: 6347 - RNA, 21 nt, Artificial Sequence
  Synthetic
ggccuuuauuuaaugggaaua

SEQ ID NO: 6348 - RNA, 22 nt, Artificial Sequence
  Synthetic
aggccuuuauuuaaugggaaua

SEQ ID NO: 6349 - RNA, 23 nt, Artificial Sequence
  Synthetic
aaggccuuuauuuaaugggaaua

SEQ ID NO: 6350 - RNA, 24 nt, Artificial Sequence
  Synthetic
gaaggccuuuauuuaaugggaaua

SEQ ID NO: 6351 - RNA, 18 nt, Artificial Sequence
  Synthetic
uaaaaccagguggagaua

SEQ ID NO: 6352 - RNA, 19 nt, Artificial Sequence
  Synthetic
guaaaaccagguggagaua

SEQ ID NO: 6353 - RNA, 21 nt, Artificial Sequence
  Synthetic
guguaaaaccagguggagaua

SEQ ID NO: 6354 - RNA, 22 nt, Artificial Sequence
  Synthetic
uguguaaaaccagguggagaua

SEQ ID NO: 6355 - RNA, 23 nt, Artificial Sequence
  Synthetic
guguguaaaaccagguggagaua

SEQ ID NO: 6356 - RNA, 24 nt, Artificial Sequence
  Synthetic
uguguguaaaaccagguggagaua

SEQ ID NO: 6357 - RNA, 18 nt, Artificial Sequence
  Synthetic
gagagggaaacuagucua

SEQ ID NO: 6358 - RNA, 19 nt, Artificial Sequence
  Synthetic
ggagagggaaacuagucua

SEQ ID NO: 6359 - RNA, 21 nt, Artificial Sequence
  Synthetic
auggagagggaaacuagucua

SEQ ID NO: 6360 - RNA, 22 nt, Artificial Sequence
  Synthetic
aauggagagggaaacuagucua

SEQ ID NO: 6361 - RNA, 23 nt, Artificial Sequence
  Synthetic
aaauggagagggaaacuagucua

SEQ ID NO: 6362 - RNA, 24 nt, Artificial Sequence
  Synthetic
gaaauggagagggaaacuagucua

SEQ ID NO: 6363 - RNA, 18 nt, Artificial Sequence
  Synthetic
gagauauaggaacuauua

SEQ ID NO: 6364 - RNA, 19 nt, Artificial Sequence
  Synthetic
ggagauauaggaacuauua

SEQ ID NO: 6365 - RNA, 21 nt, Artificial Sequence
  Synthetic
guggagauauaggaacuauua

SEQ ID NO: 6366 - RNA, 22 nt, Artificial Sequence
  Synthetic
gguggagauauaggaacuauua

SEQ ID NO: 6367 - RNA, 23 nt, Artificial Sequence
  Synthetic
agguggagauauaggaacuauua

SEQ ID NO: 6368 - RNA, 24 nt, Artificial Sequence
  Synthetic
cagguggagauauaggaacuauua

SEQ ID NO: 6369 - RNA, 18 nt, Artificial Sequence
  Synthetic
ugucccugcuacgucuua

SEQ ID NO: 6370 - RNA, 19 nt, Artificial Sequence
  Synthetic
cugucccugcuacgucuua

SEQ ID NO: 6371 - RNA, 21 nt, Artificial Sequence
  Synthetic
cucugucccugcuacgucuua

SEQ ID NO: 6372 - RNA, 22 nt, Artificial Sequence
  Synthetic
ucucugucccugcuacgucuua

SEQ ID NO: 6373 - RNA, 23 nt, Artificial Sequence
  Synthetic
uucucugucccugcuacgucuua

SEQ ID NO: 6374 - RNA, 24 nt, Artificial Sequence
  Synthetic
uuucucugucccugcuacgucuua

SEQ ID NO: 6375 - RNA, 18 nt, Artificial Sequence
  Synthetic
cacgaaggccuuuauuua

SEQ ID NO: 6376 - RNA, 19 nt, Artificial Sequence
  Synthetic
ucacgaaggccuuuauuua

SEQ ID NO: 6377 - RNA, 21 nt, Artificial Sequence
  Synthetic
cuucacgaaggccuuuauuua

SEQ ID NO: 6378 - RNA, 22 nt, Artificial Sequence
  Synthetic
ccuucacgaaggccuuuauuua

SEQ ID NO: 6379 - RNA, 23 nt, Artificial Sequence
  Synthetic
uccuucacgaaggccuuuauuua

SEQ ID NO: 6380 - RNA, 24 nt, Artificial Sequence
  Synthetic
uuccuucacgaaggccuuuauuua

SEQ ID NO: 6381 - RNA, 18 nt, Artificial Sequence
  Synthetic
gugaauggaaauauaaac

SEQ ID NO: 6382 - RNA, 19 nt, Artificial Sequence
  Synthetic
agugaauggaaauauaaac

SEQ ID NO: 6383 - RNA, 21 nt, Artificial Sequence
  Synthetic
agagugaauggaaauauaaac

SEQ ID NO: 6384 - RNA, 22 nt, Artificial Sequence
  Synthetic
cagagugaauggaaauauaaac

SEQ ID NO: 6385 - RNA, 23 nt, Artificial Sequence
  Synthetic
gcagagugaauggaaauauaaac

SEQ ID NO: 6386 - RNA, 24 nt, Artificial Sequence
  Synthetic
ugcagagugaauggaaauauaaac

SEQ ID NO: 6387 - RNA, 18 nt, Artificial Sequence
  Synthetic
cuuauaucugccagacac

SEQ ID NO: 6388 - RNA, 19 nt, Artificial Sequence
  Synthetic
acuuauaucugccagacac

SEQ ID NO: 6389 - RNA, 21 nt, Artificial Sequence
  Synthetic
guacuuauaucugccagacac

SEQ ID NO: 6390 - RNA, 22 nt, Artificial Sequence
  Synthetic
aguacuuauaucugccagacac

SEQ ID NO: 6391 - RNA, 23 nt, Artificial Sequence
  Synthetic
gaguacuuauaucugccagacac

SEQ ID NO: 6392 - RNA, 24 nt, Artificial Sequence
  Synthetic
ugaguacuuauaucugccagacac

SEQ ID NO: 6393 - RNA, 18 nt, Artificial Sequence
  Synthetic
ggggagcccugcaagcac

SEQ ID NO: 6394 - RNA, 19 nt, Artificial Sequence
  Synthetic
gggggagcccugcaagcac

SEQ ID NO: 6395 - RNA, 21 nt, Artificial Sequence
  Synthetic
cugggggagcccugcaagcac

SEQ ID NO: 6396 - RNA, 22 nt, Artificial Sequence
  Synthetic
gcugggggagcccugcaagcac

SEQ ID NO: 6397 - RNA, 23 nt, Artificial Sequence
  Synthetic
agcugggggagcccugcaagcac

SEQ ID NO: 6398 - RNA, 24 nt, Artificial Sequence
  Synthetic
cagcugggggagcccugcaagcac

SEQ ID NO: 6399 - RNA, 18 nt, Artificial Sequence
  Synthetic
ccaccucugucuuccccc

SEQ ID NO: 6400 - RNA, 19 nt, Artificial Sequence
  Synthetic
gccaccucugucuuccccc

SEQ ID NO: 6401 - RNA, 21 nt, Artificial Sequence
  Synthetic
uggccaccucugucuuccccc

SEQ ID NO: 6402 - RNA, 22 nt, Artificial Sequence
  Synthetic
guggccaccucugucuuccccc

SEQ ID NO: 6403 - RNA, 23 nt, Artificial Sequence
  Synthetic
cguggccaccucugucuuccccc

SEQ ID NO: 6404 - RNA, 24 nt, Artificial Sequence
  Synthetic
acguggccaccucugucuuccccc

SEQ ID NO: 6405 - RNA, 18 nt, Artificial Sequence
  Synthetic
ugcugccuccaucgugcc

SEQ ID NO: 6406 - RNA, 19 nt, Artificial Sequence
  Synthetic
cugcugccuccaucgugcc

SEQ ID NO: 6407 - RNA, 21 nt, Artificial Sequence
  Synthetic
cccugcugccuccaucgugcc

SEQ ID NO: 6408 - RNA, 22 nt, Artificial Sequence
  Synthetic
ccccugcugccuccaucgugcc

SEQ ID NO: 6409 - RNA, 23 nt, Artificial Sequence
  Synthetic
cccccugcugccuccaucgugcc

SEQ ID NO: 6410 - RNA, 24 nt, Artificial Sequence
  Synthetic
gcccccugcugccuccaucgugcc

SEQ ID NO: 6411 - RNA, 18 nt, Artificial Sequence
  Synthetic
aaaggggccuccacgucc

SEQ ID NO: 6412 - RNA, 19 nt, Artificial Sequence
  Synthetic
gaaaggggccuccacgucc

SEQ ID NO: 6413 - RNA, 21 nt, Artificial Sequence
  Synthetic
gggaaaggggccuccacgucc

SEQ ID NO: 6414 - RNA, 22 nt, Artificial Sequence
  Synthetic
agggaaaggggccuccacgucc

SEQ ID NO: 6415 - RNA, 23 nt, Artificial Sequence
  Synthetic
gagggaaaggggccuccacgucc

SEQ ID NO: 6416 - RNA, 24 nt, Artificial Sequence
  Synthetic
agagggaaaggggccuccacgucc

SEQ ID NO: 6417 - RNA, 18 nt, Artificial Sequence
  Synthetic
cacguccaggagaauucc

SEQ ID NO: 6418 - RNA, 19 nt, Artificial Sequence
  Synthetic
ccacguccaggagaauucc

SEQ ID NO: 6419 - RNA, 21 nt, Artificial Sequence
  Synthetic
cuccacguccaggagaauucc

SEQ ID NO: 6420 - RNA, 22 nt, Artificial Sequence
  Synthetic
ccuccacguccaggagaauucc

SEQ ID NO: 6421 - RNA, 23 nt, Artificial Sequence
  Synthetic
gccuccacguccaggagaauucc

SEQ ID NO: 6422 - RNA, 24 nt, Artificial Sequence
  Synthetic
ggccuccacguccaggagaauucc

SEQ ID NO: 6423 - RNA, 18 nt, Artificial Sequence
  Synthetic
agagguuuccucuccagc

SEQ ID NO: 6424 - RNA, 19 nt, Artificial Sequence
  Synthetic
cagagguuuccucuccagc

SEQ ID NO: 6425 - RNA, 21 nt, Artificial Sequence
  Synthetic
ggcagagguuuccucuccagc

SEQ ID NO: 6426 - RNA, 22 nt, Artificial Sequence
  Synthetic
cggcagagguuuccucuccagc

SEQ ID NO: 6427 - RNA, 23 nt, Artificial Sequence
  Synthetic
ccggcagagguuuccucuccagc

SEQ ID NO: 6428 - RNA, 24 nt, Artificial Sequence
  Synthetic
cccggcagagguuuccucuccagc

SEQ ID NO: 6429 - RNA, 18 nt, Artificial Sequence
  Synthetic
aagaaucuugcuggcagc

SEQ ID NO: 6430 - RNA, 19 nt, Artificial Sequence
  Synthetic
uaagaaucuugcuggcagc

SEQ ID NO: 6431 - RNA, 21 nt, Artificial Sequence
  Synthetic
ucuaagaaucuugcuggcagc

SEQ ID NO: 6432 - RNA, 22 nt, Artificial Sequence
  Synthetic
uucuaagaaucuugcuggcagc

SEQ ID NO: 6433 - RNA, 23 nt, Artificial Sequence
  Synthetic
uuucuaagaaucuugcuggcagc

SEQ ID NO: 6434 - RNA, 24 nt, Artificial Sequence
  Synthetic
uuuucuaagaaucuugcuggcagc

SEQ ID NO: 6435 - RNA, 18 nt, Artificial Sequence
  Synthetic
uauaaaccucucuggagc

SEQ ID NO: 6436 - RNA, 19 nt, Artificial Sequence
  Synthetic
auauaaaccucucuggagc

SEQ ID NO: 6437 - RNA, 21 nt, Artificial Sequence
  Synthetic
auauauaaaccucucuggagc

SEQ ID NO: 6438 - RNA, 22 nt, Artificial Sequence
  Synthetic
uauauauaaaccucucuggagc

SEQ ID NO: 6439 - RNA, 23 nt, Artificial Sequence
  Synthetic
guauauauaaaccucucuggagc

SEQ ID NO: 6440 - RNA, 24 nt, Artificial Sequence
  Synthetic
aguauauauaaaccucucuggagc

SEQ ID NO: 6441 - RNA, 18 nt, Artificial Sequence
  Synthetic
guccuggugcaucugagc

SEQ ID NO: 6442 - RNA, 19 nt, Artificial Sequence
  Synthetic
cguccuggugcaucugagc

SEQ ID NO: 6443 - RNA, 21 nt, Artificial Sequence
  Synthetic
aucguccuggugcaucugagc

SEQ ID NO: 6444 - RNA, 22 nt, Artificial Sequence
  Synthetic
aaucguccuggugcaucugagc

SEQ ID NO: 6445 - RNA, 23 nt, Artificial Sequence
  Synthetic
gaaucguccuggugcaucugagc

SEQ ID NO: 6446 - RNA, 24 nt, Artificial Sequence
  Synthetic
ugaaucguccuggugcaucugagc

SEQ ID NO: 6447 - RNA, 18 nt, Artificial Sequence
  Synthetic
ugcagggaguggggacgc

SEQ ID NO: 6448 - RNA, 19 nt, Artificial Sequence
  Synthetic
cugcagggaguggggacgc

SEQ ID NO: 6449 - RNA, 21 nt, Artificial Sequence
  Synthetic
gacugcagggaguggggacgc

SEQ ID NO: 6450 - RNA, 22 nt, Artificial Sequence
  Synthetic
ggacugcagggaguggggacgc

SEQ ID NO: 6451 - RNA, 23 nt, Artificial Sequence
  Synthetic
gggacugcagggaguggggacgc

SEQ ID NO: 6452 - RNA, 24 nt, Artificial Sequence
  Synthetic
ggggacugcagggaguggggacgc

SEQ ID NO: 6453 - RNA, 18 nt, Artificial Sequence
  Synthetic
gagcgggugcugaaaggc

SEQ ID NO: 6454 - RNA, 19 nt, Artificial Sequence
  Synthetic
ugagcgggugcugaaaggc

SEQ ID NO: 6455 - RNA, 21 nt, Artificial Sequence
  Synthetic
gcugagcgggugcugaaaggc

SEQ ID NO: 6456 - RNA, 22 nt, Artificial Sequence
  Synthetic
ggcugagcgggugcugaaaggc

SEQ ID NO: 6457 - RNA, 23 nt, Artificial Sequence
  Synthetic
gggcugagcgggugcugaaaggc

SEQ ID NO: 6458 - RNA, 24 nt, Artificial Sequence
  Synthetic
ggggcugagcgggugcugaaaggc

SEQ ID NO: 6459 - RNA, 18 nt, Artificial Sequence
  Synthetic
ccucucuggagcucgggc

SEQ ID NO: 6460 - RNA, 19 nt, Artificial Sequence
  Synthetic
accucucuggagcucgggc

SEQ ID NO: 6461 - RNA, 21 nt, Artificial Sequence
  Synthetic
aaaccucucuggagcucgggc

SEQ ID NO: 6462 - RNA, 22 nt, Artificial Sequence
  Synthetic
uaaaccucucuggagcucgggc

SEQ ID NO: 6463 - RNA, 23 nt, Artificial Sequence
  Synthetic
auaaaccucucuggagcucgggc

SEQ ID NO: 6464 - RNA, 24 nt, Artificial Sequence
  Synthetic
uauaaaccucucuggagcucgggc

SEQ ID NO: 6465 - RNA, 18 nt, Artificial Sequence
  Synthetic
caguguuguucacggggc

SEQ ID NO: 6466 - RNA, 19 nt, Artificial Sequence
  Synthetic
ucaguguuguucacggggc

SEQ ID NO: 6467 - RNA, 21 nt, Artificial Sequence
  Synthetic
guucaguguuguucacggggc

SEQ ID NO: 6468 - RNA, 22 nt, Artificial Sequence
  Synthetic
uguucaguguuguucacggggc

SEQ ID NO: 6469 - RNA, 23 nt, Artificial Sequence
  Synthetic
auguucaguguuguucacggggc

SEQ ID NO: 6470 - RNA, 24 nt, Artificial Sequence
  Synthetic
gauguucaguguuguucacggggc

SEQ ID NO: 6471 - RNA, 18 nt, Artificial Sequence
  Synthetic
ccaggagguggggacugc

SEQ ID NO: 6472 - RNA, 19 nt, Artificial Sequence
  Synthetic
uccaggagguggggacugc

SEQ ID NO: 6473 - RNA, 21 nt, Artificial Sequence
  Synthetic
auuccaggagguggggacugc

SEQ ID NO: 6474 - RNA, 22 nt, Artificial Sequence
  Synthetic
aauuccaggagguggggacugc

SEQ ID NO: 6475 - RNA, 23 nt, Artificial Sequence
  Synthetic
gaauuccaggagguggggacugc

SEQ ID NO: 6476 - RNA, 24 nt, Artificial Sequence
  Synthetic
agaauuccaggagguggggacugc

SEQ ID NO: 6477 - RNA, 18 nt, Artificial Sequence
  Synthetic
uuuuuaucuuuucucugc

SEQ ID NO: 6478 - RNA, 19 nt, Artificial Sequence
  Synthetic
cuuuuuaucuuuucucugc

SEQ ID NO: 6479 - RNA, 21 nt, Artificial Sequence
  Synthetic
gccuuuuuaucuuuucucugc

SEQ ID NO: 6480 - RNA, 22 nt, Artificial Sequence
  Synthetic
agccuuuuuaucuuuucucugc

SEQ ID NO: 6481 - RNA, 23 nt, Artificial Sequence
  Synthetic
gagccuuuuuaucuuuucucugc

SEQ ID NO: 6482 - RNA, 24 nt, Artificial Sequence
  Synthetic
ugagccuuuuuaucuuuucucugc

SEQ ID NO: 6483 - RNA, 18 nt, Artificial Sequence
  Synthetic
cugcugccuccaucgugc

SEQ ID NO: 6484 - RNA, 19 nt, Artificial Sequence
  Synthetic
ccugcugccuccaucgugc

SEQ ID NO: 6485 - RNA, 21 nt, Artificial Sequence
  Synthetic
ccccugcugccuccaucgugc

SEQ ID NO: 6486 - RNA, 22 nt, Artificial Sequence
  Synthetic
cccccugcugccuccaucgugc

SEQ ID NO: 6487 - RNA, 23 nt, Artificial Sequence
  Synthetic
gcccccugcugccuccaucgugc

SEQ ID NO: 6488 - RNA, 24 nt, Artificial Sequence
  Synthetic
cgcccccugcugccuccaucgugc

SEQ ID NO: 6489 - RNA, 18 nt, Artificial Sequence
  Synthetic
cuagucuaacggagaauc

SEQ ID NO: 6490 - RNA, 19 nt, Artificial Sequence
  Synthetic
acuagucuaacggagaauc

SEQ ID NO: 6491 - RNA, 21 nt, Artificial Sequence
  Synthetic
aaacuagucuaacggagaauc

SEQ ID NO: 6492 - RNA, 22 nt, Artificial Sequence
  Synthetic
gaaacuagucuaacggagaauc

SEQ ID NO: 6493 - RNA, 23 nt, Artificial Sequence
  Synthetic
ggaaacuagucuaacggagaauc

SEQ ID NO: 6494 - RNA, 24 nt, Artificial Sequence
  Synthetic
gggaaacuagucuaacggagaauc

SEQ ID NO: 6495 - RNA, 18 nt, Artificial Sequence
  Synthetic
aaggaaauaaacaccauc

SEQ ID NO: 6496 - RNA, 19 nt, Artificial Sequence
  Synthetic
aaaggaaauaaacaccauc

SEQ ID NO: 6497 - RNA, 21 nt, Artificial Sequence
  Synthetic
agaaaggaaauaaacaccauc

SEQ ID NO: 6498 - RNA, 22 nt, Artificial Sequence
  Synthetic
aagaaaggaaauaaacaccauc

SEQ ID NO: 6499 - RNA, 23 nt, Artificial Sequence
  Synthetic
aaagaaaggaaauaaacaccauc

SEQ ID NO: 6500 - RNA, 24 nt, Artificial Sequence
  Synthetic
gaaagaaaggaaauaaacaccauc

SEQ ID NO: 6501 - RNA, 18 nt, Artificial Sequence
  Synthetic
cuccuuggcuccaggcuc

SEQ ID NO: 6502 - RNA, 19 nt, Artificial Sequence
  Synthetic
acuccuuggcuccaggcuc

SEQ ID NO: 6503 - RNA, 21 nt, Artificial Sequence
  Synthetic
agacuccuuggcuccaggcuc

SEQ ID NO: 6504 - RNA, 22 nt, Artificial Sequence
  Synthetic
gagacuccuuggcuccaggcuc

SEQ ID NO: 6505 - RNA, 23 nt, Artificial Sequence
  Synthetic
ggagacuccuuggcuccaggcuc

SEQ ID NO: 6506 - RNA, 24 nt, Artificial Sequence
  Synthetic
uggagacuccuuggcuccaggcuc

SEQ ID NO: 6507 - RNA, 18 nt, Artificial Sequence
  Synthetic
uguuuuguuaucacucuc

SEQ ID NO: 6508 - RNA, 19 nt, Artificial Sequence
  Synthetic
uuguuuuguuaucacucuc

SEQ ID NO: 6509 - RNA, 21 nt, Artificial Sequence
  Synthetic
gguuguuuuguuaucacucuc

SEQ ID NO: 6510 - RNA, 22 nt, Artificial Sequence
  Synthetic
ugguuguuuuguuaucacucuc

SEQ ID NO: 6511 - RNA, 23 nt, Artificial Sequence
  Synthetic
cugguuguuuuguuaucacucuc

SEQ ID NO: 6512 - RNA, 24 nt, Artificial Sequence
  Synthetic
acugguuguuuuguuaucacucuc

SEQ ID NO: 6513 - RNA, 18 nt, Artificial Sequence
  Synthetic
aguauauauaaaccucuc

SEQ ID NO: 6514 - RNA, 19 nt, Artificial Sequence
  Synthetic
caguauauauaaaccucuc

SEQ ID NO: 6515 - RNA, 21 nt, Artificial Sequence
  Synthetic
cccaguauauauaaaccucuc

SEQ ID NO: 6516 - RNA, 22 nt, Artificial Sequence
  Synthetic
ccccaguauauauaaaccucuc

SEQ ID NO: 6517 - RNA, 23 nt, Artificial Sequence
  Synthetic
uccccaguauauauaaaccucuc

SEQ ID NO: 6518 - RNA, 24 nt, Artificial Sequence
  Synthetic
cuccccaguauauauaaaccucuc

SEQ ID NO: 6519 - RNA, 18 nt, Artificial Sequence
  Synthetic
uggaggugacaguuucuc

SEQ ID NO: 6520 - RNA, 19 nt, Artificial Sequence
  Synthetic
guggaggugacaguuucuc

SEQ ID NO: 6521 - RNA, 21 nt, Artificial Sequence
  Synthetic
ucguggaggugacaguuucuc

SEQ ID NO: 6522 - RNA, 22 nt, Artificial Sequence
  Synthetic
uucguggaggugacaguuucuc

SEQ ID NO: 6523 - RNA, 23 nt, Artificial Sequence
  Synthetic
cuucguggaggugacaguuucuc

SEQ ID NO: 6524 - RNA, 24 nt, Artificial Sequence
  Synthetic
ccuucguggaggugacaguuucuc

SEQ ID NO: 6525 - RNA, 18 nt, Artificial Sequence
  Synthetic
gaaaggggccuccacguc

SEQ ID NO: 6526 - RNA, 19 nt, Artificial Sequence
  Synthetic
ggaaaggggccuccacguc

SEQ ID NO: 6527 - RNA, 21 nt, Artificial Sequence
  Synthetic
agggaaaggggccuccacguc

SEQ ID NO: 6528 - RNA, 22 nt, Artificial Sequence
  Synthetic
gagggaaaggggccuccacguc

SEQ ID NO: 6529 - RNA, 23 nt, Artificial Sequence
  Synthetic
agagggaaaggggccuccacguc

SEQ ID NO: 6530 - RNA, 24 nt, Artificial Sequence
  Synthetic
cagagggaaaggggccuccacguc

SEQ ID NO: 6531 - RNA, 18 nt, Artificial Sequence
  Synthetic
cccgggguccuggguguc

SEQ ID NO: 6532 - RNA, 19 nt, Artificial Sequence
  Synthetic
acccgggguccuggguguc

SEQ ID NO: 6533 - RNA, 21 nt, Artificial Sequence
  Synthetic
gcacccgggguccuggguguc

SEQ ID NO: 6534 - RNA, 22 nt, Artificial Sequence
  Synthetic
agcacccgggguccuggguguc

SEQ ID NO: 6535 - RNA, 23 nt, Artificial Sequence
  Synthetic
aagcacccgggguccuggguguc

SEQ ID NO: 6536 - RNA, 24 nt, Artificial Sequence
  Synthetic
caagcacccgggguccuggguguc

SEQ ID NO: 6537 - RNA, 18 nt, Artificial Sequence
  Synthetic
ccacguccaggagaauuc

SEQ ID NO: 6538 - RNA, 19 nt, Artificial Sequence
  Synthetic
uccacguccaggagaauuc

SEQ ID NO: 6539 - RNA, 21 nt, Artificial Sequence
  Synthetic
ccuccacguccaggagaauuc

SEQ ID NO: 6540 - RNA, 22 nt, Artificial Sequence
  Synthetic
gccuccacguccaggagaauuc

SEQ ID NO: 6541 - RNA, 23 nt, Artificial Sequence
  Synthetic
ggccuccacguccaggagaauuc

SEQ ID NO: 6542 - RNA, 24 nt, Artificial Sequence
  Synthetic
gggccuccacguccaggagaauuc

SEQ ID NO: 6543 - RNA, 18 nt, Artificial Sequence
  Synthetic
uuccuaggccguuaauuc

SEQ ID NO: 6544 - RNA, 19 nt, Artificial Sequence
  Synthetic
uuuccuaggccguuaauuc

SEQ ID NO: 6545 - RNA, 21 nt, Artificial Sequence
  Synthetic
cauuuccuaggccguuaauuc

SEQ ID NO: 6546 - RNA, 22 nt, Artificial Sequence
  Synthetic
ucauuuccuaggccguuaauuc

SEQ ID NO: 6547 - RNA, 23 nt, Artificial Sequence
  Synthetic
cucauuuccuaggccguuaauuc

SEQ ID NO: 6548 - RNA, 24 nt, Artificial Sequence
  Synthetic
gcucauuuccuaggccguuaauuc

SEQ ID NO: 6549 - RNA, 18 nt, Artificial Sequence
  Synthetic
aaacuccaaacagacuuc

SEQ ID NO: 6550 - RNA, 19 nt, Artificial Sequence
  Synthetic
gaaacuccaaacagacuuc

SEQ ID NO: 6551 - RNA, 21 nt, Artificial Sequence
  Synthetic
aagaaacuccaaacagacuuc

SEQ ID NO: 6552 - RNA, 22 nt, Artificial Sequence
  Synthetic
aaagaaacuccaaacagacuuc

SEQ ID NO: 6553 - RNA, 23 nt, Artificial Sequence
  Synthetic
aaaagaaacuccaaacagacuuc

SEQ ID NO: 6554 - RNA, 24 nt, Artificial Sequence
  Synthetic
aaaaagaaacuccaaacagacuuc

SEQ ID NO: 6555 - RNA, 18 nt, Artificial Sequence
  Synthetic
agucacugcccuaccuuc

SEQ ID NO: 6556 - RNA, 19 nt, Artificial Sequence
  Synthetic
cagucacugcccuaccuuc

SEQ ID NO: 6557 - RNA, 21 nt, Artificial Sequence
  Synthetic
agcagucacugcccuaccuuc

SEQ ID NO: 6558 - RNA, 22 nt, Artificial Sequence
  Synthetic
aagcagucacugcccuaccuuc

SEQ ID NO: 6559 - RNA, 23 nt, Artificial Sequence
  Synthetic
aaagcagucacugcccuaccuuc

SEQ ID NO: 6560 - RNA, 24 nt, Artificial Sequence
  Synthetic
caaagcagucacugcccuaccuuc

SEQ ID NO: 6561 - RNA, 18 nt, Artificial Sequence
  Synthetic
gugcauggguuuuccuuc

SEQ ID NO: 6562 - RNA, 19 nt, Artificial Sequence
  Synthetic
ugugcauggguuuuccuuc

SEQ ID NO: 6563 - RNA, 21 nt, Artificial Sequence
  Synthetic
ggugugcauggguuuuccuuc

SEQ ID NO: 6564 - RNA, 22 nt, Artificial Sequence
  Synthetic
gggugugcauggguuuuccuuc

SEQ ID NO: 6565 - RNA, 23 nt, Artificial Sequence
  Synthetic
agggugugcauggguuuuccuuc

SEQ ID NO: 6566 - RNA, 24 nt, Artificial Sequence
  Synthetic
cagggugugcauggguuuuccuuc

SEQ ID NO: 6567 - RNA, 18 nt, Artificial Sequence
  Synthetic
agauguucaguguuguuc

SEQ ID NO: 6568 - RNA, 19 nt, Artificial Sequence
  Synthetic
cagauguucaguguuguuc

SEQ ID NO: 6569 - RNA, 21 nt, Artificial Sequence
  Synthetic
cccagauguucaguguuguuc

SEQ ID NO: 6570 - RNA, 22 nt, Artificial Sequence
  Synthetic
gcccagauguucaguguuguuc

SEQ ID NO: 6571 - RNA, 23 nt, Artificial Sequence
  Synthetic
ugcccagauguucaguguuguuc

SEQ ID NO: 6572 - RNA, 24 nt, Artificial Sequence
  Synthetic
cugcccagauguucaguguuguuc

SEQ ID NO: 6573 - RNA, 18 nt, Artificial Sequence
  Synthetic
ggagaagaagucuauuuc

SEQ ID NO: 6574 - RNA, 19 nt, Artificial Sequence
  Synthetic
aggagaagaagucuauuuc

SEQ ID NO: 6575 - RNA, 21 nt, Artificial Sequence
  Synthetic
ggaggagaagaagucuauuuc

SEQ ID NO: 6576 - RNA, 22 nt, Artificial Sequence
  Synthetic
uggaggagaagaagucuauuuc

SEQ ID NO: 6577 - RNA, 23 nt, Artificial Sequence
  Synthetic
uuggaggagaagaagucuauuuc

SEQ ID NO: 6578 - RNA, 24 nt, Artificial Sequence
  Synthetic
cuuggaggagaagaagucuauuuc

SEQ ID NO: 6579 - RNA, 18 nt, Artificial Sequence
  Synthetic
cagcacagcagagcuuuc

SEQ ID NO: 6580 - RNA, 19 nt, Artificial Sequence
  Synthetic
ucagcacagcagagcuuuc

SEQ ID NO: 6581 - RNA, 21 nt, Artificial Sequence
  Synthetic
ucucagcacagcagagcuuuc

SEQ ID NO: 6582 - RNA, 22 nt, Artificial Sequence
  Synthetic
cucucagcacagcagagcuuuc

SEQ ID NO: 6583 - RNA, 23 nt, Artificial Sequence
  Synthetic
ccucucagcacagcagagcuuuc

SEQ ID NO: 6584 - RNA, 24 nt, Artificial Sequence
  Synthetic
accucucagcacagcagagcuuuc

SEQ ID NO: 6585 - RNA, 18 nt, Artificial Sequence
  Synthetic
gugcugaaaggcaggaag

SEQ ID NO: 6586 - RNA, 19 nt, Artificial Sequence
  Synthetic
ggugcugaaaggcaggaag

SEQ ID NO: 6587 - RNA, 21 nt, Artificial Sequence
  Synthetic
cgggugcugaaaggcaggaag

SEQ ID NO: 6588 - RNA, 22 nt, Artificial Sequence
  Synthetic
gcgggugcugaaaggcaggaag

SEQ ID NO: 6589 - RNA, 23 nt, Artificial Sequence
  Synthetic
agcgggugcugaaaggcaggaag

SEQ ID NO: 6590 - RNA, 24 nt, Artificial Sequence
  Synthetic
gagcgggugcugaaaggcaggaag

SEQ ID NO: 6591 - RNA, 18 nt, Artificial Sequence
  Synthetic
aggcaccucucagcacag

SEQ ID NO: 6592 - RNA, 19 nt, Artificial Sequence
  Synthetic
caggcaccucucagcacag

SEQ ID NO: 6593 - RNA, 21 nt, Artificial Sequence
  Synthetic
uccaggcaccucucagcacag

SEQ ID NO: 6594 - RNA, 22 nt, Artificial Sequence
  Synthetic
auccaggcaccucucagcacag

SEQ ID NO: 6595 - RNA, 23 nt, Artificial Sequence
  Synthetic
cauccaggcaccucucagcacag

SEQ ID NO: 6596 - RNA, 24 nt, Artificial Sequence
  Synthetic
ccauccaggcaccucucagcacag

SEQ ID NO: 6597 - RNA, 18 nt, Artificial Sequence
  Synthetic
guguguguguaaaaccag

SEQ ID NO: 6598 - RNA, 19 nt, Artificial Sequence
  Synthetic
uguguguguguaaaaccag

SEQ ID NO: 6599 - RNA, 21 nt, Artificial Sequence
  Synthetic
uguguguguguguaaaaccag

SEQ ID NO: 6600 - RNA, 22 nt, Artificial Sequence
  Synthetic
guguguguguguguaaaaccag

SEQ ID NO: 6601 - RNA, 23 nt, Artificial Sequence
  Synthetic
uguguguguguguguaaaaccag

SEQ ID NO: 6602 - RNA, 24 nt, Artificial Sequence
  Synthetic
guguguguguguguguaaaaccag

SEQ ID NO: 6603 - RNA, 18 nt, Artificial Sequence
  Synthetic
cagagguuuccucuccag

SEQ ID NO: 6604 - RNA, 19 nt, Artificial Sequence
  Synthetic
gcagagguuuccucuccag

SEQ ID NO: 6605 - RNA, 21 nt, Artificial Sequence
  Synthetic
cggcagagguuuccucuccag

SEQ ID NO: 6606 - RNA, 22 nt, Artificial Sequence
  Synthetic
ccggcagagguuuccucuccag

SEQ ID NO: 6607 - RNA, 23 nt, Artificial Sequence
  Synthetic
cccggcagagguuuccucuccag

SEQ ID NO: 6608 - RNA, 24 nt, Artificial Sequence
  Synthetic
ccccggcagagguuuccucuccag

SEQ ID NO: 6609 - RNA, 18 nt, Artificial Sequence
  Synthetic
cacagcagagcuuuccag

SEQ ID NO: 6610 - RNA, 19 nt, Artificial Sequence
  Synthetic
gcacagcagagcuuuccag

SEQ ID NO: 6611 - RNA, 21 nt, Artificial Sequence
  Synthetic
cagcacagcagagcuuuccag

SEQ ID NO: 6612 - RNA, 22 nt, Artificial Sequence
  Synthetic
ucagcacagcagagcuuuccag

SEQ ID NO: 6613 - RNA, 23 nt, Artificial Sequence
  Synthetic
cucagcacagcagagcuuuccag

SEQ ID NO: 6614 - RNA, 24 nt, Artificial Sequence
  Synthetic
ucucagcacagcagagcuuuccag

SEQ ID NO: 6615 - RNA, 18 nt, Artificial Sequence
  Synthetic
cucauggaagacgugcag

SEQ ID NO: 6616 - RNA, 19 nt, Artificial Sequence
  Synthetic
ucucauggaagacgugcag

SEQ ID NO: 6617 - RNA, 21 nt, Artificial Sequence
  Synthetic
uuucucauggaagacgugcag

SEQ ID NO: 6618 - RNA, 22 nt, Artificial Sequence
  Synthetic
guuucucauggaagacgugcag

SEQ ID NO: 6619 - RNA, 23 nt, Artificial Sequence
  Synthetic
aguuucucauggaagacgugcag

SEQ ID NO: 6620 - RNA, 24 nt, Artificial Sequence
  Synthetic
caguuucucauggaagacgugcag

SEQ ID NO: 6621 - RNA, 18 nt, Artificial Sequence
  Synthetic
gggacaguguuuccucag

SEQ ID NO: 6622 - RNA, 19 nt, Artificial Sequence
  Synthetic
ggggacaguguuuccucag

SEQ ID NO: 6623 - RNA, 21 nt, Artificial Sequence
  Synthetic
gaggggacaguguuuccucag

SEQ ID NO: 6624 - RNA, 22 nt, Artificial Sequence
  Synthetic
ggaggggacaguguuuccucag

SEQ ID NO: 6625 - RNA, 23 nt, Artificial Sequence
  Synthetic
uggaggggacaguguuuccucag

SEQ ID NO: 6626 - RNA, 24 nt, Artificial Sequence
  Synthetic
cuggaggggacaguguuuccucag

SEQ ID NO: 6627 - RNA, 18 nt, Artificial Sequence
  Synthetic
ccaggagaauuccaggag

SEQ ID NO: 6628 - RNA, 19 nt, Artificial Sequence
  Synthetic
uccaggagaauuccaggag

SEQ ID NO: 6629 - RNA, 21 nt, Artificial Sequence
  Synthetic
cguccaggagaauuccaggag

SEQ ID NO: 6630 - RNA, 22 nt, Artificial Sequence
  Synthetic
acguccaggagaauuccaggag

SEQ ID NO: 6631 - RNA, 23 nt, Artificial Sequence
  Synthetic
cacguccaggagaauuccaggag

SEQ ID NO: 6632 - RNA, 24 nt, Artificial Sequence
  Synthetic
ccacguccaggagaauuccaggag

SEQ ID NO: 6633 - RNA, 18 nt, Artificial Sequence
  Synthetic
uuucucugcuuggaggag

SEQ ID NO: 6634 - RNA, 19 nt, Artificial Sequence
  Synthetic
uuuucucugcuuggaggag

SEQ ID NO: 6635 - RNA, 21 nt, Artificial Sequence
  Synthetic
ucuuuucucugcuuggaggag

SEQ ID NO: 6636 - RNA, 22 nt, Artificial Sequence
  Synthetic
aucuuuucucugcuuggaggag

SEQ ID NO: 6637 - RNA, 23 nt, Artificial Sequence
  Synthetic
uaucuuuucucugcuuggaggag

SEQ ID NO: 6638 - RNA, 24 nt, Artificial Sequence
  Synthetic
uuaucuuuucucugcuuggaggag

SEQ ID NO: 6639 - RNA, 18 nt, Artificial Sequence
  Synthetic
gguggggacugcagggag

SEQ ID NO: 6640 - RNA, 19 nt, Artificial Sequence
  Synthetic
agguggggacugcagggag

SEQ ID NO: 6641 - RNA, 21 nt, Artificial Sequence
  Synthetic
ggagguggggacugcagggag

SEQ ID NO: 6642 - RNA, 22 nt, Artificial Sequence
  Synthetic
aggagguggggacugcagggag

SEQ ID NO: 6643 - RNA, 23 nt, Artificial Sequence
  Synthetic
caggagguggggacugcagggag

SEQ ID NO: 6644 - RNA, 24 nt, Artificial Sequence
  Synthetic
ccaggagguggggacugcagggag

SEQ ID NO: 6645 - RNA, 18 nt, Artificial Sequence
  Synthetic
uccagaaaggaaauggag

SEQ ID NO: 6646 - RNA, 19 nt, Artificial Sequence
  Synthetic
cuccagaaaggaaauggag

SEQ ID NO: 6647 - RNA, 21 nt, Artificial Sequence
  Synthetic
ggcuccagaaaggaaauggag

SEQ ID NO: 6648 - RNA, 22 nt, Artificial Sequence
  Synthetic
aggcuccagaaaggaaauggag

SEQ ID NO: 6649 - RNA, 23 nt, Artificial Sequence
  Synthetic
caggcuccagaaaggaaauggag

SEQ ID NO: 6650 - RNA, 24 nt, Artificial Sequence
  Synthetic
ccaggcuccagaaaggaaauggag

SEQ ID NO: 6651 - RNA, 18 nt, Artificial Sequence
  Synthetic
ucuuuucucugcuuggag

SEQ ID NO: 6652 - RNA, 19 nt, Artificial Sequence
  Synthetic
aucuuuucucugcuuggag

SEQ ID NO: 6653 - RNA, 21 nt, Artificial Sequence
  Synthetic
uuaucuuuucucugcuuggag

SEQ ID NO: 6654 - RNA, 22 nt, Artificial Sequence
  Synthetic
uuuaucuuuucucugcuuggag

SEQ ID NO: 6655 - RNA, 23 nt, Artificial Sequence
  Synthetic
uuuuaucuuuucucugcuuggag

SEQ ID NO: 6656 - RNA, 24 nt, Artificial Sequence
  Synthetic
uuuuuaucuuuucucugcuuggag

SEQ ID NO: 6657 - RNA, 18 nt, Artificial Sequence
  Synthetic
cguccuggugcaucugag

SEQ ID NO: 6658 - RNA, 19 nt, Artificial Sequence
  Synthetic
ucguccuggugcaucugag

SEQ ID NO: 6659 - RNA, 21 nt, Artificial Sequence
  Synthetic
aaucguccuggugcaucugag

SEQ ID NO: 6660 - RNA, 22 nt, Artificial Sequence
  Synthetic
gaaucguccuggugcaucugag

SEQ ID NO: 6661 - RNA, 23 nt, Artificial Sequence
  Synthetic
ugaaucguccuggugcaucugag

SEQ ID NO: 6662 - RNA, 24 nt, Artificial Sequence
  Synthetic
gugaaucguccuggugcaucugag

SEQ ID NO: 6663 - RNA, 18 nt, Artificial Sequence
  Synthetic
cugcagggaguggggacg

SEQ ID NO: 6664 - RNA, 19 nt, Artificial Sequence
  Synthetic
acugcagggaguggggacg

SEQ ID NO: 6665 - RNA, 21 nt, Artificial Sequence
  Synthetic
ggacugcagggaguggggacg

SEQ ID NO: 6666 - RNA, 22 nt, Artificial Sequence
  Synthetic
gggacugcagggaguggggacg

SEQ ID NO: 6667 - RNA, 23 nt, Artificial Sequence
  Synthetic
ggggacugcagggaguggggacg

SEQ ID NO: 6668 - RNA, 24 nt, Artificial Sequence
  Synthetic
uggggacugcagggaguggggacg

SEQ ID NO: 6669 - RNA, 18 nt, Artificial Sequence
  Synthetic
gucacugcccuaccuucg

SEQ ID NO: 6670 - RNA, 19 nt, Artificial Sequence
  Synthetic
agucacugcccuaccuucg

SEQ ID NO: 6671 - RNA, 21 nt, Artificial Sequence
  Synthetic
gcagucacugcccuaccuucg

SEQ ID NO: 6672 - RNA, 22 nt, Artificial Sequence
  Synthetic
agcagucacugcccuaccuucg

SEQ ID NO: 6673 - RNA, 23 nt, Artificial Sequence
  Synthetic
aagcagucacugcccuaccuucg

SEQ ID NO: 6674 - RNA, 24 nt, Artificial Sequence
  Synthetic
aaagcagucacugcccuaccuucg

SEQ ID NO: 6675 - RNA, 18 nt, Artificial Sequence
  Synthetic
ugagcgggugcugaaagg

SEQ ID NO: 6676 - RNA, 19 nt, Artificial Sequence
  Synthetic
cugagcgggugcugaaagg

SEQ ID NO: 6677 - RNA, 21 nt, Artificial Sequence
  Synthetic
ggcugagcgggugcugaaagg

SEQ ID NO: 6678 - RNA, 22 nt, Artificial Sequence
  Synthetic
gggcugagcgggugcugaaagg

SEQ ID NO: 6679 - RNA, 23 nt, Artificial Sequence
  Synthetic
ggggcugagcgggugcugaaagg

SEQ ID NO: 6680 - RNA, 24 nt, Artificial Sequence
  Synthetic
uggggcugagcgggugcugaaagg

SEQ ID NO: 6681 - RNA, 18 nt, Artificial Sequence
  Synthetic
aaggugaaaagggcaagg

SEQ ID NO: 6682 - RNA, 19 nt, Artificial Sequence
  Synthetic
gaaggugaaaagggcaagg

SEQ ID NO: 6683 - RNA, 21 nt, Artificial Sequence
  Synthetic
aggaaggugaaaagggcaagg

SEQ ID NO: 6684 - RNA, 22 nt, Artificial Sequence
  Synthetic
caggaaggugaaaagggcaagg

SEQ ID NO: 6685 - RNA, 23 nt, Artificial Sequence
  Synthetic
gcaggaaggugaaaagggcaagg

SEQ ID NO: 6686 - RNA, 24 nt, Artificial Sequence
  Synthetic
ggcaggaaggugaaaagggcaagg

SEQ ID NO: 6687 - RNA, 18 nt, Artificial Sequence
  Synthetic
uguguguguaaaaccagg

SEQ ID NO: 6688 - RNA, 19 nt, Artificial Sequence
  Synthetic
guguguguguaaaaccagg

SEQ ID NO: 6689 - RNA, 21 nt, Artificial Sequence
  Synthetic
guguguguguguaaaaccagg

SEQ ID NO: 6690 - RNA, 22 nt, Artificial Sequence
  Synthetic
uguguguguguguaaaaccagg

SEQ ID NO: 6691 - RNA, 23 nt, Artificial Sequence
  Synthetic
guguguguguguguaaaaccagg

SEQ ID NO: 6692 - RNA, 24 nt, Artificial Sequence
  Synthetic
uguguguguguguguaaaaccagg

SEQ ID NO: 6693 - RNA, 18 nt, Artificial Sequence
  Synthetic
caggagaauuccaggagg

SEQ ID NO: 6694 - RNA, 19 nt, Artificial Sequence
  Synthetic
ccaggagaauuccaggagg

SEQ ID NO: 6695 - RNA, 21 nt, Artificial Sequence
  Synthetic
guccaggagaauuccaggagg

SEQ ID NO: 6696 - RNA, 22 nt, Artificial Sequence
  Synthetic
cguccaggagaauuccaggagg

SEQ ID NO: 6697 - RNA, 23 nt, Artificial Sequence
  Synthetic
acguccaggagaauuccaggagg

SEQ ID NO: 6698 - RNA, 24 nt, Artificial Sequence
  Synthetic
cacguccaggagaauuccaggagg

SEQ ID NO: 6699 - RNA, 18 nt, Artificial Sequence
  Synthetic
uaggccguuaauucacgg

SEQ ID NO: 6700 - RNA, 19 nt, Artificial Sequence
  Synthetic
cuaggccguuaauucacgg

SEQ ID NO: 6701 - RNA, 21 nt, Artificial Sequence
  Synthetic
uccuaggccguuaauucacgg

SEQ ID NO: 6702 - RNA, 22 nt, Artificial Sequence
  Synthetic
uuccuaggccguuaauucacgg

SEQ ID NO: 6703 - RNA, 23 nt, Artificial Sequence
  Synthetic
uuuccuaggccguuaauucacgg

SEQ ID NO: 6704 - RNA, 24 nt, Artificial Sequence
  Synthetic
auuuccuaggccguuaauucacgg

SEQ ID NO: 6705 - RNA, 18 nt, Artificial Sequence
  Synthetic
ucaguguuguucacgggg

SEQ ID NO: 6706 - RNA, 19 nt, Artificial Sequence
  Synthetic
uucaguguuguucacgggg

SEQ ID NO: 6707 - RNA, 21 nt, Artificial Sequence
  Synthetic
uguucaguguuguucacgggg

SEQ ID NO: 6708 - RNA, 22 nt, Artificial Sequence
  Synthetic
auguucaguguuguucacgggg

SEQ ID NO: 6709 - RNA, 23 nt, Artificial Sequence
  Synthetic
gauguucaguguuguucacgggg

SEQ ID NO: 6710 - RNA, 24 nt, Artificial Sequence
  Synthetic
agauguucaguguuguucacgggg

SEQ ID NO: 6711 - RNA, 18 nt, Artificial Sequence
  Synthetic
ggaguggggacgcugggg

SEQ ID NO: 6712 - RNA, 19 nt, Artificial Sequence
  Synthetic
gggaguggggacgcugggg

SEQ ID NO: 6713 - RNA, 21 nt, Artificial Sequence
  Synthetic
cagggaguggggacgcugggg

SEQ ID NO: 6714 - RNA, 22 nt, Artificial Sequence
  Synthetic
gcagggaguggggacgcugggg

SEQ ID NO: 6715 - RNA, 23 nt, Artificial Sequence
  Synthetic
ugcagggaguggggacgcugggg

SEQ ID NO: 6716 - RNA, 24 nt, Artificial Sequence
  Synthetic
cugcagggaguggggacgcugggg

SEQ ID NO: 6717 - RNA, 18 nt, Artificial Sequence
  Synthetic
gguuuccucuccagcugg

SEQ ID NO: 6718 - RNA, 19 nt, Artificial Sequence
  Synthetic
agguuuccucuccagcugg

SEQ ID NO: 6719 - RNA, 21 nt, Artificial Sequence
  Synthetic
agagguuuccucuccagcugg

SEQ ID NO: 6720 - RNA, 22 nt, Artificial Sequence
  Synthetic
cagagguuuccucuccagcugg

SEQ ID NO: 6721 - RNA, 23 nt, Artificial Sequence
  Synthetic
gcagagguuuccucuccagcugg

SEQ ID NO: 6722 - RNA, 24 nt, Artificial Sequence
  Synthetic
ggcagagguuuccucuccagcugg

SEQ ID NO: 6723 - RNA, 18 nt, Artificial Sequence
  Synthetic
gucuaacggagaaucugg

SEQ ID NO: 6724 - RNA, 19 nt, Artificial Sequence
  Synthetic
agucuaacggagaaucugg

SEQ ID NO: 6725 - RNA, 21 nt, Artificial Sequence
  Synthetic
cuagucuaacggagaaucugg

SEQ ID NO: 6726 - RNA, 22 nt, Artificial Sequence
  Synthetic
acuagucuaacggagaaucugg

SEQ ID NO: 6727 - RNA, 23 nt, Artificial Sequence
  Synthetic
aacuagucuaacggagaaucugg

SEQ ID NO: 6728 - RNA, 24 nt, Artificial Sequence
  Synthetic
aaacuagucuaacggagaaucugg

SEQ ID NO: 6729 - RNA, 18 nt, Artificial Sequence
  Synthetic
uaucuuuucucugcuugg

SEQ ID NO: 6730 - RNA, 19 nt, Artificial Sequence
  Synthetic
uuaucuuuucucugcuugg

SEQ ID NO: 6731 - RNA, 21 nt, Artificial Sequence
  Synthetic
uuuuaucuuuucucugcuugg

SEQ ID NO: 6732 - RNA, 22 nt, Artificial Sequence
  Synthetic
uuuuuaucuuuucucugcuugg

SEQ ID NO: 6733 - RNA, 23 nt, Artificial Sequence
  Synthetic
cuuuuuaucuuuucucugcuugg

SEQ ID NO: 6734 - RNA, 24 nt, Artificial Sequence
  Synthetic
ccuuuuuaucuuuucucugcuugg

SEQ ID NO: 6735 - RNA, 18 nt, Artificial Sequence
  Synthetic
gacaccagagacaaaaug

SEQ ID NO: 6736 - RNA, 19 nt, Artificial Sequence
  Synthetic
agacaccagagacaaaaug

SEQ ID NO: 6737 - RNA, 21 nt, Artificial Sequence
  Synthetic
ccagacaccagagacaaaaug

SEQ ID NO: 6738 - RNA, 22 nt, Artificial Sequence
  Synthetic
gccagacaccagagacaaaaug

SEQ ID NO: 6739 - RNA, 23 nt, Artificial Sequence
  Synthetic
ugccagacaccagagacaaaaug

SEQ ID NO: 6740 - RNA, 24 nt, Artificial Sequence
  Synthetic
cugccagacaccagagacaaaaug

SEQ ID NO: 6741 - RNA, 18 nt, Artificial Sequence
  Synthetic
ggcuccagaaaggaaaug

SEQ ID NO: 6742 - RNA, 19 nt, Artificial Sequence
  Synthetic
aggcuccagaaaggaaaug

SEQ ID NO: 6743 - RNA, 21 nt, Artificial Sequence
  Synthetic
ccaggcuccagaaaggaaaug

SEQ ID NO: 6744 - RNA, 22 nt, Artificial Sequence
  Synthetic
uccaggcuccagaaaggaaaug

SEQ ID NO: 6745 - RNA, 23 nt, Artificial Sequence
  Synthetic
cuccaggcuccagaaaggaaaug

SEQ ID NO: 6746 - RNA, 24 nt, Artificial Sequence
  Synthetic
gcuccaggcuccagaaaggaaaug

SEQ ID NO: 6747 - RNA, 18 nt, Artificial Sequence
  Synthetic
ccucugucuucccccaug

SEQ ID NO: 6748 - RNA, 19 nt, Artificial Sequence
  Synthetic
accucugucuucccccaug

SEQ ID NO: 6749 - RNA, 21 nt, Artificial Sequence
  Synthetic
ccaccucugucuucccccaug

SEQ ID NO: 6750 - RNA, 22 nt, Artificial Sequence
  Synthetic
gccaccucugucuucccccaug

SEQ ID NO: 6751 - RNA, 23 nt, Artificial Sequence
  Synthetic
ggccaccucugucuucccccaug

SEQ ID NO: 6752 - RNA, 24 nt, Artificial Sequence
  Synthetic
uggccaccucugucuucccccaug

SEQ ID NO: 6753 - RNA, 18 nt, Artificial Sequence
  Synthetic
gaagaagucuauuucaug

SEQ ID NO: 6754 - RNA, 19 nt, Artificial Sequence
  Synthetic
agaagaagucuauuucaug

SEQ ID NO: 6755 - RNA, 21 nt, Artificial Sequence
  Synthetic
ggagaagaagucuauuucaug

SEQ ID NO: 6756 - RNA, 22 nt, Artificial Sequence
  Synthetic
aggagaagaagucuauuucaug

SEQ ID NO: 6757 - RNA, 23 nt, Artificial Sequence
  Synthetic
gaggagaagaagucuauuucaug

SEQ ID NO: 6758 - RNA, 24 nt, Artificial Sequence
  Synthetic
ggaggagaagaagucuauuucaug

SEQ ID NO: 6759 - RNA, 18 nt, Artificial Sequence
  Synthetic
uccaggagguggggacug

SEQ ID NO: 6760 - RNA, 19 nt, Artificial Sequence
  Synthetic
uuccaggagguggggacug

SEQ ID NO: 6761 - RNA, 21 nt, Artificial Sequence
  Synthetic
aauuccaggagguggggacug

SEQ ID NO: 6762 - RNA, 22 nt, Artificial Sequence
  Synthetic
gaauuccaggagguggggacug

SEQ ID NO: 6763 - RNA, 23 nt, Artificial Sequence
  Synthetic
agaauuccaggagguggggacug

SEQ ID NO: 6764 - RNA, 24 nt, Artificial Sequence
  Synthetic
gagaauuccaggagguggggacug

SEQ ID NO: 6765 - RNA, 18 nt, Artificial Sequence
  Synthetic
agguuuccucuccagcug

SEQ ID NO: 6766 - RNA, 19 nt, Artificial Sequence
  Synthetic
gagguuuccucuccagcug

SEQ ID NO: 6767 - RNA, 21 nt, Artificial Sequence
  Synthetic
cagagguuuccucuccagcug

SEQ ID NO: 6768 - RNA, 22 nt, Artificial Sequence
  Synthetic
gcagagguuuccucuccagcug

SEQ ID NO: 6769 - RNA, 23 nt, Artificial Sequence
  Synthetic
ggcagagguuuccucuccagcug

SEQ ID NO: 6770 - RNA, 24 nt, Artificial Sequence
  Synthetic
cggcagagguuuccucuccagcug

SEQ ID NO: 6771 - RNA, 18 nt, Artificial Sequence
  Synthetic
agucuaacggagaaucug

SEQ ID NO: 6772 - RNA, 19 nt, Artificial Sequence
  Synthetic
uagucuaacggagaaucug

SEQ ID NO: 6773 - RNA, 21 nt, Artificial Sequence
  Synthetic
acuagucuaacggagaaucug

SEQ ID NO: 6774 - RNA, 22 nt, Artificial Sequence
  Synthetic
aacuagucuaacggagaaucug

SEQ ID NO: 6775 - RNA, 23 nt, Artificial Sequence
  Synthetic
aaacuagucuaacggagaaucug

SEQ ID NO: 6776 - RNA, 24 nt, Artificial Sequence
  Synthetic
gaaacuagucuaacggagaaucug

SEQ ID NO: 6777 - RNA, 18 nt, Artificial Sequence
  Synthetic
gccaacuuaaacccagug

SEQ ID NO: 6778 - RNA, 19 nt, Artificial Sequence
  Synthetic
agccaacuuaaacccagug

SEQ ID NO: 6779 - RNA, 21 nt, Artificial Sequence
  Synthetic
ccagccaacuuaaacccagug

SEQ ID NO: 6780 - RNA, 22 nt, Artificial Sequence
  Synthetic
gccagccaacuuaaacccagug

SEQ ID NO: 6781 - RNA, 23 nt, Artificial Sequence
  Synthetic
agccagccaacuuaaacccagug

SEQ ID NO: 6782 - RNA, 24 nt, Artificial Sequence
  Synthetic
uagccagccaacuuaaacccagug

SEQ ID NO: 6783 - RNA, 18 nt, Artificial Sequence
  Synthetic
uuucucauggaagacgug

SEQ ID NO: 6784 - RNA, 19 nt, Artificial Sequence
  Synthetic
guuucucauggaagacgug

SEQ ID NO: 6785 - RNA, 21 nt, Artificial Sequence
  Synthetic
caguuucucauggaagacgug

SEQ ID NO: 6786 - RNA, 22 nt, Artificial Sequence
  Synthetic
acaguuucucauggaagacgug

SEQ ID NO: 6787 - RNA, 23 nt, Artificial Sequence
  Synthetic
gacaguuucucauggaagacgug

SEQ ID NO: 6788 - RNA, 24 nt, Artificial Sequence
  Synthetic
ugacaguuucucauggaagacgug

SEQ ID NO: 6789 - RNA, 18 nt, Artificial Sequence
  Synthetic
gcuggggcugagcgggug

SEQ ID NO: 6790 - RNA, 19 nt, Artificial Sequence
  Synthetic
cgcuggggcugagcgggug

SEQ ID NO: 6791 - RNA, 21 nt, Artificial Sequence
  Synthetic
gacgcuggggcugagcgggug

SEQ ID NO: 6792 - RNA, 22 nt, Artificial Sequence
  Synthetic
ggacgcuggggcugagcgggug

SEQ ID NO: 6793 - RNA, 23 nt, Artificial Sequence
  Synthetic
gggacgcuggggcugagcgggug

SEQ ID NO: 6794 - RNA, 24 nt, Artificial Sequence
  Synthetic
ggggacgcuggggcugagcgggug

SEQ ID NO: 6795 - RNA, 18 nt, Artificial Sequence
  Synthetic
acuagaaauauauccuug

SEQ ID NO: 6796 - RNA, 19 nt, Artificial Sequence
  Synthetic
aacuagaaauauauccuug

SEQ ID NO: 6797 - RNA, 21 nt, Artificial Sequence
  Synthetic
uaaacuagaaauauauccuug

SEQ ID NO: 6798 - RNA, 22 nt, Artificial Sequence
  Synthetic
auaaacuagaaauauauccuug

SEQ ID NO: 6799 - RNA, 23 nt, Artificial Sequence
  Synthetic
uauaaacuagaaauauauccuug

SEQ ID NO: 6800 - RNA, 24 nt, Artificial Sequence
  Synthetic
auauaaacuagaaauauauccuug

SEQ ID NO: 6801 - RNA, 18 nt, Artificial Sequence
  Synthetic
uuaucuuuucucugcuug

SEQ ID NO: 6802 - RNA, 19 nt, Artificial Sequence
  Synthetic
uuuaucuuuucucugcuug

SEQ ID NO: 6803 - RNA, 21 nt, Artificial Sequence
  Synthetic
uuuuuaucuuuucucugcuug

SEQ ID NO: 6804 - RNA, 22 nt, Artificial Sequence
  Synthetic
cuuuuuaucuuuucucugcuug

SEQ ID NO: 6805 - RNA, 23 nt, Artificial Sequence
  Synthetic
ccuuuuuaucuuuucucugcuug

SEQ ID NO: 6806 - RNA, 24 nt, Artificial Sequence
  Synthetic
gccuuuuuaucuuuucucugcuug

SEQ ID NO: 6807 - RNA, 18 nt, Artificial Sequence
  Synthetic
acuagucuaacggagaau

SEQ ID NO: 6808 - RNA, 19 nt, Artificial Sequence
  Synthetic
aacuagucuaacggagaau

SEQ ID NO: 6809 - RNA, 21 nt, Artificial Sequence
  Synthetic
gaaacuagucuaacggagaau

SEQ ID NO: 6810 - RNA, 22 nt, Artificial Sequence
  Synthetic
ggaaacuagucuaacggagaau

SEQ ID NO: 6811 - RNA, 23 nt, Artificial Sequence
  Synthetic
gggaaacuagucuaacggagaau

SEQ ID NO: 6812 - RNA, 24 nt, Artificial Sequence
  Synthetic
agggaaacuagucuaacggagaau

SEQ ID NO: 6813 - RNA, 18 nt, Artificial Sequence
  Synthetic
ugaaucguccuggugcau

SEQ ID NO: 6814 - RNA, 19 nt, Artificial Sequence
  Synthetic
gugaaucguccuggugcau

SEQ ID NO: 6815 - RNA, 21 nt, Artificial Sequence
  Synthetic
ccgugaaucguccuggugcau

SEQ ID NO: 6816 - RNA, 22 nt, Artificial Sequence
  Synthetic
cccgugaaucguccuggugcau

SEQ ID NO: 6817 - RNA, 23 nt, Artificial Sequence
  Synthetic
ucccgugaaucguccuggugcau

SEQ ID NO: 6818 - RNA, 24 nt, Artificial Sequence
  Synthetic
uucccgugaaucguccuggugcau

SEQ ID NO: 6819 - RNA, 18 nt, Artificial Sequence
  Synthetic
uuuauuuaaugggaauau

SEQ ID NO: 6820 - RNA, 19 nt, Artificial Sequence
  Synthetic
cuuuauuuaaugggaauau

SEQ ID NO: 6821 - RNA, 21 nt, Artificial Sequence
  Synthetic
gccuuuauuuaaugggaauau

SEQ ID NO: 6822 - RNA, 22 nt, Artificial Sequence
  Synthetic
ggccuuuauuuaaugggaauau

SEQ ID NO: 6823 - RNA, 23 nt, Artificial Sequence
  Synthetic
aggccuuuauuuaaugggaauau

SEQ ID NO: 6824 - RNA, 24 nt, Artificial Sequence
  Synthetic
aaggccuuuauuuaaugggaauau

SEQ ID NO: 6825 - RNA, 18 nt, Artificial Sequence
  Synthetic
aaaaccagguggagauau

SEQ ID NO: 6826 - RNA, 19 nt, Artificial Sequence
  Synthetic
uaaaaccagguggagauau

SEQ ID NO: 6827 - RNA, 21 nt, Artificial Sequence
  Synthetic
uguaaaaccagguggagauau

SEQ ID NO: 6828 - RNA, 22 nt, Artificial Sequence
  Synthetic
guguaaaaccagguggagauau

SEQ ID NO: 6829 - RNA, 23 nt, Artificial Sequence
  Synthetic
uguguaaaaccagguggagauau

SEQ ID NO: 6830 - RNA, 24 nt, Artificial Sequence
  Synthetic
guguguaaaaccagguggagauau

SEQ ID NO: 6831 - RNA, 18 nt, Artificial Sequence
  Synthetic
aguuuuccguugcuuccu

SEQ ID NO: 6832 - RNA, 19 nt, Artificial Sequence
  Synthetic
gaguuuuccguugcuuccu

SEQ ID NO: 6833 - RNA, 21 nt, Artificial Sequence
  Synthetic
gggaguuuuccguugcuuccu

SEQ ID NO: 6834 - RNA, 22 nt, Artificial Sequence
  Synthetic
ugggaguuuuccguugcuuccu

SEQ ID NO: 6835 - RNA, 23 nt, Artificial Sequence
  Synthetic
cugggaguuuuccguugcuuccu

SEQ ID NO: 6836 - RNA, 24 nt, Artificial Sequence
  Synthetic
gcugggaguuuuccguugcuuccu

SEQ ID NO: 6837 - RNA, 18 nt, Artificial Sequence
  Synthetic
gaggggacaguguuuccu

SEQ ID NO: 6838 - RNA, 19 nt, Artificial Sequence
  Synthetic
ggaggggacaguguuuccu

SEQ ID NO: 6839 - RNA, 21 nt, Artificial Sequence
  Synthetic
cuggaggggacaguguuuccu

SEQ ID NO: 6840 - RNA, 22 nt, Artificial Sequence
  Synthetic
ucuggaggggacaguguuuccu

SEQ ID NO: 6841 - RNA, 23 nt, Artificial Sequence
  Synthetic
aucuggaggggacaguguuuccu

SEQ ID NO: 6842 - RNA, 24 nt, Artificial Sequence
  Synthetic
aaucuggaggggacaguguuuccu

SEQ ID NO: 6843 - RNA, 18 nt, Artificial Sequence
  Synthetic
gagguuuccucuccagcu

SEQ ID NO: 6844 - RNA, 19 nt, Artificial Sequence
  Synthetic
agagguuuccucuccagcu

SEQ ID NO: 6845 - RNA, 21 nt, Artificial Sequence
  Synthetic
gcagagguuuccucuccagcu

SEQ ID NO: 6846 - RNA, 22 nt, Artificial Sequence
  Synthetic
ggcagagguuuccucuccagcu

SEQ ID NO: 6847 - RNA, 23 nt, Artificial Sequence
  Synthetic
cggcagagguuuccucuccagcu

SEQ ID NO: 6848 - RNA, 24 nt, Artificial Sequence
  Synthetic
ccggcagagguuuccucuccagcu

SEQ ID NO: 6849 - RNA, 18 nt, Artificial Sequence
  Synthetic
uuuuaucuuuucucugcu

SEQ ID NO: 6850 - RNA, 19 nt, Artificial Sequence
  Synthetic
uuuuuaucuuuucucugcu

SEQ ID NO: 6851 - RNA, 21 nt, Artificial Sequence
  Synthetic
ccuuuuuaucuuuucucugcu

SEQ ID NO: 6852 - RNA, 22 nt, Artificial Sequence
  Synthetic
gccuuuuuaucuuuucucugcu

SEQ ID NO: 6853 - RNA, 23 nt, Artificial Sequence
  Synthetic
agccuuuuuaucuuuucucugcu

SEQ ID NO: 6854 - RNA, 24 nt, Artificial Sequence
  Synthetic
gagccuuuuuaucuuuucucugcu

SEQ ID NO: 6855 - RNA, 18 nt, Artificial Sequence
  Synthetic
caguauauauaaaccucu

SEQ ID NO: 6856 - RNA, 19 nt, Artificial Sequence
  Synthetic
ccaguauauauaaaccucu

SEQ ID NO: 6857 - RNA, 21 nt, Artificial Sequence
  Synthetic
ccccaguauauauaaaccucu

SEQ ID NO: 6858 - RNA, 22 nt, Artificial Sequence
  Synthetic
uccccaguauauauaaaccucu

SEQ ID NO: 6859 - RNA, 23 nt, Artificial Sequence
  Synthetic
cuccccaguauauauaaaccucu

SEQ ID NO: 6860 - RNA, 24 nt, Artificial Sequence
  Synthetic
gcuccccaguauauauaaaccucu

SEQ ID NO: 6861 - RNA, 18 nt, Artificial Sequence
  Synthetic
guuuuguuaucacucucu

SEQ ID NO: 6862 - RNA, 19 nt, Artificial Sequence
  Synthetic
uguuuuguuaucacucucu

SEQ ID NO: 6863 - RNA, 21 nt, Artificial Sequence
  Synthetic
guuguuuuguuaucacucucu

SEQ ID NO: 6864 - RNA, 22 nt, Artificial Sequence
  Synthetic
gguuguuuuguuaucacucucu

SEQ ID NO: 6865 - RNA, 23 nt, Artificial Sequence
  Synthetic
ugguuguuuuguuaucacucucu

SEQ ID NO: 6866 - RNA, 24 nt, Artificial Sequence
  Synthetic
cugguuguuuuguuaucacucucu

SEQ ID NO: 6867 - RNA, 18 nt, Artificial Sequence
  Synthetic
guggggacugcagggagu

SEQ ID NO: 6868 - RNA, 19 nt, Artificial Sequence
  Synthetic
gguggggacugcagggagu

SEQ ID NO: 6869 - RNA, 21 nt, Artificial Sequence
  Synthetic
gagguggggacugcagggagu

SEQ ID NO: 6870 - RNA, 22 nt, Artificial Sequence
  Synthetic
ggagguggggacugcagggagu

SEQ ID NO: 6871 - RNA, 23 nt, Artificial Sequence
  Synthetic
aggagguggggacugcagggagu

SEQ ID NO: 6872 - RNA, 24 nt, Artificial Sequence
  Synthetic
caggagguggggacugcagggagu

SEQ ID NO: 6873 - RNA, 18 nt, Artificial Sequence
  Synthetic
aggagaauuccaggaggu

SEQ ID NO: 6874 - RNA, 19 nt, Artificial Sequence
  Synthetic
caggagaauuccaggaggu

SEQ ID NO: 6875 - RNA, 21 nt, Artificial Sequence
  Synthetic
uccaggagaauuccaggaggu

SEQ ID NO: 6876 - RNA, 22 nt, Artificial Sequence
  Synthetic
guccaggagaauuccaggaggu

SEQ ID NO: 6877 - RNA, 23 nt, Artificial Sequence
  Synthetic
cguccaggagaauuccaggaggu

SEQ ID NO: 6878 - RNA, 24 nt, Artificial Sequence
  Synthetic
acguccaggagaauuccaggaggu

SEQ ID NO: 6879 - RNA, 18 nt, Artificial Sequence
  Synthetic
gaaacuccaaacagacuu

SEQ ID NO: 6880 - RNA, 19 nt, Artificial Sequence
  Synthetic
agaaacuccaaacagacuu

SEQ ID NO: 6881 - RNA, 21 nt, Artificial Sequence
  Synthetic
aaagaaacuccaaacagacuu

SEQ ID NO: 6882 - RNA, 22 nt, Artificial Sequence
  Synthetic
aaaagaaacuccaaacagacuu

SEQ ID NO: 6883 - RNA, 23 nt, Artificial Sequence
  Synthetic
aaaaagaaacuccaaacagacuu

SEQ ID NO: 6884 - RNA, 24 nt, Artificial Sequence
  Synthetic
uaaaaagaaacuccaaacagacuu

SEQ ID NO: 6885 - RNA, 18 nt, Artificial Sequence
  Synthetic
ucuuuucuuucaugucuu

SEQ ID NO: 6886 - RNA, 19 nt, Artificial Sequence
  Synthetic
gucuuuucuuucaugucuu

SEQ ID NO: 6887 - RNA, 21 nt, Artificial Sequence
  Synthetic
gagucuuuucuuucaugucuu

SEQ ID NO: 6888 - RNA, 22 nt, Artificial Sequence
  Synthetic
ggagucuuuucuuucaugucuu

SEQ ID NO: 6889 - RNA, 23 nt, Artificial Sequence
  Synthetic
uggagucuuuucuuucaugucuu

SEQ ID NO: 6890 - RNA, 24 nt, Artificial Sequence
  Synthetic
cuggagucuuuucuuucaugucuu

SEQ ID NO: 6891 - RNA, 18 nt, Artificial Sequence
  Synthetic
gcagaaccagaaagaaaa

SEQ ID NO: 6892 - RNA, 19 nt, Artificial Sequence
  Synthetic
ggcagaaccagaaagaaaa

SEQ ID NO: 6893 - RNA, 22 nt, Artificial Sequence
  Synthetic
guuuucuuccuguuaaaagaaa

SEQ ID NO: 6894 - RNA, 18 nt, Artificial Sequence
  Synthetic
gcuaacuccacagagaaa

SEQ ID NO: 6895 - RNA, 21 nt, Artificial Sequence
  Synthetic
gcugcuaacuccacagagaaa

SEQ ID NO: 6896 - RNA, 23 nt, Artificial Sequence
  Synthetic
gugcugcuaacuccacagagaaa

SEQ ID NO: 6897 - RNA, 19 nt, Artificial Sequence
  Synthetic
gaacuugagacauuuacaa

SEQ ID NO: 6898 - RNA, 23 nt, Artificial Sequence
  Synthetic
gccugaacuugagacauuuacaa

SEQ ID NO: 6899 - RNA, 22 nt, Artificial Sequence
  Synthetic
gaguuuauggcucuauucgcaa

SEQ ID NO: 6900 - RNA, 19 nt, Artificial Sequence
  Synthetic
guuuguuuacagcugacca

SEQ ID NO: 6901 - RNA, 21 nt, Artificial Sequence
  Synthetic
guguuuguuuacagcugacca

SEQ ID NO: 6902 - RNA, 22 nt, Artificial Sequence
  Synthetic
gguguuuguuuacagcugacca

SEQ ID NO: 6903 - RNA, 23 nt, Artificial Sequence
  Synthetic
ggguguuuguuuacagcugacca

SEQ ID NO: 6904 - RNA, 21 nt, Artificial Sequence
  Synthetic
gucaauucccacugcccuuga

SEQ ID NO: 6905 - RNA, 22 nt, Artificial Sequence
  Synthetic
ggucaauucccacugcccuuga

SEQ ID NO: 6906 - RNA, 24 nt, Artificial Sequence
  Synthetic
guggucaauucccacugcccuuga

SEQ ID NO: 6907 - RNA, 18 nt, Artificial Sequence
  Synthetic
gcccugccuccuagaacc

SEQ ID NO: 6908 - RNA, 18 nt, Artificial Sequence
  Synthetic
ggucaauucccacugccc

SEQ ID NO: 6909 - RNA, 19 nt, Artificial Sequence
  Synthetic
gcauuguggcucucggucc

SEQ ID NO: 6910 - RNA, 22 nt, Artificial Sequence
  Synthetic
gaagcauuguggcucucggucc

SEQ ID NO: 6911 - RNA, 22 nt, Artificial Sequence
  Synthetic
guucacagaacacgagagcugc

SEQ ID NO: 6912 - RNA, 24 nt, Artificial Sequence
  Synthetic
guguucacagaacacgagagcugc

SEQ ID NO: 6913 - RNA, 19 nt, Artificial Sequence
  Synthetic
gcccuggcagacucaccuc

SEQ ID NO: 6914 - RNA, 24 nt, Artificial Sequence
  Synthetic
gucagcagucacugcugagcugcg

SEQ ID NO: 6915 - RNA, 18 nt, Artificial Sequence
  Synthetic
gccaaguccaccacaggg

SEQ ID NO: 6916 - RNA, 24 nt, Artificial Sequence
  Synthetic
gcauaagccaaguccaccacaggg

SEQ ID NO: 6917 - RNA, 18 nt, Artificial Sequence
  Synthetic
ggaaggaaaauguggcug

SEQ ID NO: 6918 - RNA, 19 nt, Artificial Sequence
  Synthetic
gggaaggaaaauguggcug

SEQ ID NO: 6919 - RNA, 24 nt, Artificial Sequence
  Synthetic
gcuuagggaaggaaaauguggcug

SEQ ID NO: 6920 - RNA, 20 nt, Artificial Sequence
  Synthetic
gccauaucaccugcugaacu

SEQ ID NO: 6921 - RNA, 22 nt, Artificial Sequence
  Synthetic
gagccauaucaccugcugaacu

SEQ ID NO: 6922 - RNA, 18 nt, Artificial Sequence
  Synthetic
gguacuguuauuaccacu

SEQ ID NO: 6923 - RNA, 21 nt, Artificial Sequence
  Synthetic
guuacuaccuugugacuugcu

SEQ ID NO: 6924 - RNA, 18 nt, Artificial Sequence
  Synthetic
gcugcguggggugcuggu

SEQ ID NO: 6925 - RNA, 23 nt, Artificial Sequence
  Synthetic
gcugagcugcguggggugcuggu

SEQ ID NO: 6926 - RNA, 22 nt, Artificial Sequence
  Synthetic
gaaucuguuuggcuuuacucuu

SEQ ID NO: 6927 - RNA, 19 nt, Artificial Sequence
  Synthetic
gucuaauuucaaaguaguu

SEQ ID NO: 6928 - RNA, 22 nt, Artificial Sequence
  Synthetic
gaggucuaauuucaaaguaguu

SEQ ID NO: 6929 - RNA, 23 nt, Artificial Sequence
  Synthetic
ggaggucuaauuucaaaguaguu

SEQ ID NO: 6930 - RNA, 18 nt, Artificial Sequence
  Synthetic
ggguacuagucucauuuu

SEQ ID NO: 6931 - RNA, 19 nt, Artificial Sequence
  Synthetic
gcauuugccaauaaccaaa

SEQ ID NO: 6932 - RNA, 18 nt, Artificial Sequence
  Synthetic
gaaccaaucaaauaagaa

SEQ ID NO: 6933 - RNA, 21 nt, Artificial Sequence
  Synthetic
gcagaaccaaucaaauaagaa

SEQ ID NO: 6934 - RNA, 21 nt, Artificial Sequence
  Synthetic
gguucuuggcaugcacacaca

SEQ ID NO: 6935 - RNA, 23 nt, Artificial Sequence
  Synthetic
gagguucuuggcaugcacacaca

SEQ ID NO: 6936 - RNA, 19 nt, Artificial Sequence
  Synthetic
gcagugacugcugacagca

SEQ ID NO: 6937 - RNA, 24 nt, Artificial Sequence
  Synthetic
gcucagcagugacugcugacagca

SEQ ID NO: 6938 - RNA, 21 nt, Artificial Sequence
  Synthetic
gcaaaaggagaaauaaaagga

SEQ ID NO: 6939 - RNA, 18 nt, Artificial Sequence
  Synthetic
gcagugggaauugaccac

SEQ ID NO: 6940 - RNA, 19 nt, Artificial Sequence
  Synthetic
ggcagugggaauugaccac

SEQ ID NO: 6941 - RNA, 18 nt, Artificial Sequence
  Synthetic
gguuuauuaauguaaagc

SEQ ID NO: 6942 - RNA, 19 nt, Artificial Sequence
  Synthetic
ggguuuauuaauguaaagc

SEQ ID NO: 6943 - RNA, 19 nt, Artificial Sequence
  Synthetic
gauuauaguccacgugauc

SEQ ID NO: 6944 - RNA, 21 nt, Artificial Sequence
  Synthetic
gggauuauaguccacgugauc

SEQ ID NO: 6945 - RNA, 21 nt, Artificial Sequence
  Synthetic
ggacaggaaggcaggcagaag

SEQ ID NO: 6946 - RNA, 22 nt, Artificial Sequence
  Synthetic
gggacaggaaggcaggcagaag

SEQ ID NO: 6947 - RNA, 23 nt, Artificial Sequence
  Synthetic
ggggacaggaaggcaggcagaag

SEQ ID NO: 6948 - RNA, 24 nt, Artificial Sequence
  Synthetic
gggggacaggaaggcaggcagaag

SEQ ID NO: 6949 - RNA, 20 nt, Artificial Sequence
  Synthetic
gcacagcuagcacaagacag

SEQ ID NO: 6950 - RNA, 24 nt, Artificial Sequence
  Synthetic
gacugcacagcuagcacaagacag

SEQ ID NO: 6951 - RNA, 18 nt, Artificial Sequence
  Synthetic
ggaggagaagaaaaagag

SEQ ID NO: 6952 - RNA, 19 nt, Artificial Sequence
  Synthetic
gggaggagaagaaaaagag

SEQ ID NO: 6953 - RNA, 23 nt, Artificial Sequence
  Synthetic
gcaggggaggagaagaaaaagag

SEQ ID NO: 6954 - RNA, 19 nt, Artificial Sequence
  Synthetic
guguuucuccacucuggag

SEQ ID NO: 6955 - RNA, 18 nt, Artificial Sequence
  Synthetic
gcucucccuggagccugg

SEQ ID NO: 6956 - RNA, 22 nt, Artificial Sequence
  Synthetic
gaaugcucucccuggagccugg

SEQ ID NO: 6957 - RNA, 23 nt, Artificial Sequence
  Synthetic
ggaaugcucucccuggagccugg

SEQ ID NO: 6958 - RNA, 24 nt, Artificial Sequence
  Synthetic
gcuuaacugcagaaccaaucaaau

SEQ ID NO: 6959 - RNA, 19 nt, Artificial Sequence
  Synthetic
guccagaaagccugugaau

SEQ ID NO: 6960 - RNA, 18 nt, Artificial Sequence
  Synthetic
gaaaucugccgcuucuau

SEQ ID NO: 6961 - RNA, 19 nt, Artificial Sequence
  Synthetic
ggaaaucugccgcuucuau

SEQ ID NO: 6962 - RNA, 21 nt, Artificial Sequence
  Synthetic
ggggaaaucugccgcuucuau

SEQ ID NO: 6963 - RNA, 22 nt, Artificial Sequence
  Synthetic
gggggaaaucugccgcuucuau

SEQ ID NO: 6964 - RNA, 23 nt, Artificial Sequence
  Synthetic
ggggggaaaucugccgcuucuau

SEQ ID NO: 6965 - RNA, 19 nt, Artificial Sequence
  Synthetic
gcaagacggucgaaaaccu

SEQ ID NO: 6966 - RNA, 22 nt, Artificial Sequence
  Synthetic
gauacacaguuguuuuaaagcu

SEQ ID NO: 6967 - RNA, 18 nt, Artificial Sequence
  Synthetic
gcuuuuuguuuuuucucu

SEQ ID NO: 6968 - RNA, 18 nt, Artificial Sequence
  Synthetic
gauucauucaagggcagu

SEQ ID NO: 6969 - RNA, 22 nt, Artificial Sequence
  Synthetic
gacagauucauucaagggcagu

SEQ ID NO: 6970 - RNA, 21 nt, Artificial Sequence
  Synthetic
gcuucauuuagauuagugguu

SEQ ID NO: 6971 - RNA, 23 nt, Artificial Sequence
  Synthetic
gagcuucauuuagauuagugguu

SEQ ID NO: 6972 - RNA, 18 nt, Artificial Sequence
  Synthetic
cugagcaaagguucaaaa

SEQ ID NO: 6973 - RNA, 19 nt, Artificial Sequence
  Synthetic
ucugagcaaagguucaaaa

SEQ ID NO: 6974 - RNA, 20 nt, Artificial Sequence
  Synthetic
aucugagcaaagguucaaaa

SEQ ID NO: 6975 - RNA, 21 nt, Artificial Sequence
  Synthetic
aaucugagcaaagguucaaaa

SEQ ID NO: 6976 - RNA, 22 nt, Artificial Sequence
  Synthetic
caaucugagcaaagguucaaaa

SEQ ID NO: 6977 - RNA, 23 nt, Artificial Sequence
  Synthetic
acaaucugagcaaagguucaaaa

SEQ ID NO: 6978 - RNA, 24 nt, Artificial Sequence
  Synthetic
aacaaucugagcaaagguucaaaa

SEQ ID NO: 6979 - RNA, 21 nt, Artificial Sequence
  Synthetic
auggcagaaccagaaagaaaa

SEQ ID NO: 6980 - RNA, 22 nt, Artificial Sequence
  Synthetic
aauggcagaaccagaaagaaaa

SEQ ID NO: 6981 - RNA, 23 nt, Artificial Sequence
  Synthetic
caauggcagaaccagaaagaaaa

SEQ ID NO: 6982 - RNA, 24 nt, Artificial Sequence
  Synthetic
ccaauggcagaaccagaaagaaaa

SEQ ID NO: 6983 - RNA, 18 nt, Artificial Sequence
  Synthetic
ucuuccuguuaaaagaaa

SEQ ID NO: 6984 - RNA, 19 nt, Artificial Sequence
  Synthetic
uucuuccuguuaaaagaaa

SEQ ID NO: 6985 - RNA, 21 nt, Artificial Sequence
  Synthetic
uuuucuuccuguuaaaagaaa

SEQ ID NO: 6986 - RNA, 23 nt, Artificial Sequence
  Synthetic
uguuuucuuccuguuaaaagaaa

SEQ ID NO: 6987 - RNA, 24 nt, Artificial Sequence
  Synthetic
auguuuucuuccuguuaaaagaaa

SEQ ID NO: 6988 - RNA, 19 nt, Artificial Sequence
  Synthetic
ugcuaacuccacagagaaa

SEQ ID NO: 6989 - RNA, 22 nt, Artificial Sequence
  Synthetic
ugcugcuaacuccacagagaaa

SEQ ID NO: 6990 - RNA, 24 nt, Artificial Sequence
  Synthetic
ugugcugcuaacuccacagagaaa

SEQ ID NO: 6991 - RNA, 18 nt, Artificial Sequence
  Synthetic
aacuugagacauuuacaa

SEQ ID NO: 6992 - RNA, 21 nt, Artificial Sequence
  Synthetic
cugaacuugagacauuuacaa

SEQ ID NO: 6993 - RNA, 22 nt, Artificial Sequence
  Synthetic
ccugaacuugagacauuuacaa

SEQ ID NO: 6994 - RNA, 24 nt, Artificial Sequence
  Synthetic
agccugaacuugagacauuuacaa

SEQ ID NO: 6995 - RNA, 18 nt, Artificial Sequence
  Synthetic
uuauggcucuauucgcaa

SEQ ID NO: 6996 - RNA, 19 nt, Artificial Sequence
  Synthetic
uuuauggcucuauucgcaa

SEQ ID NO: 6997 - RNA, 21 nt, Artificial Sequence
  Synthetic
aguuuauggcucuauucgcaa

SEQ ID NO: 6998 - RNA, 23 nt, Artificial Sequence
  Synthetic
ugaguuuauggcucuauucgcaa

SEQ ID NO: 6999 - RNA, 24 nt, Artificial Sequence
  Synthetic
uugaguuuauggcucuauucgcaa

SEQ ID NO: 7000 - RNA, 18 nt, Artificial Sequence
  Synthetic
ucaacauccccccucaca

SEQ ID NO: 7001 - RNA, 19 nt, Artificial Sequence
  Synthetic
cucaacauccccccucaca

SEQ ID NO: 7002 - RNA, 21 nt, Artificial Sequence
  Synthetic
cucucaacauccccccucaca

SEQ ID NO: 7003 - RNA, 22 nt, Artificial Sequence
  Synthetic
ccucucaacauccccccucaca

SEQ ID NO: 7004 - RNA, 23 nt, Artificial Sequence
  Synthetic
cccucucaacauccccccucaca

SEQ ID NO: 7005 - RNA, 24 nt, Artificial Sequence
  Synthetic
ccccucucaacauccccccucaca

SEQ ID NO: 7006 - RNA, 18 nt, Artificial Sequence
  Synthetic
uuuguuuacagcugacca

SEQ ID NO: 7007 - RNA, 24 nt, Artificial Sequence
  Synthetic
uggguguuuguuuacagcugacca

SEQ ID NO: 7008 - RNA, 18 nt, Artificial Sequence
  Synthetic
aauucccacugcccuuga

SEQ ID NO: 7009 - RNA, 19 nt, Artificial Sequence
  Synthetic
caauucccacugcccuuga

SEQ ID NO: 7010 - RNA, 23 nt, Artificial Sequence
  Synthetic
uggucaauucccacugcccuuga

SEQ ID NO: 7011 - RNA, 19 nt, Artificial Sequence
  Synthetic
agcccugccuccuagaacc

SEQ ID NO: 7012 - RNA, 21 nt, Artificial Sequence
  Synthetic
auagcccugccuccuagaacc

SEQ ID NO: 7013 - RNA, 22 nt, Artificial Sequence
  Synthetic
uauagcccugccuccuagaacc

SEQ ID NO: 7014 - RNA, 23 nt, Artificial Sequence
  Synthetic
auauagcccugccuccuagaacc

SEQ ID NO: 7015 - RNA, 24 nt, Artificial Sequence
  Synthetic
aauauagcccugccuccuagaacc

SEQ ID NO: 7016 - RNA, 19 nt, Artificial Sequence
  Synthetic
uggucaauucccacugccc

SEQ ID NO: 7017 - RNA, 21 nt, Artificial Sequence
  Synthetic
uguggucaauucccacugccc

SEQ ID NO: 7018 - RNA, 22 nt, Artificial Sequence
  Synthetic
cuguggucaauucccacugccc

SEQ ID NO: 7019 - RNA, 23 nt, Artificial Sequence
  Synthetic
ccuguggucaauucccacugccc

SEQ ID NO: 7020 - RNA, 24 nt, Artificial Sequence
  Synthetic
cccuguggucaauucccacugccc

SEQ ID NO: 7021 - RNA, 18 nt, Artificial Sequence
  Synthetic
cauuguggcucucggucc

SEQ ID NO: 7022 - RNA, 21 nt, Artificial Sequence
  Synthetic
aagcauuguggcucucggucc

SEQ ID NO: 7023 - RNA, 23 nt, Artificial Sequence
  Synthetic
ugaagcauuguggcucucggucc

SEQ ID NO: 7024 - RNA, 24 nt, Artificial Sequence
  Synthetic
cugaagcauuguggcucucggucc

SEQ ID NO: 7025 - RNA, 18 nt, Artificial Sequence
  Synthetic
agucagcaagaccuaggc

SEQ ID NO: 7026 - RNA, 19 nt, Artificial Sequence
  Synthetic
uagucagcaagaccuaggc

SEQ ID NO: 7027 - RNA, 21 nt, Artificial Sequence
  Synthetic
uauagucagcaagaccuaggc

SEQ ID NO: 7028 - RNA, 22 nt, Artificial Sequence
  Synthetic
auauagucagcaagaccuaggc

SEQ ID NO: 7029 - RNA, 23 nt, Artificial Sequence
  Synthetic
cauauagucagcaagaccuaggc

SEQ ID NO: 7030 - RNA, 24 nt, Artificial Sequence
  Synthetic
ucauauagucagcaagaccuaggc

SEQ ID NO: 7031 - RNA, 18 nt, Artificial Sequence
  Synthetic
acagaacacgagagcugc

SEQ ID NO: 7032 - RNA, 19 nt, Artificial Sequence
  Synthetic
cacagaacacgagagcugc

SEQ ID NO: 7033 - RNA, 21 nt, Artificial Sequence
  Synthetic
uucacagaacacgagagcugc

SEQ ID NO: 7034 - RNA, 23 nt, Artificial Sequence
  Synthetic
uguucacagaacacgagagcugc

SEQ ID NO: 7035 - RNA, 18 nt, Artificial Sequence
  Synthetic
cccuggcagacucaccuc

SEQ ID NO: 7036 - RNA, 21 nt, Artificial Sequence
  Synthetic
cugcccuggcagacucaccuc

SEQ ID NO: 7037 - RNA, 22 nt, Artificial Sequence
  Synthetic
acugcccuggcagacucaccuc

SEQ ID NO: 7038 - RNA, 23 nt, Artificial Sequence
  Synthetic
aacugcccuggcagacucaccuc

SEQ ID NO: 7039 - RNA, 24 nt, Artificial Sequence
  Synthetic
aaacugcccuggcagacucaccuc

SEQ ID NO: 7040 - RNA, 18 nt, Artificial Sequence
  Synthetic
agucacugcugagcugcg

SEQ ID NO: 7041 - RNA, 19 nt, Artificial Sequence
  Synthetic
cagucacugcugagcugcg

SEQ ID NO: 7042 - RNA, 21 nt, Artificial Sequence
  Synthetic
agcagucacugcugagcugcg

SEQ ID NO: 7043 - RNA, 22 nt, Artificial Sequence
  Synthetic
cagcagucacugcugagcugcg

SEQ ID NO: 7044 - RNA, 23 nt, Artificial Sequence
  Synthetic
ucagcagucacugcugagcugcg

SEQ ID NO: 7045 - RNA, 19 nt, Artificial Sequence
  Synthetic
agccaaguccaccacaggg

SEQ ID NO: 7046 - RNA, 21 nt, Artificial Sequence
  Synthetic
uaagccaaguccaccacaggg

SEQ ID NO: 7047 - RNA, 22 nt, Artificial Sequence
  Synthetic
auaagccaaguccaccacaggg

SEQ ID NO: 7048 - RNA, 23 nt, Artificial Sequence
  Synthetic
cauaagccaaguccaccacaggg

SEQ ID NO: 7049 - RNA, 21 nt, Artificial Sequence
  Synthetic
uagggaaggaaaauguggcug

SEQ ID NO: 7050 - RNA, 22 nt, Artificial Sequence
  Synthetic
uuagggaaggaaaauguggcug

SEQ ID NO: 7051 - RNA, 23 nt, Artificial Sequence
  Synthetic
cuuagggaaggaaaauguggcug

SEQ ID NO: 7052 - RNA, 18 nt, Artificial Sequence
  Synthetic
cauaucaccugcugaacu

SEQ ID NO: 7053 - RNA, 19 nt, Artificial Sequence
  Synthetic
ccauaucaccugcugaacu

SEQ ID NO: 7054 - RNA, 21 nt, Artificial Sequence
  Synthetic
agccauaucaccugcugaacu

SEQ ID NO: 7055 - RNA, 23 nt, Artificial Sequence
  Synthetic
cgagccauaucaccugcugaacu

SEQ ID NO: 7056 - RNA, 24 nt, Artificial Sequence
  Synthetic
acgagccauaucaccugcugaacu

SEQ ID NO: 7057 - RNA, 19 nt, Artificial Sequence
  Synthetic
agguacuguuauuaccacu

SEQ ID NO: 7058 - RNA, 21 nt, Artificial Sequence
  Synthetic
acagguacuguuauuaccacu

SEQ ID NO: 7059 - RNA, 22 nt, Artificial Sequence
  Synthetic
cacagguacuguuauuaccacu

SEQ ID NO: 7060 - RNA, 23 nt, Artificial Sequence
  Synthetic
ucacagguacuguuauuaccacu

SEQ ID NO: 7061 - RNA, 24 nt, Artificial Sequence
  Synthetic
aucacagguacuguuauuaccacu

SEQ ID NO: 7062 - RNA, 18 nt, Artificial Sequence
  Synthetic
acuaccuugugacuugcu

SEQ ID NO: 7063 - RNA, 19 nt, Artificial Sequence
  Synthetic
uacuaccuugugacuugcu

SEQ ID NO: 7064 - RNA, 22 nt, Artificial Sequence
  Synthetic
aguuacuaccuugugacuugcu

SEQ ID NO: 7065 - RNA, 23 nt, Artificial Sequence
  Synthetic
caguuacuaccuugugacuugcu

SEQ ID NO: 7066 - RNA, 24 nt, Artificial Sequence
  Synthetic
ucaguuacuaccuugugacuugcu

SEQ ID NO: 7067 - RNA, 19 nt, Artificial Sequence
  Synthetic
agcugcguggggugcuggu

SEQ ID NO: 7068 - RNA, 21 nt, Artificial Sequence
  Synthetic
ugagcugcguggggugcuggu

SEQ ID NO: 7069 - RNA, 22 nt, Artificial Sequence
  Synthetic
cugagcugcguggggugcuggu

SEQ ID NO: 7070 - RNA, 24 nt, Artificial Sequence
  Synthetic
ugcugagcugcguggggugcuggu

SEQ ID NO: 7071 - RNA, 18 nt, Artificial Sequence
  Synthetic
cuguuuggcuuuacucuu

SEQ ID NO: 7072 - RNA, 19 nt, Artificial Sequence
  Synthetic
ucuguuuggcuuuacucuu

SEQ ID NO: 7073 - RNA, 21 nt, Artificial Sequence
  Synthetic
aaucuguuuggcuuuacucuu

SEQ ID NO: 7074 - RNA, 23 nt, Artificial Sequence
  Synthetic
ugaaucuguuuggcuuuacucuu

SEQ ID NO: 7075 - RNA, 24 nt, Artificial Sequence
  Synthetic
uugaaucuguuuggcuuuacucuu

SEQ ID NO: 7076 - RNA, 18 nt, Artificial Sequence
  Synthetic
ucuaauuucaaaguaguu

SEQ ID NO: 7077 - RNA, 21 nt, Artificial Sequence
  Synthetic
aggucuaauuucaaaguaguu

SEQ ID NO: 7078 - RNA, 24 nt, Artificial Sequence
  Synthetic
aggaggucuaauuucaaaguaguu

SEQ ID NO: 7079 - RNA, 18 nt, Artificial Sequence
  Synthetic
cuugcucuggcccaguuu

SEQ ID NO: 7080 - RNA, 19 nt, Artificial Sequence
  Synthetic
acuugcucuggcccaguuu

SEQ ID NO: 7081 - RNA, 21 nt, Artificial Sequence
  Synthetic
ccacuugcucuggcccaguuu

SEQ ID NO: 7082 - RNA, 22 nt, Artificial Sequence
  Synthetic
uccacuugcucuggcccaguuu

SEQ ID NO: 7083 - RNA, 23 nt, Artificial Sequence
  Synthetic
uuccacuugcucuggcccaguuu

SEQ ID NO: 7084 - RNA, 24 nt, Artificial Sequence
  Synthetic
uuuccacuugcucuggcccaguuu

SEQ ID NO: 7085 - RNA, 19 nt, Artificial Sequence
  Synthetic
aggguacuagucucauuuu

SEQ ID NO: 7086 - RNA, 21 nt, Artificial Sequence
  Synthetic
aaaggguacuagucucauuuu

SEQ ID NO: 7087 - RNA, 22 nt, Artificial Sequence
  Synthetic
caaaggguacuagucucauuuu

SEQ ID NO: 7088 - RNA, 23 nt, Artificial Sequence
  Synthetic
ccaaaggguacuagucucauuuu

SEQ ID NO: 7089 - RNA, 24 nt, Artificial Sequence
  Synthetic
accaaaggguacuagucucauuuu

SEQ ID NO: 7090 - RNA, 18 nt, Artificial Sequence
  Synthetic
cauuugccaauaaccaaa

SEQ ID NO: 7091 - RNA, 21 nt, Artificial Sequence
  Synthetic
uggcauuugccaauaaccaaa

SEQ ID NO: 7092 - RNA, 22 nt, Artificial Sequence
  Synthetic
auggcauuugccaauaaccaaa

SEQ ID NO: 7093 - RNA, 23 nt, Artificial Sequence
  Synthetic
aauggcauuugccaauaaccaaa

SEQ ID NO: 7094 - RNA, 24 nt, Artificial Sequence
  Synthetic
caauggcauuugccaauaaccaaa

SEQ ID NO: 7095 - RNA, 19 nt, Artificial Sequence
  Synthetic
agaaccaaucaaauaagaa

SEQ ID NO: 7096 - RNA, 22 nt, Artificial Sequence
  Synthetic
ugcagaaccaaucaaauaagaa

SEQ ID NO: 7097 - RNA, 23 nt, Artificial Sequence
  Synthetic
cugcagaaccaaucaaauaagaa

SEQ ID NO: 7098 - RNA, 24 nt, Artificial Sequence
  Synthetic
acugcagaaccaaucaaauaagaa

SEQ ID NO: 7099 - RNA, 18 nt, Artificial Sequence
  Synthetic
ucuuggcaugcacacaca

SEQ ID NO: 7100 - RNA, 19 nt, Artificial Sequence
  Synthetic
uucuuggcaugcacacaca

SEQ ID NO: 7101 - RNA, 22 nt, Artificial Sequence
  Synthetic
agguucuuggcaugcacacaca

SEQ ID NO: 7102 - RNA, 24 nt, Artificial Sequence
  Synthetic
ugagguucuuggcaugcacacaca

SEQ ID NO: 7103 - RNA, 18 nt, Artificial Sequence
  Synthetic
cagugacugcugacagca

SEQ ID NO: 7104 - RNA, 21 nt, Artificial Sequence
  Synthetic
cagcagugacugcugacagca

SEQ ID NO: 7105 - RNA, 22 nt, Artificial Sequence
  Synthetic
ucagcagugacugcugacagca

SEQ ID NO: 7106 - RNA, 23 nt, Artificial Sequence
  Synthetic
cucagcagugacugcugacagca

SEQ ID NO: 7107 - RNA, 18 nt, Artificial Sequence
  Synthetic
aaaggagaaauaaaagga

SEQ ID NO: 7108 - RNA, 19 nt, Artificial Sequence
  Synthetic
aaaaggagaaauaaaagga

SEQ ID NO: 7109 - RNA, 20 nt, Artificial Sequence
  Synthetic
caaaaggagaaauaaaagga

SEQ ID NO: 7110 - RNA, 22 nt, Artificial Sequence
  Synthetic
agcaaaaggagaaauaaaagga

SEQ ID NO: 7111 - RNA, 23 nt, Artificial Sequence
  Synthetic
uagcaaaaggagaaauaaaagga

SEQ ID NO: 7112 - RNA, 24 nt, Artificial Sequence
  Synthetic
auagcaaaaggagaaauaaaagga

SEQ ID NO: 7113 - RNA, 21 nt, Artificial Sequence
  Synthetic
agggcagugggaauugaccac

SEQ ID NO: 7114 - RNA, 22 nt, Artificial Sequence
  Synthetic
aagggcagugggaauugaccac

SEQ ID NO: 7115 - RNA, 23 nt, Artificial Sequence
  Synthetic
caagggcagugggaauugaccac

SEQ ID NO: 7116 - RNA, 24 nt, Artificial Sequence
  Synthetic
ucaagggcagugggaauugaccac

SEQ ID NO: 7117 - RNA, 21 nt, Artificial Sequence
  Synthetic
uuggguuuauuaauguaaagc

SEQ ID NO: 7118 - RNA, 22 nt, Artificial Sequence
  Synthetic
uuuggguuuauuaauguaaagc

SEQ ID NO: 7119 - RNA, 23 nt, Artificial Sequence
  Synthetic
cuuuggguuuauuaauguaaagc

SEQ ID NO: 7120 - RNA, 24 nt, Artificial Sequence
  Synthetic
ucuuuggguuuauuaauguaaagc

SEQ ID NO: 7121 - RNA, 18 nt, Artificial Sequence
  Synthetic
auuauaguccacgugauc

SEQ ID NO: 7122 - RNA, 22 nt, Artificial Sequence
  Synthetic
agggauuauaguccacgugauc

SEQ ID NO: 7123 - RNA, 23 nt, Artificial Sequence
  Synthetic
cagggauuauaguccacgugauc

SEQ ID NO: 7124 - RNA, 24 nt, Artificial Sequence
  Synthetic
acagggauuauaguccacgugauc

SEQ ID NO: 7125 - RNA, 18 nt, Artificial Sequence
  Synthetic
auauuuuuccuuuacaag

SEQ ID NO: 7126 - RNA, 19 nt, Artificial Sequence
  Synthetic
uauauuuuuccuuuacaag

SEQ ID NO: 7127 - RNA, 21 nt, Artificial Sequence
  Synthetic
acuauauuuuuccuuuacaag

SEQ ID NO: 7128 - RNA, 22 nt, Artificial Sequence
  Synthetic
uacuauauuuuuccuuuacaag

SEQ ID NO: 7129 - RNA, 23 nt, Artificial Sequence
  Synthetic
auacuauauuuuuccuuuacaag

SEQ ID NO: 7130 - RNA, 24 nt, Artificial Sequence
  Synthetic
aauacuauauuuuuccuuuacaag

SEQ ID NO: 7131 - RNA, 18 nt, Artificial Sequence
  Synthetic
caggaaggcaggcagaag

SEQ ID NO: 7132 - RNA, 19 nt, Artificial Sequence
  Synthetic
acaggaaggcaggcagaag

SEQ ID NO: 7133 - RNA, 18 nt, Artificial Sequence
  Synthetic
acagcuagcacaagacag

SEQ ID NO: 7134 - RNA, 19 nt, Artificial Sequence
  Synthetic
cacagcuagcacaagacag

SEQ ID NO: 7135 - RNA, 21 nt, Artificial Sequence
  Synthetic
ugcacagcuagcacaagacag

SEQ ID NO: 7136 - RNA, 22 nt, Artificial Sequence
  Synthetic
cugcacagcuagcacaagacag

SEQ ID NO: 7137 - RNA, 23 nt, Artificial Sequence
  Synthetic
acugcacagcuagcacaagacag

SEQ ID NO: 7138 - RNA, 21 nt, Artificial Sequence
  Synthetic
aggggaggagaagaaaaagag

SEQ ID NO: 7139 - RNA, 22 nt, Artificial Sequence
  Synthetic
caggggaggagaagaaaaagag

SEQ ID NO: 7140 - RNA, 24 nt, Artificial Sequence
  Synthetic
cgcaggggaggagaagaaaaagag

SEQ ID NO: 7141 - RNA, 18 nt, Artificial Sequence
  Synthetic
uguuucuccacucuggag

SEQ ID NO: 7142 - RNA, 21 nt, Artificial Sequence
  Synthetic
cuguguuucuccacucuggag

SEQ ID NO: 7143 - RNA, 22 nt, Artificial Sequence
  Synthetic
acuguguuucuccacucuggag

SEQ ID NO: 7144 - RNA, 23 nt, Artificial Sequence
  Synthetic
aacuguguuucuccacucuggag

SEQ ID NO: 7145 - RNA, 24 nt, Artificial Sequence
  Synthetic
aaacuguguuucuccacucuggag

SEQ ID NO: 7146 - RNA, 18 nt, Artificial Sequence
  Synthetic
ugaaaacaucuuucugag

SEQ ID NO: 7147 - RNA, 19 nt, Artificial Sequence
  Synthetic
uugaaaacaucuuucugag

SEQ ID NO: 7148 - RNA, 21 nt, Artificial Sequence
  Synthetic
auuugaaaacaucuuucugag

SEQ ID NO: 7149 - RNA, 22 nt, Artificial Sequence
  Synthetic
uauuugaaaacaucuuucugag

SEQ ID NO: 7150 - RNA, 23 nt, Artificial Sequence
  Synthetic
auauuugaaaacaucuuucugag

SEQ ID NO: 7151 - RNA, 24 nt, Artificial Sequence
  Synthetic
uauauuugaaaacaucuuucugag

SEQ ID NO: 7152 - RNA, 18 nt, Artificial Sequence
  Synthetic
cugugauucucugugagg

SEQ ID NO: 7153 - RNA, 19 nt, Artificial Sequence
  Synthetic
ccugugauucucugugagg

SEQ ID NO: 7154 - RNA, 21 nt, Artificial Sequence
  Synthetic
ucccugugauucucugugagg

SEQ ID NO: 7155 - RNA, 22 nt, Artificial Sequence
  Synthetic
uucccugugauucucugugagg

SEQ ID NO: 7156 - RNA, 23 nt, Artificial Sequence
  Synthetic
cuucccugugauucucugugagg

SEQ ID NO: 7157 - RNA, 24 nt, Artificial Sequence
  Synthetic
acuucccugugauucucugugagg

SEQ ID NO: 7158 - RNA, 19 nt, Artificial Sequence
  Synthetic
ugcucucccuggagccugg

SEQ ID NO: 7159 - RNA, 21 nt, Artificial Sequence
  Synthetic
aaugcucucccuggagccugg

SEQ ID NO: 7160 - RNA, 24 nt, Artificial Sequence
  Synthetic
aggaaugcucucccuggagccugg

SEQ ID NO: 7161 - RNA, 18 nt, Artificial Sequence
  Synthetic
uugaaauuagaccuccug

SEQ ID NO: 7162 - RNA, 19 nt, Artificial Sequence
  Synthetic
uuugaaauuagaccuccug

SEQ ID NO: 7163 - RNA, 21 nt, Artificial Sequence
  Synthetic
acuuugaaauuagaccuccug

SEQ ID NO: 7164 - RNA, 22 nt, Artificial Sequence
  Synthetic
uacuuugaaauuagaccuccug

SEQ ID NO: 7165 - RNA, 23 nt, Artificial Sequence
  Synthetic
cuacuuugaaauuagaccuccug

SEQ ID NO: 7166 - RNA, 24 nt, Artificial Sequence
  Synthetic
acuacuuugaaauuagaccuccug

SEQ ID NO: 7167 - RNA, 18 nt, Artificial Sequence
  Synthetic
aggaacucuuuuucucug

SEQ ID NO: 7168 - RNA, 19 nt, Artificial Sequence
  Synthetic
uaggaacucuuuuucucug

SEQ ID NO: 7169 - RNA, 21 nt, Artificial Sequence
  Synthetic
auuaggaacucuuuuucucug

SEQ ID NO: 7170 - RNA, 22 nt, Artificial Sequence
  Synthetic
uauuaggaacucuuuuucucug

SEQ ID NO: 7171 - RNA, 23 nt, Artificial Sequence
  Synthetic
uuauuaggaacucuuuuucucug

SEQ ID NO: 7172 - RNA, 24 nt, Artificial Sequence
  Synthetic
cuuauuaggaacucuuuuucucug

SEQ ID NO: 7173 - RNA, 18 nt, Artificial Sequence
  Synthetic
cugcagaaccaaucaaau

SEQ ID NO: 7174 - RNA, 19 nt, Artificial Sequence
  Synthetic
acugcagaaccaaucaaau

SEQ ID NO: 7175 - RNA, 21 nt, Artificial Sequence
  Synthetic
uaacugcagaaccaaucaaau

SEQ ID NO: 7176 - RNA, 22 nt, Artificial Sequence
  Synthetic
uuaacugcagaaccaaucaaau

SEQ ID NO: 7177 - RNA, 23 nt, Artificial Sequence
  Synthetic
cuuaacugcagaaccaaucaaau

SEQ ID NO: 7178 - RNA, 18 nt, Artificial Sequence
  Synthetic
uccagaaagccugugaau

SEQ ID NO: 7179 - RNA, 21 nt, Artificial Sequence
  Synthetic
caguccagaaagccugugaau

SEQ ID NO: 7180 - RNA, 22 nt, Artificial Sequence
  Synthetic
acaguccagaaagccugugaau

SEQ ID NO: 7181 - RNA, 23 nt, Artificial Sequence
  Synthetic
uacaguccagaaagccugugaau

SEQ ID NO: 7182 - RNA, 24 nt, Artificial Sequence
  Synthetic
cuacaguccagaaagccugugaau

SEQ ID NO: 7183 - RNA, 24 nt, Artificial Sequence
  Synthetic
aggggggaaaucugccgcuucuau

SEQ ID NO: 7184 - RNA, 18 nt, Artificial Sequence
  Synthetic
caagacggucgaaaaccu

SEQ ID NO: 7185 - RNA, 21 nt, Artificial Sequence
  Synthetic
augcaagacggucgaaaaccu

SEQ ID NO: 7186 - RNA, 22 nt, Artificial Sequence
  Synthetic
uaugcaagacggucgaaaaccu

SEQ ID NO: 7187 - RNA, 23 nt, Artificial Sequence
  Synthetic
uuaugcaagacggucgaaaaccu

SEQ ID NO: 7188 - RNA, 24 nt, Artificial Sequence
  Synthetic
cuuaugcaagacggucgaaaaccu

SEQ ID NO: 7189 - RNA, 18 nt, Artificial Sequence
  Synthetic
cuacaguccagaaagccu

SEQ ID NO: 7190 - RNA, 19 nt, Artificial Sequence
  Synthetic
ccuacaguccagaaagccu

SEQ ID NO: 7191 - RNA, 21 nt, Artificial Sequence
  Synthetic
aaccuacaguccagaaagccu

SEQ ID NO: 7192 - RNA, 22 nt, Artificial Sequence
  Synthetic
uaaccuacaguccagaaagccu

SEQ ID NO: 7193 - RNA, 23 nt, Artificial Sequence
  Synthetic
uuaaccuacaguccagaaagccu

SEQ ID NO: 7194 - RNA, 24 nt, Artificial Sequence
  Synthetic
auuaaccuacaguccagaaagccu

SEQ ID NO: 7195 - RNA, 18 nt, Artificial Sequence
  Synthetic
caggaagaaaacauuccu

SEQ ID NO: 7196 - RNA, 19 nt, Artificial Sequence
  Synthetic
acaggaagaaaacauuccu

SEQ ID NO: 7197 - RNA, 21 nt, Artificial Sequence
  Synthetic
uaacaggaagaaaacauuccu

SEQ ID NO: 7198 - RNA, 22 nt, Artificial Sequence
  Synthetic
uuaacaggaagaaaacauuccu

SEQ ID NO: 7199 - RNA, 23 nt, Artificial Sequence
  Synthetic
uuuaacaggaagaaaacauuccu

SEQ ID NO: 7200 - RNA, 24 nt, Artificial Sequence
  Synthetic
uuuuaacaggaagaaaacauuccu

SEQ ID NO: 7201 - RNA, 18 nt, Artificial Sequence
  Synthetic
cacaguuguuuuaaagcu

SEQ ID NO: 7202 - RNA, 19 nt, Artificial Sequence
  Synthetic
acacaguuguuuuaaagcu

SEQ ID NO: 7203 - RNA, 21 nt, Artificial Sequence
  Synthetic
auacacaguuguuuuaaagcu

SEQ ID NO: 7204 - RNA, 23 nt, Artificial Sequence
  Synthetic
agauacacaguuguuuuaaagcu

SEQ ID NO: 7205 - RNA, 24 nt, Artificial Sequence
  Synthetic
aagauacacaguuguuuuaaagcu

SEQ ID NO: 7206 - RNA, 19 nt, Artificial Sequence
  Synthetic
ugcuuuuuguuuuuucucu

SEQ ID NO: 7207 - RNA, 21 nt, Artificial Sequence
  Synthetic
uuugcuuuuuguuuuuucucu

SEQ ID NO: 7208 - RNA, 22 nt, Artificial Sequence
  Synthetic
auuugcuuuuuguuuuuucucu

SEQ ID NO: 7209 - RNA, 23 nt, Artificial Sequence
  Synthetic
cauuugcuuuuuguuuuuucucu

SEQ ID NO: 7210 - RNA, 24 nt, Artificial Sequence
  Synthetic
ccauuugcuuuuuguuuuuucucu

SEQ ID NO: 7211 - RNA, 19 nt, Artificial Sequence
  Synthetic
agauucauucaagggcagu

SEQ ID NO: 7212 - RNA, 21 nt, Artificial Sequence
  Synthetic
acagauucauucaagggcagu

SEQ ID NO: 7213 - RNA, 23 nt, Artificial Sequence
  Synthetic
agacagauucauucaagggcagu

SEQ ID NO: 7214 - RNA, 24 nt, Artificial Sequence
  Synthetic
aagacagauucauucaagggcagu

SEQ ID NO: 7215 - RNA, 18 nt, Artificial Sequence
  Synthetic
uuaacauuuuauuccauu

SEQ ID NO: 7216 - RNA, 19 nt, Artificial Sequence
  Synthetic
uuuaacauuuuauuccauu

SEQ ID NO: 7217 - RNA, 21 nt, Artificial Sequence
  Synthetic
aauuuaacauuuuauuccauu

SEQ ID NO: 7218 - RNA, 22 nt, Artificial Sequence
  Synthetic
aaauuuaacauuuuauuccauu

SEQ ID NO: 7219 - RNA, 23 nt, Artificial Sequence
  Synthetic
uaaauuuaacauuuuauuccauu

SEQ ID NO: 7220 - RNA, 24 nt, Artificial Sequence
  Synthetic
cuaaauuuaacauuuuauuccauu

SEQ ID NO: 7221 - RNA, 18 nt, Artificial Sequence
  Synthetic
ucauuuagauuagugguu

SEQ ID NO: 7222 - RNA, 19 nt, Artificial Sequence
  Synthetic
uucauuuagauuagugguu

SEQ ID NO: 7223 - RNA, 20 nt, Artificial Sequence
  Synthetic
cuucauuuagauuagugguu

SEQ ID NO: 7224 - RNA, 22 nt, Artificial Sequence
  Synthetic
agcuucauuuagauuagugguu

SEQ ID NO: 7225 - RNA, 24 nt, Artificial Sequence
  Synthetic
agagcuucauuuagauuagugguu

SEQ ID NO: 7226 - RNA, 18 nt, Artificial Sequence
  Synthetic
uacauuaauaaacccaaa

SEQ ID NO: 7227 - RNA, 19 nt, Artificial Sequence
  Synthetic
uuacauuaauaaacccaaa

SEQ ID NO: 7228 - RNA, 21 nt, Artificial Sequence
  Synthetic
cuuuacauuaauaaacccaaa

SEQ ID NO: 7229 - RNA, 22 nt, Artificial Sequence
  Synthetic
gcuuuacauuaauaaacccaaa

SEQ ID NO: 7230 - RNA, 23 nt, Artificial Sequence
  Synthetic
ugcuuuacauuaauaaacccaaa

SEQ ID NO: 7231 - RNA, 24 nt, Artificial Sequence
  Synthetic
cugcuuuacauuaauaaacccaaa

SEQ ID NO: 7232 - RNA, 18 nt, Artificial Sequence
  Synthetic
aaaggauaguuuuucaaa

SEQ ID NO: 7233 - RNA, 19 nt, Artificial Sequence
  Synthetic
aaaaggauaguuuuucaaa

SEQ ID NO: 7234 - RNA, 21 nt, Artificial Sequence
  Synthetic
aaaaaaggauaguuuuucaaa

SEQ ID NO: 7235 - RNA, 22 nt, Artificial Sequence
  Synthetic
caaaaaaggauaguuuuucaaa

SEQ ID NO: 7236 - RNA, 23 nt, Artificial Sequence
  Synthetic
ucaaaaaaggauaguuuuucaaa

SEQ ID NO: 7237 - RNA, 24 nt, Artificial Sequence
  Synthetic
uucaaaaaaggauaguuuuucaaa

SEQ ID NO: 7238 - RNA, 18 nt, Artificial Sequence
  Synthetic
auaaaauauagauuacaa

SEQ ID NO: 7239 - RNA, 19 nt, Artificial Sequence
  Synthetic
uauaaaauauagauuacaa

SEQ ID NO: 7240 - RNA, 21 nt, Artificial Sequence
  Synthetic
uauauaaaauauagauuacaa

SEQ ID NO: 7241 - RNA, 22 nt, Artificial Sequence
  Synthetic
auauauaaaauauagauuacaa

SEQ ID NO: 7242 - RNA, 23 nt, Artificial Sequence
  Synthetic
aauauauaaaauauagauuacaa

SEQ ID NO: 7243 - RNA, 24 nt, Artificial Sequence
  Synthetic
aaauauauaaaauauagauuacaa

SEQ ID NO: 7244 - RNA, 18 nt, Artificial Sequence
  Synthetic
aaaaggauaguuuuucaa

SEQ ID NO: 7245 - RNA, 19 nt, Artificial Sequence
  Synthetic
aaaaaggauaguuuuucaa

SEQ ID NO: 7246 - RNA, 20 nt, Artificial Sequence
  Synthetic
aaaaaaggauaguuuuucaa

SEQ ID NO: 7247 - RNA, 21 nt, Artificial Sequence
  Synthetic
caaaaaaggauaguuuuucaa

SEQ ID NO: 7248 - RNA, 22 nt, Artificial Sequence
  Synthetic
ucaaaaaaggauaguuuuucaa

SEQ ID NO: 7249 - RNA, 23 nt, Artificial Sequence
  Synthetic
uucaaaaaaggauaguuuuucaa

SEQ ID NO: 7250 - RNA, 24 nt, Artificial Sequence
  Synthetic
guucaaaaaaggauaguuuuucaa

SEQ ID NO: 7251 - RNA, 18 nt, Artificial Sequence
  Synthetic
uucuuccuguuaaaagaa

SEQ ID NO: 7252 - RNA, 19 nt, Artificial Sequence
  Synthetic
uuucuuccuguuaaaagaa

SEQ ID NO: 7253 - RNA, 21 nt, Artificial Sequence
  Synthetic
guuuucuuccuguuaaaagaa

SEQ ID NO: 7254 - RNA, 22 nt, Artificial Sequence
  Synthetic
uguuuucuuccuguuaaaagaa

SEQ ID NO: 7255 - RNA, 23 nt, Artificial Sequence
  Synthetic
auguuuucuuccuguuaaaagaa

SEQ ID NO: 7256 - RNA, 24 nt, Artificial Sequence
  Synthetic
aauguuuucuuccuguuaaaagaa

SEQ ID NO: 7257 - RNA, 18 nt, Artificial Sequence
  Synthetic
ucugaaccacuaaucuaa

SEQ ID NO: 7258 - RNA, 19 nt, Artificial Sequence
  Synthetic
cucugaaccacuaaucuaa

SEQ ID NO: 7259 - RNA, 20 nt, Artificial Sequence
  Synthetic
acucugaaccacuaaucuaa

SEQ ID NO: 7260 - RNA, 21 nt, Artificial Sequence
  Synthetic
aacucugaaccacuaaucuaa

SEQ ID NO: 7261 - RNA, 22 nt, Artificial Sequence
  Synthetic
gaacucugaaccacuaaucuaa

SEQ ID NO: 7262 - RNA, 23 nt, Artificial Sequence
  Synthetic
agaacucugaaccacuaaucuaa

SEQ ID NO: 7263 - RNA, 24 nt, Artificial Sequence
  Synthetic
aagaacucugaaccacuaaucuaa

SEQ ID NO: 7264 - RNA, 18 nt, Artificial Sequence
  Synthetic
gaauuacucagcuuguaa

SEQ ID NO: 7265 - RNA, 19 nt, Artificial Sequence
  Synthetic
agaauuacucagcuuguaa

SEQ ID NO: 7266 - RNA, 21 nt, Artificial Sequence
  Synthetic
ucagaauuacucagcuuguaa

SEQ ID NO: 7267 - RNA, 22 nt, Artificial Sequence
  Synthetic
cucagaauuacucagcuuguaa

SEQ ID NO: 7268 - RNA, 23 nt, Artificial Sequence
  Synthetic
gcucagaauuacucagcuuguaa

SEQ ID NO: 7269 - RNA, 24 nt, Artificial Sequence
  Synthetic
ugcucagaauuacucagcuuguaa

SEQ ID NO: 7270 - RNA, 18 nt, Artificial Sequence
  Synthetic
auguuuucuuccuguuaa

SEQ ID NO: 7271 - RNA, 19 nt, Artificial Sequence
  Synthetic
aauguuuucuuccuguuaa

SEQ ID NO: 7272 - RNA, 21 nt, Artificial Sequence
  Synthetic
ggaauguuuucuuccuguuaa

SEQ ID NO: 7273 - RNA, 22 nt, Artificial Sequence
  Synthetic
aggaauguuuucuuccuguuaa

SEQ ID NO: 7274 - RNA, 23 nt, Artificial Sequence
  Synthetic
uaggaauguuuucuuccuguuaa

SEQ ID NO: 7275 - RNA, 24 nt, Artificial Sequence
  Synthetic
uuaggaauguuuucuuccuguuaa

SEQ ID NO: 7276 - RNA, 18 nt, Artificial Sequence
  Synthetic
ugugcugcuaacuccaca

SEQ ID NO: 7277 - RNA, 19 nt, Artificial Sequence
  Synthetic
uugugcugcuaacuccaca

SEQ ID NO: 7278 - RNA, 21 nt, Artificial Sequence
  Synthetic
ccuugugcugcuaacuccaca

SEQ ID NO: 7279 - RNA, 22 nt, Artificial Sequence
  Synthetic
cccuugugcugcuaacuccaca

SEQ ID NO: 7280 - RNA, 23 nt, Artificial Sequence
  Synthetic
gcccuugugcugcuaacuccaca

SEQ ID NO: 7281 - RNA, 24 nt, Artificial Sequence
  Synthetic
ugcccuugugcugcuaacuccaca

SEQ ID NO: 7282 - RNA, 18 nt, Artificial Sequence
  Synthetic
cccucacagagaaucaca

SEQ ID NO: 7283 - RNA, 19 nt, Artificial Sequence
  Synthetic
ccccucacagagaaucaca

SEQ ID NO: 7284 - RNA, 21 nt, Artificial Sequence
  Synthetic
ccccccucacagagaaucaca

SEQ ID NO: 7285 - RNA, 22 nt, Artificial Sequence
  Synthetic
uccccccucacagagaaucaca

SEQ ID NO: 7286 - RNA, 23 nt, Artificial Sequence
  Synthetic
auccccccucacagagaaucaca

SEQ ID NO: 7287 - RNA, 24 nt, Artificial Sequence
  Synthetic
cauccccccucacagagaaucaca

SEQ ID NO: 7288 - RNA, 18 nt, Artificial Sequence
  Synthetic
ggacugugaaaacugaca

SEQ ID NO: 7289 - RNA, 19 nt, Artificial Sequence
  Synthetic
uggacugugaaaacugaca

SEQ ID NO: 7290 - RNA, 21 nt, Artificial Sequence
  Synthetic
uauggacugugaaaacugaca

SEQ ID NO: 7291 - RNA, 22 nt, Artificial Sequence
  Synthetic
cuauggacugugaaaacugaca

SEQ ID NO: 7292 - RNA, 23 nt, Artificial Sequence
  Synthetic
gcuauggacugugaaaacugaca

SEQ ID NO: 7293 - RNA, 24 nt, Artificial Sequence
  Synthetic
ugcuauggacugugaaaacugaca

SEQ ID NO: 7294 - RNA, 18 nt, Artificial Sequence
  Synthetic
uauaaaauauagauuaca

SEQ ID NO: 7295 - RNA, 19 nt, Artificial Sequence
  Synthetic
auauaaaauauagauuaca

SEQ ID NO: 7296 - RNA, 21 nt, Artificial Sequence
  Synthetic
auauauaaaauauagauuaca

SEQ ID NO: 7297 - RNA, 22 nt, Artificial Sequence
  Synthetic
aauauauaaaauauagauuaca

SEQ ID NO: 7298 - RNA, 23 nt, Artificial Sequence
  Synthetic
aaauauauaaaauauagauuaca

SEQ ID NO: 7299 - RNA, 24 nt, Artificial Sequence
  Synthetic
caaauauauaaaauauagauuaca

SEQ ID NO: 7300 - RNA, 18 nt, Artificial Sequence
  Synthetic
cauaagccaaguccacca

SEQ ID NO: 7301 - RNA, 19 nt, Artificial Sequence
  Synthetic
gcauaagccaaguccacca

SEQ ID NO: 7302 - RNA, 21 nt, Artificial Sequence
  Synthetic
uugcauaagccaaguccacca

SEQ ID NO: 7303 - RNA, 22 nt, Artificial Sequence
  Synthetic
cuugcauaagccaaguccacca

SEQ ID NO: 7304 - RNA, 23 nt, Artificial Sequence
  Synthetic
ucuugcauaagccaaguccacca

SEQ ID NO: 7305 - RNA, 24 nt, Artificial Sequence
  Synthetic
gucuugcauaagccaaguccacca

SEQ ID NO: 7306 - RNA, 18 nt, Artificial Sequence
  Synthetic
uuuacauuaauaaaccca

SEQ ID NO: 7307 - RNA, 19 nt, Artificial Sequence
  Synthetic
cuuuacauuaauaaaccca

SEQ ID NO: 7308 - RNA, 21 nt, Artificial Sequence
  Synthetic
ugcuuuacauuaauaaaccca

SEQ ID NO: 7309 - RNA, 22 nt, Artificial Sequence
  Synthetic
cugcuuuacauuaauaaaccca

SEQ ID NO: 7310 - RNA, 23 nt, Artificial Sequence
  Synthetic
ccugcuuuacauuaauaaaccca

SEQ ID NO: 7311 - RNA, 24 nt, Artificial Sequence
  Synthetic
cccugcuuuacauuaauaaaccca

SEQ ID NO: 7312 - RNA, 18 nt, Artificial Sequence
  Synthetic
agagaagacuauggccca

SEQ ID NO: 7313 - RNA, 19 nt, Artificial Sequence
  Synthetic
cagagaagacuauggccca

SEQ ID NO: 7314 - RNA, 21 nt, Artificial Sequence
  Synthetic
agcagagaagacuauggccca

SEQ ID NO: 7315 - RNA, 22 nt, Artificial Sequence
  Synthetic
uagcagagaagacuauggccca

SEQ ID NO: 7316 - RNA, 23 nt, Artificial Sequence
  Synthetic
auagcagagaagacuauggccca

SEQ ID NO: 7317 - RNA, 24 nt, Artificial Sequence
  Synthetic
uauagcagagaagacuauggccca

SEQ ID NO: 7318 - RNA, 18 nt, Artificial Sequence
  Synthetic
cuugugcugcuaacucca

SEQ ID NO: 7319 - RNA, 19 nt, Artificial Sequence
  Synthetic
ccuugugcugcuaacucca

SEQ ID NO: 7320 - RNA, 21 nt, Artificial Sequence
  Synthetic
gcccuugugcugcuaacucca

SEQ ID NO: 7321 - RNA, 22 nt, Artificial Sequence
  Synthetic
ugcccuugugcugcuaacucca

SEQ ID NO: 7322 - RNA, 23 nt, Artificial Sequence
  Synthetic
uugcccuugugcugcuaacucca

SEQ ID NO: 7323 - RNA, 24 nt, Artificial Sequence
  Synthetic
auugcccuugugcugcuaacucca

SEQ ID NO: 7324 - RNA, 18 nt, Artificial Sequence
  Synthetic
gcacccuaccaggcucca

SEQ ID NO: 7325 - RNA, 19 nt, Artificial Sequence
  Synthetic
agcacccuaccaggcucca

SEQ ID NO: 7326 - RNA, 21 nt, Artificial Sequence
  Synthetic
acagcacccuaccaggcucca

SEQ ID NO: 7327 - RNA, 22 nt, Artificial Sequence
  Synthetic
gacagcacccuaccaggcucca

SEQ ID NO: 7328 - RNA, 23 nt, Artificial Sequence
  Synthetic
ggacagcacccuaccaggcucca

SEQ ID NO: 7329 - RNA, 24 nt, Artificial Sequence
  Synthetic
aggacagcacccuaccaggcucca

SEQ ID NO: 7330 - RNA, 18 nt, Artificial Sequence
  Synthetic
gcaagggucuuuauagca

SEQ ID NO: 7331 - RNA, 19 nt, Artificial Sequence
  Synthetic
ugcaagggucuuuauagca

SEQ ID NO: 7332 - RNA, 21 nt, Artificial Sequence
  Synthetic
gcugcaagggucuuuauagca

SEQ ID NO: 7333 - RNA, 22 nt, Artificial Sequence
  Synthetic
agcugcaagggucuuuauagca

SEQ ID NO: 7334 - RNA, 23 nt, Artificial Sequence
  Synthetic
gagcugcaagggucuuuauagca

SEQ ID NO: 7335 - RNA, 24 nt, Artificial Sequence
  Synthetic
agagcugcaagggucuuuauagca

SEQ ID NO: 7336 - RNA, 18 nt, Artificial Sequence
  Synthetic
uuuauggcucuauucgca

SEQ ID NO: 7337 - RNA, 19 nt, Artificial Sequence
  Synthetic
guuuauggcucuauucgca

SEQ ID NO: 7338 - RNA, 21 nt, Artificial Sequence
  Synthetic
gaguuuauggcucuauucgca

SEQ ID NO: 7339 - RNA, 22 nt, Artificial Sequence
  Synthetic
ugaguuuauggcucuauucgca

SEQ ID NO: 7340 - RNA, 23 nt, Artificial Sequence
  Synthetic
uugaguuuauggcucuauucgca

SEQ ID NO: 7341 - RNA, 24 nt, Artificial Sequence
  Synthetic
uuugaguuuauggcucuauucgca

SEQ ID NO: 7342 - RNA, 18 nt, Artificial Sequence
  Synthetic
uaggagaaagggcaggca

SEQ ID NO: 7343 - RNA, 19 nt, Artificial Sequence
  Synthetic
cuaggagaaagggcaggca

SEQ ID NO: 7344 - RNA, 21 nt, Artificial Sequence
  Synthetic
cucuaggagaaagggcaggca

SEQ ID NO: 7345 - RNA, 22 nt, Artificial Sequence
  Synthetic
ucucuaggagaaagggcaggca

SEQ ID NO: 7346 - RNA, 23 nt, Artificial Sequence
  Synthetic
gucucuaggagaaagggcaggca

SEQ ID NO: 7347 - RNA, 24 nt, Artificial Sequence
  Synthetic
agucucuaggagaaagggcaggca

SEQ ID NO: 7348 - RNA, 18 nt, Artificial Sequence
  Synthetic
cccccucacagagaauca

SEQ ID NO: 7349 - RNA, 19 nt, Artificial Sequence
  Synthetic
ccccccucacagagaauca

SEQ ID NO: 7350 - RNA, 21 nt, Artificial Sequence
  Synthetic
auccccccucacagagaauca

SEQ ID NO: 7351 - RNA, 22 nt, Artificial Sequence
  Synthetic
cauccccccucacagagaauca

SEQ ID NO: 7352 - RNA, 23 nt, Artificial Sequence
  Synthetic
acauccccccucacagagaauca

SEQ ID NO: 7353 - RNA, 24 nt, Artificial Sequence
  Synthetic
aacauccccccucacagagaauca

SEQ ID NO: 7354 - RNA, 18 nt, Artificial Sequence
  Synthetic
uggagucugacgugauca

SEQ ID NO: 7355 - RNA, 19 nt, Artificial Sequence
  Synthetic
cuggagucugacgugauca

SEQ ID NO: 7356 - RNA, 21 nt, Artificial Sequence
  Synthetic
uccuggagucugacgugauca

SEQ ID NO: 7357 - RNA, 22 nt, Artificial Sequence
  Synthetic
guccuggagucugacgugauca

SEQ ID NO: 7358 - RNA, 23 nt, Artificial Sequence
  Synthetic
gguccuggagucugacgugauca

SEQ ID NO: 7359 - RNA, 24 nt, Artificial Sequence
  Synthetic
cgguccuggagucugacgugauca

SEQ ID NO: 7360 - RNA, 18 nt, Artificial Sequence
  Synthetic
ucucaacauccccccuca

SEQ ID NO: 7361 - RNA, 19 nt, Artificial Sequence
  Synthetic
cucucaacauccccccuca

SEQ ID NO: 7362 - RNA, 21 nt, Artificial Sequence
  Synthetic
cccucucaacauccccccuca

SEQ ID NO: 7363 - RNA, 22 nt, Artificial Sequence
  Synthetic
ccccucucaacauccccccuca

SEQ ID NO: 7364 - RNA, 23 nt, Artificial Sequence
  Synthetic
uccccucucaacauccccccuca

SEQ ID NO: 7365 - RNA, 24 nt, Artificial Sequence
  Synthetic
uuccccucucaacauccccccuca

SEQ ID NO: 7366 - RNA, 18 nt, Artificial Sequence
  Synthetic
auguggcuguuggguuca

SEQ ID NO: 7367 - RNA, 19 nt, Artificial Sequence
  Synthetic
aauguggcuguuggguuca

SEQ ID NO: 7368 - RNA, 21 nt, Artificial Sequence
  Synthetic
aaaauguggcuguuggguuca

SEQ ID NO: 7369 - RNA, 22 nt, Artificial Sequence
  Synthetic
gaaaauguggcuguuggguuca

SEQ ID NO: 7370 - RNA, 23 nt, Artificial Sequence
  Synthetic
ggaaaauguggcuguuggguuca

SEQ ID NO: 7371 - RNA, 24 nt, Artificial Sequence
  Synthetic
aggaaaauguggcuguuggguuca

SEQ ID NO: 7372 - RNA, 18 nt, Artificial Sequence
  Synthetic
aucacagggaaguguuca

SEQ ID NO: 7373 - RNA, 19 nt, Artificial Sequence
  Synthetic
aaucacagggaaguguuca

SEQ ID NO: 7374 - RNA, 21 nt, Artificial Sequence
  Synthetic
agaaucacagggaaguguuca

SEQ ID NO: 7375 - RNA, 22 nt, Artificial Sequence
  Synthetic
gagaaucacagggaaguguuca

SEQ ID NO: 7376 - RNA, 23 nt, Artificial Sequence
  Synthetic
agagaaucacagggaaguguuca

SEQ ID NO: 7377 - RNA, 24 nt, Artificial Sequence
  Synthetic
cagagaaucacagggaaguguuca

SEQ ID NO: 7378 - RNA, 18 nt, Artificial Sequence
  Synthetic
accaauggcagaaccaga

SEQ ID NO: 7379 - RNA, 19 nt, Artificial Sequence
  Synthetic
aaccaauggcagaaccaga

SEQ ID NO: 7380 - RNA, 21 nt, Artificial Sequence
  Synthetic
ccaaccaauggcagaaccaga

SEQ ID NO: 7381 - RNA, 22 nt, Artificial Sequence
  Synthetic
gccaaccaauggcagaaccaga

SEQ ID NO: 7382 - RNA, 23 nt, Artificial Sequence
  Synthetic
agccaaccaauggcagaaccaga

SEQ ID NO: 7383 - RNA, 24 nt, Artificial Sequence
  Synthetic
cagccaaccaauggcagaaccaga

SEQ ID NO: 7384 - RNA, 18 nt, Artificial Sequence
  Synthetic
ggcagacucaccuccaga

SEQ ID NO: 7385 - RNA, 19 nt, Artificial Sequence
  Synthetic
uggcagacucaccuccaga

SEQ ID NO: 7386 - RNA, 21 nt, Artificial Sequence
  Synthetic
ccuggcagacucaccuccaga

SEQ ID NO: 7387 - RNA, 22 nt, Artificial Sequence
  Synthetic
cccuggcagacucaccuccaga

SEQ ID NO: 7388 - RNA, 23 nt, Artificial Sequence
  Synthetic
gcccuggcagacucaccuccaga

SEQ ID NO: 7389 - RNA, 24 nt, Artificial Sequence
  Synthetic
ugcccuggcagacucaccuccaga

SEQ ID NO: 7390 - RNA, 18 nt, Artificial Sequence
  Synthetic
ugugcagucucuaggaga

SEQ ID NO: 7391 - RNA, 19 nt, Artificial Sequence
  Synthetic
cugugcagucucuaggaga

SEQ ID NO: 7392 - RNA, 20 nt, Artificial Sequence
  Synthetic
gcugugcagucucuaggaga

SEQ ID NO: 7393 - RNA, 21 nt, Artificial Sequence
  Synthetic
agcugugcagucucuaggaga

SEQ ID NO: 7394 - RNA, 22 nt, Artificial Sequence
  Synthetic
uagcugugcagucucuaggaga

SEQ ID NO: 7395 - RNA, 23 nt, Artificial Sequence
  Synthetic
cuagcugugcagucucuaggaga

SEQ ID NO: 7396 - RNA, 24 nt, Artificial Sequence
  Synthetic
gcuagcugugcagucucuaggaga

SEQ ID NO: 7397 - RNA, 18 nt, Artificial Sequence
  Synthetic
aagacuauggcccaggga

SEQ ID NO: 7398 - RNA, 19 nt, Artificial Sequence
  Synthetic
gaagacuauggcccaggga

SEQ ID NO: 7399 - RNA, 21 nt, Artificial Sequence
  Synthetic
gagaagacuauggcccaggga

SEQ ID NO: 7400 - RNA, 22 nt, Artificial Sequence
  Synthetic
agagaagacuauggcccaggga

SEQ ID NO: 7401 - RNA, 23 nt, Artificial Sequence
  Synthetic
cagagaagacuauggcccaggga

SEQ ID NO: 7402 - RNA, 24 nt, Artificial Sequence
  Synthetic
gcagagaagacuauggcccaggga

SEQ ID NO: 7403 - RNA, 18 nt, Artificial Sequence
  Synthetic
auugucuaugcuuaggga

SEQ ID NO: 7404 - RNA, 19 nt, Artificial Sequence
  Synthetic
cauugucuaugcuuaggga

SEQ ID NO: 7405 - RNA, 21 nt, Artificial Sequence
  Synthetic
gccauugucuaugcuuaggga

SEQ ID NO: 7406 - RNA, 22 nt, Artificial Sequence
  Synthetic
ugccauugucuaugcuuaggga

SEQ ID NO: 7407 - RNA, 23 nt, Artificial Sequence
  Synthetic
augccauugucuaugcuuaggga

SEQ ID NO: 7408 - RNA, 24 nt, Artificial Sequence
  Synthetic
aaugccauugucuaugcuuaggga

SEQ ID NO: 7409 - RNA, 18 nt, Artificial Sequence
  Synthetic
gugaucagugaggacuga

SEQ ID NO: 7410 - RNA, 19 nt, Artificial Sequence
  Synthetic
cgugaucagugaggacuga

SEQ ID NO: 7411 - RNA, 21 nt, Artificial Sequence
  Synthetic
gacgugaucagugaggacuga

SEQ ID NO: 7412 - RNA, 22 nt, Artificial Sequence
  Synthetic
ugacgugaucagugaggacuga

SEQ ID NO: 7413 - RNA, 23 nt, Artificial Sequence
  Synthetic
cugacgugaucagugaggacuga

SEQ ID NO: 7414 - RNA, 24 nt, Artificial Sequence
  Synthetic
ucugacgugaucagugaggacuga

SEQ ID NO: 7415 - RNA, 18 nt, Artificial Sequence
  Synthetic
gaaaaagaguuccuaaua

SEQ ID NO: 7416 - RNA, 19 nt, Artificial Sequence
  Synthetic
agaaaaagaguuccuaaua

SEQ ID NO: 7417 - RNA, 21 nt, Artificial Sequence
  Synthetic
agagaaaaagaguuccuaaua

SEQ ID NO: 7418 - RNA, 22 nt, Artificial Sequence
  Synthetic
cagagaaaaagaguuccuaaua

SEQ ID NO: 7419 - RNA, 23 nt, Artificial Sequence
  Synthetic
acagagaaaaagaguuccuaaua

SEQ ID NO: 7420 - RNA, 24 nt, Artificial Sequence
  Synthetic
cacagagaaaaagaguuccuaaua

SEQ ID NO: 7421 - RNA, 18 nt, Artificial Sequence
  Synthetic
caaaggaaacaaaugaua

SEQ ID NO: 7422 - RNA, 19 nt, Artificial Sequence
  Synthetic
acaaaggaaacaaaugaua

SEQ ID NO: 7423 - RNA, 21 nt, Artificial Sequence
  Synthetic
uuacaaaggaaacaaaugaua

SEQ ID NO: 7424 - RNA, 22 nt, Artificial Sequence
  Synthetic
auuacaaaggaaacaaaugaua

SEQ ID NO: 7425 - RNA, 23 nt, Artificial Sequence
  Synthetic
gauuacaaaggaaacaaaugaua

SEQ ID NO: 7426 - RNA, 24 nt, Artificial Sequence
  Synthetic
agauuacaaaggaaacaaaugaua

SEQ ID NO: 7427 - RNA, 18 nt, Artificial Sequence
  Synthetic
ccagggagagcauuccua

SEQ ID NO: 7428 - RNA, 19 nt, Artificial Sequence
  Synthetic
uccagggagagcauuccua

SEQ ID NO: 7429 - RNA, 21 nt, Artificial Sequence
  Synthetic
gcuccagggagagcauuccua

SEQ ID NO: 7430 - RNA, 22 nt, Artificial Sequence
  Synthetic
ggcuccagggagagcauuccua

SEQ ID NO: 7431 - RNA, 23 nt, Artificial Sequence
  Synthetic
aggcuccagggagagcauuccua

SEQ ID NO: 7432 - RNA, 24 nt, Artificial Sequence
  Synthetic
caggcuccagggagagcauuccua

SEQ ID NO: 7433 - RNA, 18 nt, Artificial Sequence
  Synthetic
agaauuacucagcuugua

SEQ ID NO: 7434 - RNA, 19 nt, Artificial Sequence
  Synthetic
cagaauuacucagcuugua

SEQ ID NO: 7435 - RNA, 21 nt, Artificial Sequence
  Synthetic
cucagaauuacucagcuugua

SEQ ID NO: 7436 - RNA, 22 nt, Artificial Sequence
  Synthetic
gcucagaauuacucagcuugua

SEQ ID NO: 7437 - RNA, 23 nt, Artificial Sequence
  Synthetic
ugcucagaauuacucagcuugua

SEQ ID NO: 7438 - RNA, 24 nt, Artificial Sequence
  Synthetic
uugcucagaauuacucagcuugua

SEQ ID NO: 7439 - RNA, 18 nt, Artificial Sequence
  Synthetic
ugccauugucuaugcuua

SEQ ID NO: 7440 - RNA, 19 nt, Artificial Sequence
  Synthetic
augccauugucuaugcuua

SEQ ID NO: 7441 - RNA, 21 nt, Artificial Sequence
  Synthetic
aaaugccauugucuaugcuua

SEQ ID NO: 7442 - RNA, 22 nt, Artificial Sequence
  Synthetic
caaaugccauugucuaugcuua

SEQ ID NO: 7443 - RNA, 23 nt, Artificial Sequence
  Synthetic
gcaaaugccauugucuaugcuua

SEQ ID NO: 7444 - RNA, 24 nt, Artificial Sequence
  Synthetic
ggcaaaugccauugucuaugcuua

SEQ ID NO: 7445 - RNA, 18 nt, Artificial Sequence
  Synthetic
gggaaguguucacagaac

SEQ ID NO: 7446 - RNA, 19 nt, Artificial Sequence
  Synthetic
agggaaguguucacagaac

SEQ ID NO: 7447 - RNA, 21 nt, Artificial Sequence
  Synthetic
acagggaaguguucacagaac

SEQ ID NO: 7448 - RNA, 22 nt, Artificial Sequence
  Synthetic
cacagggaaguguucacagaac

SEQ ID NO: 7449 - RNA, 23 nt, Artificial Sequence
  Synthetic
ucacagggaaguguucacagaac

SEQ ID NO: 7450 - RNA, 24 nt, Artificial Sequence
  Synthetic
aucacagggaaguguucacagaac

SEQ ID NO: 7451 - RNA, 18 nt, Artificial Sequence
  Synthetic
gccaaccaauggcagaac

SEQ ID NO: 7452 - RNA, 19 nt, Artificial Sequence
  Synthetic
agccaaccaauggcagaac

SEQ ID NO: 7453 - RNA, 21 nt, Artificial Sequence
  Synthetic
acagccaaccaauggcagaac

SEQ ID NO: 7454 - RNA, 22 nt, Artificial Sequence
  Synthetic
cacagccaaccaauggcagaac

SEQ ID NO: 7455 - RNA, 23 nt, Artificial Sequence
  Synthetic
gcacagccaaccaauggcagaac

SEQ ID NO: 7456 - RNA, 24 nt, Artificial Sequence
  Synthetic
cgcacagccaaccaauggcagaac

SEQ ID NO: 7457 - RNA, 18 nt, Artificial Sequence
  Synthetic
cugcaguuaagccugaac

SEQ ID NO: 7458 - RNA, 19 nt, Artificial Sequence
  Synthetic
ucugcaguuaagccugaac

SEQ ID NO: 7459 - RNA, 21 nt, Artificial Sequence
  Synthetic
guucugcaguuaagccugaac

SEQ ID NO: 7460 - RNA, 22 nt, Artificial Sequence
  Synthetic
gguucugcaguuaagccugaac

SEQ ID NO: 7461 - RNA, 23 nt, Artificial Sequence
  Synthetic
ugguucugcaguuaagccugaac

SEQ ID NO: 7462 - RNA, 24 nt, Artificial Sequence
  Synthetic
uugguucugcaguuaagccugaac

SEQ ID NO: 7463 - RNA, 18 nt, Artificial Sequence
  Synthetic
gaaguguucacagaacac

SEQ ID NO: 7464 - RNA, 19 nt, Artificial Sequence
  Synthetic
ggaaguguucacagaacac

SEQ ID NO: 7465 - RNA, 21 nt, Artificial Sequence
  Synthetic
agggaaguguucacagaacac

SEQ ID NO: 7466 - RNA, 22 nt, Artificial Sequence
  Synthetic
cagggaaguguucacagaacac

SEQ ID NO: 7467 - RNA, 23 nt, Artificial Sequence
  Synthetic
acagggaaguguucacagaacac

SEQ ID NO: 7468 - RNA, 24 nt, Artificial Sequence
  Synthetic
cacagggaaguguucacagaacac

SEQ ID NO: 7469 - RNA, 18 nt, Artificial Sequence
  Synthetic
gaaguaacuuuaagccac

SEQ ID NO: 7470 - RNA, 19 nt, Artificial Sequence
  Synthetic
agaaguaacuuuaagccac

SEQ ID NO: 7471 - RNA, 21 nt, Artificial Sequence
  Synthetic
ucagaaguaacuuuaagccac

SEQ ID NO: 7472 - RNA, 22 nt, Artificial Sequence
  Synthetic
gucagaaguaacuuuaagccac

SEQ ID NO: 7473 - RNA, 23 nt, Artificial Sequence
  Synthetic
ugucagaaguaacuuuaagccac

SEQ ID NO: 7474 - RNA, 24 nt, Artificial Sequence
  Synthetic
cugucagaaguaacuuuaagccac

SEQ ID NO: 7475 - RNA, 18 nt, Artificial Sequence
  Synthetic
acugacauggaggggcac

SEQ ID NO: 7476 - RNA, 19 nt, Artificial Sequence
  Synthetic
aacugacauggaggggcac

SEQ ID NO: 7477 - RNA, 20 nt, Artificial Sequence
  Synthetic
aaacugacauggaggggcac

SEQ ID NO: 7478 - RNA, 21 nt, Artificial Sequence
  Synthetic
aaaacugacauggaggggcac

SEQ ID NO: 7479 - RNA, 22 nt, Artificial Sequence
  Synthetic
gaaaacugacauggaggggcac

SEQ ID NO: 7480 - RNA, 23 nt, Artificial Sequence
  Synthetic
ugaaaacugacauggaggggcac

SEQ ID NO: 7481 - RNA, 24 nt, Artificial Sequence
  Synthetic
gugaaaacugacauggaggggcac

SEQ ID NO: 7482 - RNA, 18 nt, Artificial Sequence
  Synthetic
ccccucacagagaaucac

SEQ ID NO: 7483 - RNA, 19 nt, Artificial Sequence
  Synthetic
cccccucacagagaaucac

SEQ ID NO: 7484 - RNA, 21 nt, Artificial Sequence
  Synthetic
uccccccucacagagaaucac

SEQ ID NO: 7485 - RNA, 22 nt, Artificial Sequence
  Synthetic
auccccccucacagagaaucac

SEQ ID NO: 7486 - RNA, 23 nt, Artificial Sequence
  Synthetic
cauccccccucacagagaaucac

SEQ ID NO: 7487 - RNA, 24 nt, Artificial Sequence
  Synthetic
acauccccccucacagagaaucac

SEQ ID NO: 7488 - RNA, 18 nt, Artificial Sequence
  Synthetic
ccuagaacccaggaucac

SEQ ID NO: 7489 - RNA, 19 nt, Artificial Sequence
  Synthetic
uccuagaacccaggaucac

SEQ ID NO: 7490 - RNA, 21 nt, Artificial Sequence
  Synthetic
ccuccuagaacccaggaucac

SEQ ID NO: 7491 - RNA, 22 nt, Artificial Sequence
  Synthetic
gccuccuagaacccaggaucac

SEQ ID NO: 7492 - RNA, 23 nt, Artificial Sequence
  Synthetic
ugccuccuagaacccaggaucac

SEQ ID NO: 7493 - RNA, 24 nt, Artificial Sequence
  Synthetic
cugccuccuagaacccaggaucac

SEQ ID NO: 7494 - RNA, 21 nt, Artificial Sequence
  Synthetic
cugaguaguugcccagaagac

SEQ ID NO: 7495 - RNA, 22 nt, Artificial Sequence
  Synthetic
gcugaguaguugcccagaagac

SEQ ID NO: 7496 - RNA, 23 nt, Artificial Sequence
  Synthetic
ggcugaguaguugcccagaagac

SEQ ID NO: 7497 - RNA, 24 nt, Artificial Sequence
  Synthetic
gggcugaguaguugcccagaagac

SEQ ID NO: 7498 - RNA, 18 nt, Artificial Sequence
  Synthetic
uggacugugaaaacugac

SEQ ID NO: 7499 - RNA, 19 nt, Artificial Sequence
  Synthetic
auggacugugaaaacugac

SEQ ID NO: 7500 - RNA, 20 nt, Artificial Sequence
  Synthetic
uauggacugugaaaacugac

SEQ ID NO: 7501 - RNA, 21 nt, Artificial Sequence
  Synthetic
cuauggacugugaaaacugac

SEQ ID NO: 7502 - RNA, 22 nt, Artificial Sequence
  Synthetic
gcuauggacugugaaaacugac

SEQ ID NO: 7503 - RNA, 23 nt, Artificial Sequence
  Synthetic
ugcuauggacugugaaaacugac

SEQ ID NO: 7504 - RNA, 24 nt, Artificial Sequence
  Synthetic
uugcuauggacugugaaaacugac

SEQ ID NO: 7505 - RNA, 18 nt, Artificial Sequence
  Synthetic
cuaaauuacuaguaauac

SEQ ID NO: 7506 - RNA, 19 nt, Artificial Sequence
  Synthetic
gcuaaauuacuaguaauac

SEQ ID NO: 7507 - RNA, 20 nt, Artificial Sequence
  Synthetic
agcuaaauuacuaguaauac

SEQ ID NO: 7508 - RNA, 21 nt, Artificial Sequence
  Synthetic
gagcuaaauuacuaguaauac

SEQ ID NO: 7509 - RNA, 22 nt, Artificial Sequence
  Synthetic
ggagcuaaauuacuaguaauac

SEQ ID NO: 7510 - RNA, 23 nt, Artificial Sequence
  Synthetic
aggagcuaaauuacuaguaauac

SEQ ID NO: 7511 - RNA, 24 nt, Artificial Sequence
  Synthetic
caggagcuaaauuacuaguaauac

SEQ ID NO: 7512 - RNA, 18 nt, Artificial Sequence
  Synthetic
cagagaagacuauggccc

SEQ ID NO: 7513 - RNA, 19 nt, Artificial Sequence
  Synthetic
gcagagaagacuauggccc

SEQ ID NO: 7514 - RNA, 21 nt, Artificial Sequence
  Synthetic
uagcagagaagacuauggccc

SEQ ID NO: 7515 - RNA, 22 nt, Artificial Sequence
  Synthetic
auagcagagaagacuauggccc

SEQ ID NO: 7516 - RNA, 23 nt, Artificial Sequence
  Synthetic
uauagcagagaagacuauggccc

SEQ ID NO: 7517 - RNA, 24 nt, Artificial Sequence
  Synthetic
uuauagcagagaagacuauggccc

SEQ ID NO: 7518 - RNA, 18 nt, Artificial Sequence
  Synthetic
caggucucccgacuuccc

SEQ ID NO: 7519 - RNA, 19 nt, Artificial Sequence
  Synthetic
ucaggucucccgacuuccc

SEQ ID NO: 7520 - RNA, 21 nt, Artificial Sequence
  Synthetic
aaucaggucucccgacuuccc

SEQ ID NO: 7521 - RNA, 22 nt, Artificial Sequence
  Synthetic
aaaucaggucucccgacuuccc

SEQ ID NO: 7522 - RNA, 23 nt, Artificial Sequence
  Synthetic
gaaaucaggucucccgacuuccc

SEQ ID NO: 7523 - RNA, 24 nt, Artificial Sequence
  Synthetic
agaaaucaggucucccgacuuccc

SEQ ID NO: 7524 - RNA, 18 nt, Artificial Sequence
  Synthetic
agggcaggcagggaggcc

SEQ ID NO: 7525 - RNA, 19 nt, Artificial Sequence
  Synthetic
aagggcaggcagggaggcc

SEQ ID NO: 7526 - RNA, 21 nt, Artificial Sequence
  Synthetic
gaaagggcaggcagggaggcc

SEQ ID NO: 7527 - RNA, 22 nt, Artificial Sequence
  Synthetic
agaaagggcaggcagggaggcc

SEQ ID NO: 7528 - RNA, 23 nt, Artificial Sequence
  Synthetic
gagaaagggcaggcagggaggcc

SEQ ID NO: 7529 - RNA, 24 nt, Artificial Sequence
  Synthetic
ggagaaagggcaggcagggaggcc

SEQ ID NO: 7530 - RNA, 18 nt, Artificial Sequence
  Synthetic
gcagagaagacuauggcc

SEQ ID NO: 7531 - RNA, 19 nt, Artificial Sequence
  Synthetic
agcagagaagacuauggcc

SEQ ID NO: 7532 - RNA, 21 nt, Artificial Sequence
  Synthetic
auagcagagaagacuauggcc

SEQ ID NO: 7533 - RNA, 22 nt, Artificial Sequence
  Synthetic
uauagcagagaagacuauggcc

SEQ ID NO: 7534 - RNA, 23 nt, Artificial Sequence
  Synthetic
uuauagcagagaagacuauggcc

SEQ ID NO: 7535 - RNA, 24 nt, Artificial Sequence
  Synthetic
uuuauagcagagaagacuauggcc

SEQ ID NO: 7536 - RNA, 18 nt, Artificial Sequence
  Synthetic
ucugugugugugcaugcc

SEQ ID NO: 7537 - RNA, 19 nt, Artificial Sequence
  Synthetic
cucugugugugugcaugcc

SEQ ID NO: 7538 - RNA, 21 nt, Artificial Sequence
  Synthetic
uacucugugugugugcaugcc

SEQ ID NO: 7539 - RNA, 22 nt, Artificial Sequence
  Synthetic
uuacucugugugugugcaugcc

SEQ ID NO: 7540 - RNA, 23 nt, Artificial Sequence
  Synthetic
cuuacucugugugugugcaugcc

SEQ ID NO: 7541 - RNA, 24 nt, Artificial Sequence
  Synthetic
ucuuacucugugugugugcaugcc

SEQ ID NO: 7542 - RNA, 18 nt, Artificial Sequence
  Synthetic
cagggcugaguaguugcc

SEQ ID NO: 7543 - RNA, 19 nt, Artificial Sequence
  Synthetic
acagggcugaguaguugcc

SEQ ID NO: 7544 - RNA, 21 nt, Artificial Sequence
  Synthetic
ccacagggcugaguaguugcc

SEQ ID NO: 7545 - RNA, 22 nt, Artificial Sequence
  Synthetic
accacagggcugaguaguugcc

SEQ ID NO: 7546 - RNA, 23 nt, Artificial Sequence
  Synthetic
caccacagggcugaguaguugcc

SEQ ID NO: 7547 - RNA, 24 nt, Artificial Sequence
  Synthetic
ccaccacagggcugaguaguugcc

SEQ ID NO: 7548 - RNA, 18 nt, Artificial Sequence
  Synthetic
caauauagcccugccucc

SEQ ID NO: 7549 - RNA, 19 nt, Artificial Sequence
  Synthetic
acaauauagcccugccucc

SEQ ID NO: 7550 - RNA, 21 nt, Artificial Sequence
  Synthetic
ccacaauauagcccugccucc

SEQ ID NO: 7551 - RNA, 22 nt, Artificial Sequence
  Synthetic
cccacaauauagcccugccucc

SEQ ID NO: 7552 - RNA, 23 nt, Artificial Sequence
  Synthetic
ccccacaauauagcccugccucc

SEQ ID NO: 7553 - RNA, 24 nt, Artificial Sequence
  Synthetic
cccccacaauauagcccugccucc

SEQ ID NO: 7554 - RNA, 18 nt, Artificial Sequence
  Synthetic
agcacccuaccaggcucc

SEQ ID NO: 7555 - RNA, 19 nt, Artificial Sequence
  Synthetic
cagcacccuaccaggcucc

SEQ ID NO: 7556 - RNA, 21 nt, Artificial Sequence
  Synthetic
gacagcacccuaccaggcucc

SEQ ID NO: 7557 - RNA, 22 nt, Artificial Sequence
  Synthetic
ggacagcacccuaccaggcucc

SEQ ID NO: 7558 - RNA, 23 nt, Artificial Sequence
  Synthetic
aggacagcacccuaccaggcucc

SEQ ID NO: 7559 - RNA, 24 nt, Artificial Sequence
  Synthetic
aaggacagcacccuaccaggcucc

SEQ ID NO: 7560 - RNA, 18 nt, Artificial Sequence
  Synthetic
uugguucugcaguuaagc

SEQ ID NO: 7561 - RNA, 19 nt, Artificial Sequence
  Synthetic
auugguucugcaguuaagc

SEQ ID NO: 7562 - RNA, 21 nt, Artificial Sequence
  Synthetic
ugauugguucugcaguuaagc

SEQ ID NO: 7563 - RNA, 22 nt, Artificial Sequence
  Synthetic
uugauugguucugcaguuaagc

SEQ ID NO: 7564 - RNA, 23 nt, Artificial Sequence
  Synthetic
uuugauugguucugcaguuaagc

SEQ ID NO: 7565 - RNA, 24 nt, Artificial Sequence
  Synthetic
auuugauugguucugcaguuaagc

SEQ ID NO: 7566 - RNA, 18 nt, Artificial Sequence
  Synthetic
uuaaaaacaagauccagc

SEQ ID NO: 7567 - RNA, 19 nt, Artificial Sequence
  Synthetic
guuaaaaacaagauccagc

SEQ ID NO: 7568 - RNA, 21 nt, Artificial Sequence
  Synthetic
auguuaaaaacaagauccagc

SEQ ID NO: 7569 - RNA, 22 nt, Artificial Sequence
  Synthetic
uauguuaaaaacaagauccagc

SEQ ID NO: 7570 - RNA, 23 nt, Artificial Sequence
  Synthetic
auauguuaaaaacaagauccagc

SEQ ID NO: 7571 - RNA, 24 nt, Artificial Sequence
  Synthetic
aauauguuaaaaacaagauccagc

SEQ ID NO: 7572 - RNA, 18 nt, Artificial Sequence
  Synthetic
cuaggagaaagggcaggc

SEQ ID NO: 7573 - RNA, 19 nt, Artificial Sequence
  Synthetic
ucuaggagaaagggcaggc

SEQ ID NO: 7574 - RNA, 21 nt, Artificial Sequence
  Synthetic
ucucuaggagaaagggcaggc

SEQ ID NO: 7575 - RNA, 22 nt, Artificial Sequence
  Synthetic
gucucuaggagaaagggcaggc

SEQ ID NO: 7576 - RNA, 23 nt, Artificial Sequence
  Synthetic
agucucuaggagaaagggcaggc

SEQ ID NO: 7577 - RNA, 24 nt, Artificial Sequence
  Synthetic
cagucucuaggagaaagggcaggc

SEQ ID NO: 7578 - RNA, 18 nt, Artificial Sequence
  Synthetic
aagggcaggcagggaggc

SEQ ID NO: 7579 - RNA, 19 nt, Artificial Sequence
  Synthetic
aaagggcaggcagggaggc

SEQ ID NO: 7580 - RNA, 20 nt, Artificial Sequence
  Synthetic
gaaagggcaggcagggaggc

SEQ ID NO: 7581 - RNA, 21 nt, Artificial Sequence
  Synthetic
agaaagggcaggcagggaggc

SEQ ID NO: 7582 - RNA, 22 nt, Artificial Sequence
  Synthetic
gagaaagggcaggcagggaggc

SEQ ID NO: 7583 - RNA, 23 nt, Artificial Sequence
  Synthetic
ggagaaagggcaggcagggaggc

SEQ ID NO: 7584 - RNA, 24 nt, Artificial Sequence
  Synthetic
aggagaaagggcaggcagggaggc

SEQ ID NO: 7585 - RNA, 18 nt, Artificial Sequence
  Synthetic
cagucacugcugagcugc

SEQ ID NO: 7586 - RNA, 19 nt, Artificial Sequence
  Synthetic
gcagucacugcugagcugc

SEQ ID NO: 7587 - RNA, 21 nt, Artificial Sequence
  Synthetic
cagcagucacugcugagcugc

SEQ ID NO: 7588 - RNA, 22 nt, Artificial Sequence
  Synthetic
ucagcagucacugcugagcugc

SEQ ID NO: 7589 - RNA, 23 nt, Artificial Sequence
  Synthetic
gucagcagucacugcugagcugc

SEQ ID NO: 7590 - RNA, 24 nt, Artificial Sequence
  Synthetic
ugucagcagucacugcugagcugc

SEQ ID NO: 7591 - RNA, 18 nt, Artificial Sequence
  Synthetic
aaccucauuggugaaauc

SEQ ID NO: 7592 - RNA, 19 nt, Artificial Sequence
  Synthetic
gaaccucauuggugaaauc

SEQ ID NO: 7593 - RNA, 21 nt, Artificial Sequence
  Synthetic
aagaaccucauuggugaaauc

SEQ ID NO: 7594 - RNA, 22 nt, Artificial Sequence
  Synthetic
caagaaccucauuggugaaauc

SEQ ID NO: 7595 - RNA, 23 nt, Artificial Sequence
  Synthetic
ccaagaaccucauuggugaaauc

SEQ ID NO: 7596 - RNA, 24 nt, Artificial Sequence
  Synthetic
gccaagaaccucauuggugaaauc

SEQ ID NO: 7597 - RNA, 18 nt, Artificial Sequence
  Synthetic
cagcacccuaccaggcuc

SEQ ID NO: 7598 - RNA, 19 nt, Artificial Sequence
  Synthetic
acagcacccuaccaggcuc

SEQ ID NO: 7599 - RNA, 21 nt, Artificial Sequence
  Synthetic
ggacagcacccuaccaggcuc

SEQ ID NO: 7600 - RNA, 22 nt, Artificial Sequence
  Synthetic
aggacagcacccuaccaggcuc

SEQ ID NO: 7601 - RNA, 23 nt, Artificial Sequence
  Synthetic
aaggacagcacccuaccaggcuc

SEQ ID NO: 7602 - RNA, 24 nt, Artificial Sequence
  Synthetic
caaggacagcacccuaccaggcuc

SEQ ID NO: 7603 - RNA, 18 nt, Artificial Sequence
  Synthetic
aaucuaaaugaagcucuc

SEQ ID NO: 7604 - RNA, 19 nt, Artificial Sequence
  Synthetic
uaaucuaaaugaagcucuc

SEQ ID NO: 7605 - RNA, 21 nt, Artificial Sequence
  Synthetic
acuaaucuaaaugaagcucuc

SEQ ID NO: 7606 - RNA, 22 nt, Artificial Sequence
  Synthetic
cacuaaucuaaaugaagcucuc

SEQ ID NO: 7607 - RNA, 23 nt, Artificial Sequence
  Synthetic
ccacuaaucuaaaugaagcucuc

SEQ ID NO: 7608 - RNA, 24 nt, Artificial Sequence
  Synthetic
accacuaaucuaaaugaagcucuc

SEQ ID NO: 7609 - RNA, 18 nt, Artificial Sequence
  Synthetic
ugcuagcugugcagucuc

SEQ ID NO: 7610 - RNA, 19 nt, Artificial Sequence
  Synthetic
gugcuagcugugcagucuc

SEQ ID NO: 7611 - RNA, 20 nt, Artificial Sequence
  Synthetic
ugugcuagcugugcagucuc

SEQ ID NO: 7612 - RNA, 21 nt, Artificial Sequence
  Synthetic
uugugcuagcugugcagucuc

SEQ ID NO: 7613 - RNA, 22 nt, Artificial Sequence
  Synthetic
cuugugcuagcugugcagucuc

SEQ ID NO: 7614 - RNA, 23 nt, Artificial Sequence
  Synthetic
ucuugugcuagcugugcagucuc

SEQ ID NO: 7615 - RNA, 24 nt, Artificial Sequence
  Synthetic
gucuugugcuagcugugcagucuc

SEQ ID NO: 7616 - RNA, 18 nt, Artificial Sequence
  Synthetic
gcauuguggcucucgguc

SEQ ID NO: 7617 - RNA, 19 nt, Artificial Sequence
  Synthetic
agcauuguggcucucgguc

SEQ ID NO: 7618 - RNA, 21 nt, Artificial Sequence
  Synthetic
gaagcauuguggcucucgguc

SEQ ID NO: 7619 - RNA, 22 nt, Artificial Sequence
  Synthetic
ugaagcauuguggcucucgguc

SEQ ID NO: 7620 - RNA, 23 nt, Artificial Sequence
  Synthetic
cugaagcauuguggcucucgguc

SEQ ID NO: 7621 - RNA, 24 nt, Artificial Sequence
  Synthetic
ccugaagcauuguggcucucgguc

SEQ ID NO: 7622 - RNA, 18 nt, Artificial Sequence
  Synthetic
uggguucauugagcuuuc

SEQ ID NO: 7623 - RNA, 19 nt, Artificial Sequence
  Synthetic
uuggguucauugagcuuuc

SEQ ID NO: 7624 - RNA, 21 nt, Artificial Sequence
  Synthetic
uguuggguucauugagcuuuc

SEQ ID NO: 7625 - RNA, 22 nt, Artificial Sequence
  Synthetic
cuguuggguucauugagcuuuc

SEQ ID NO: 7626 - RNA, 23 nt, Artificial Sequence
  Synthetic
gcuguuggguucauugagcuuuc

SEQ ID NO: 7627 - RNA, 24 nt, Artificial Sequence
  Synthetic
ggcuguuggguucauugagcuuuc

SEQ ID NO: 7628 - RNA, 18 nt, Artificial Sequence
  Synthetic
gacuauggcccagggaag

SEQ ID NO: 7629 - RNA, 19 nt, Artificial Sequence
  Synthetic
agacuauggcccagggaag

SEQ ID NO: 7630 - RNA, 21 nt, Artificial Sequence
  Synthetic
gaagacuauggcccagggaag

SEQ ID NO: 7631 - RNA, 22 nt, Artificial Sequence
  Synthetic
agaagacuauggcccagggaag

SEQ ID NO: 7632 - RNA, 23 nt, Artificial Sequence
  Synthetic
gagaagacuauggcccagggaag

SEQ ID NO: 7633 - RNA, 24 nt, Artificial Sequence
  Synthetic
agagaagacuauggcccagggaag

SEQ ID NO: 7634 - RNA, 18 nt, Artificial Sequence
  Synthetic
aaaagaguuccuaauaag

SEQ ID NO: 7635 - RNA, 19 nt, Artificial Sequence
  Synthetic
aaaaagaguuccuaauaag

SEQ ID NO: 7636 - RNA, 21 nt, Artificial Sequence
  Synthetic
agaaaaagaguuccuaauaag

SEQ ID NO: 7637 - RNA, 22 nt, Artificial Sequence
  Synthetic
gagaaaaagaguuccuaauaag

SEQ ID NO: 7638 - RNA, 23 nt, Artificial Sequence
  Synthetic
agagaaaaagaguuccuaauaag

SEQ ID NO: 7639 - RNA, 24 nt, Artificial Sequence
  Synthetic
cagagaaaaagaguuccuaauaag

SEQ ID NO: 7640 - RNA, 18 nt, Artificial Sequence
  Synthetic
guuaaaaacaagauccag

SEQ ID NO: 7641 - RNA, 19 nt, Artificial Sequence
  Synthetic
uguuaaaaacaagauccag

SEQ ID NO: 7642 - RNA, 21 nt, Artificial Sequence
  Synthetic
uauguuaaaaacaagauccag

SEQ ID NO: 7643 - RNA, 22 nt, Artificial Sequence
  Synthetic
auauguuaaaaacaagauccag

SEQ ID NO: 7644 - RNA, 23 nt, Artificial Sequence
  Synthetic
aauauguuaaaaacaagauccag

SEQ ID NO: 7645 - RNA, 24 nt, Artificial Sequence
  Synthetic
uaauauguuaaaaacaagauccag

SEQ ID NO: 7646 - RNA, 18 nt, Artificial Sequence
  Synthetic
gcagacucaccuccagag

SEQ ID NO: 7647 - RNA, 19 nt, Artificial Sequence
  Synthetic
ggcagacucaccuccagag

SEQ ID NO: 7648 - RNA, 21 nt, Artificial Sequence
  Synthetic
cuggcagacucaccuccagag

SEQ ID NO: 7649 - RNA, 22 nt, Artificial Sequence
  Synthetic
ccuggcagacucaccuccagag

SEQ ID NO: 7650 - RNA, 23 nt, Artificial Sequence
  Synthetic
cccuggcagacucaccuccagag

SEQ ID NO: 7651 - RNA, 24 nt, Artificial Sequence
  Synthetic
gcccuggcagacucaccuccagag

SEQ ID NO: 7652 - RNA, 18 nt, Artificial Sequence
  Synthetic
cugcaagggucuuuauag

SEQ ID NO: 7653 - RNA, 19 nt, Artificial Sequence
  Synthetic
gcugcaagggucuuuauag

SEQ ID NO: 7654 - RNA, 21 nt, Artificial Sequence
  Synthetic
gagcugcaagggucuuuauag

SEQ ID NO: 7655 - RNA, 22 nt, Artificial Sequence
  Synthetic
agagcugcaagggucuuuauag

SEQ ID NO: 7656 - RNA, 23 nt, Artificial Sequence
  Synthetic
gagagcugcaagggucuuuauag

SEQ ID NO: 7657 - RNA, 24 nt, Artificial Sequence
  Synthetic
cgagagcugcaagggucuuuauag

SEQ ID NO: 7658 - RNA, 18 nt, Artificial Sequence
  Synthetic
uagcugugcagucucuag

SEQ ID NO: 7659 - RNA, 19 nt, Artificial Sequence
  Synthetic
cuagcugugcagucucuag

SEQ ID NO: 7660 - RNA, 20 nt, Artificial Sequence
  Synthetic
gcuagcugugcagucucuag

SEQ ID NO: 7661 - RNA, 21 nt, Artificial Sequence
  Synthetic
ugcuagcugugcagucucuag

SEQ ID NO: 7662 - RNA, 22 nt, Artificial Sequence
  Synthetic
gugcuagcugugcagucucuag

SEQ ID NO: 7663 - RNA, 23 nt, Artificial Sequence
  Synthetic
ugugcuagcugugcagucucuag

SEQ ID NO: 7664 - RNA, 24 nt, Artificial Sequence
  Synthetic
uugugcuagcugugcagucucuag

SEQ ID NO: 7665 - RNA, 18 nt, Artificial Sequence
  Synthetic
aucagauaguaaacaucg

SEQ ID NO: 7666 - RNA, 19 nt, Artificial Sequence
  Synthetic
aaucagauaguaaacaucg

SEQ ID NO: 7667 - RNA, 21 nt, Artificial Sequence
  Synthetic
ugaaucagauaguaaacaucg

SEQ ID NO: 7668 - RNA, 22 nt, Artificial Sequence
  Synthetic
cugaaucagauaguaaacaucg

SEQ ID NO: 7669 - RNA, 23 nt, Artificial Sequence
  Synthetic
ucugaaucagauaguaaacaucg

SEQ ID NO: 7670 - RNA, 24 nt, Artificial Sequence
  Synthetic
uucugaaucagauaguaaacaucg

SEQ ID NO: 7671 - RNA, 18 nt, Artificial Sequence
  Synthetic
acccuaccaggcuccagg

SEQ ID NO: 7672 - RNA, 19 nt, Artificial Sequence
  Synthetic
cacccuaccaggcuccagg

SEQ ID NO: 7673 - RNA, 21 nt, Artificial Sequence
  Synthetic
agcacccuaccaggcuccagg

SEQ ID NO: 7674 - RNA, 22 nt, Artificial Sequence
  Synthetic
cagcacccuaccaggcuccagg

SEQ ID NO: 7675 - RNA, 23 nt, Artificial Sequence
  Synthetic
acagcacccuaccaggcuccagg

SEQ ID NO: 7676 - RNA, 24 nt, Artificial Sequence
  Synthetic
gacagcacccuaccaggcuccagg

SEQ ID NO: 7677 - RNA, 18 nt, Artificial Sequence
  Synthetic
ucuaggagaaagggcagg

SEQ ID NO: 7678 - RNA, 19 nt, Artificial Sequence
  Synthetic
cucuaggagaaagggcagg

SEQ ID NO: 7679 - RNA, 20 nt, Artificial Sequence
  Synthetic
ucucuaggagaaagggcagg

SEQ ID NO: 7680 - RNA, 21 nt, Artificial Sequence
  Synthetic
gucucuaggagaaagggcagg

SEQ ID NO: 7681 - RNA, 22 nt, Artificial Sequence
  Synthetic
agucucuaggagaaagggcagg

SEQ ID NO: 7682 - RNA, 23 nt, Artificial Sequence
  Synthetic
cagucucuaggagaaagggcagg

SEQ ID NO: 7683 - RNA, 24 nt, Artificial Sequence
  Synthetic
gcagucucuaggagaaagggcagg

SEQ ID NO: 7684 - RNA, 18 nt, Artificial Sequence
  Synthetic
cguggggugcuggucagg

SEQ ID NO: 7685 - RNA, 19 nt, Artificial Sequence
  Synthetic
gcguggggugcuggucagg

SEQ ID NO: 7686 - RNA, 21 nt, Artificial Sequence
  Synthetic
cugcguggggugcuggucagg

SEQ ID NO: 7687 - RNA, 22 nt, Artificial Sequence
  Synthetic
gcugcguggggugcuggucagg

SEQ ID NO: 7688 - RNA, 23 nt, Artificial Sequence
  Synthetic
agcugcguggggugcuggucagg

SEQ ID NO: 7689 - RNA, 24 nt, Artificial Sequence
  Synthetic
gagcugcguggggugcuggucagg

SEQ ID NO: 7690 - RNA, 18 nt, Artificial Sequence
  Synthetic
gaagacuauggcccaggg

SEQ ID NO: 7691 - RNA, 19 nt, Artificial Sequence
  Synthetic
agaagacuauggcccaggg

SEQ ID NO: 7692 - RNA, 21 nt, Artificial Sequence
  Synthetic
agagaagacuauggcccaggg

SEQ ID NO: 7693 - RNA, 22 nt, Artificial Sequence
  Synthetic
cagagaagacuauggcccaggg

SEQ ID NO: 7694 - RNA, 23 nt, Artificial Sequence
  Synthetic
gcagagaagacuauggcccaggg

SEQ ID NO: 7695 - RNA, 24 nt, Artificial Sequence
  Synthetic
agcagagaagacuauggcccaggg

SEQ ID NO: 7696 - RNA, 18 nt, Artificial Sequence
  Synthetic
cauugucuaugcuuaggg

SEQ ID NO: 7697 - RNA, 19 nt, Artificial Sequence
  Synthetic
ccauugucuaugcuuaggg

SEQ ID NO: 7698 - RNA, 21 nt, Artificial Sequence
  Synthetic
ugccauugucuaugcuuaggg

SEQ ID NO: 7699 - RNA, 22 nt, Artificial Sequence
  Synthetic
augccauugucuaugcuuaggg

SEQ ID NO: 7700 - RNA, 23 nt, Artificial Sequence
  Synthetic
aaugccauugucuaugcuuaggg

SEQ ID NO: 7701 - RNA, 24 nt, Artificial Sequence
  Synthetic
aaaugccauugucuaugcuuaggg

SEQ ID NO: 7702 - RNA, 18 nt, Artificial Sequence
  Synthetic
cgcacagccaaccaaugg

SEQ ID NO: 7703 - RNA, 19 nt, Artificial Sequence
  Synthetic
ucgcacagccaaccaaugg

SEQ ID NO: 7704 - RNA, 21 nt, Artificial Sequence
  Synthetic
ggucgcacagccaaccaaugg

SEQ ID NO: 7705 - RNA, 22 nt, Artificial Sequence
  Synthetic
cggucgcacagccaaccaaugg

SEQ ID NO: 7706 - RNA, 23 nt, Artificial Sequence
  Synthetic
acggucgcacagccaaccaaugg

SEQ ID NO: 7707 - RNA, 24 nt, Artificial Sequence
  Synthetic
cacggucgcacagccaaccaaugg

SEQ ID NO: 7708 - RNA, 18 nt, Artificial Sequence
  Synthetic
cugugaaaacugacaugg

SEQ ID NO: 7709 - RNA, 19 nt, Artificial Sequence
  Synthetic
acugugaaaacugacaugg

SEQ ID NO: 7710 - RNA, 21 nt, Artificial Sequence
  Synthetic
ggacugugaaaacugacaugg

SEQ ID NO: 7711 - RNA, 22 nt, Artificial Sequence
  Synthetic
uggacugugaaaacugacaugg

SEQ ID NO: 7712 - RNA, 23 nt, Artificial Sequence
  Synthetic
auggacugugaaaacugacaugg

SEQ ID NO: 7713 - RNA, 24 nt, Artificial Sequence
  Synthetic
uauggacugugaaaacugacaugg

SEQ ID NO: 7714 - RNA, 18 nt, Artificial Sequence
  Synthetic
acaacuguguaucuuugg

SEQ ID NO: 7715 - RNA, 19 nt, Artificial Sequence
  Synthetic
aacaacuguguaucuuugg

SEQ ID NO: 7716 - RNA, 21 nt, Artificial Sequence
  Synthetic
aaaacaacuguguaucuuugg

SEQ ID NO: 7717 - RNA, 22 nt, Artificial Sequence
  Synthetic
uaaaacaacuguguaucuuugg

SEQ ID NO: 7718 - RNA, 23 nt, Artificial Sequence
  Synthetic
uuaaaacaacuguguaucuuugg

SEQ ID NO: 7719 - RNA, 24 nt, Artificial Sequence
  Synthetic
uuuaaaacaacuguguaucuuugg

SEQ ID NO: 7720 - RNA, 18 nt, Artificial Sequence
  Synthetic
acugugaaaacugacaug

SEQ ID NO: 7721 - RNA, 19 nt, Artificial Sequence
  Synthetic
gacugugaaaacugacaug

SEQ ID NO: 7722 - RNA, 20 nt, Artificial Sequence
  Synthetic
ggacugugaaaacugacaug

SEQ ID NO: 7723 - RNA, 21 nt, Artificial Sequence
  Synthetic
uggacugugaaaacugacaug

SEQ ID NO: 7724 - RNA, 22 nt, Artificial Sequence
  Synthetic
auggacugugaaaacugacaug

SEQ ID NO: 7725 - RNA, 23 nt, Artificial Sequence
  Synthetic
uauggacugugaaaacugacaug

SEQ ID NO: 7726 - RNA, 24 nt, Artificial Sequence
  Synthetic
cuauggacugugaaaacugacaug

SEQ ID NO: 7727 - RNA, 18 nt, Artificial Sequence
  Synthetic
ugcugucagcagucacug

SEQ ID NO: 7728 - RNA, 19 nt, Artificial Sequence
  Synthetic
gugcugucagcagucacug

SEQ ID NO: 7729 - RNA, 21 nt, Artificial Sequence
  Synthetic
ccgugcugucagcagucacug

SEQ ID NO: 7730 - RNA, 22 nt, Artificial Sequence
  Synthetic
uccgugcugucagcagucacug

SEQ ID NO: 7731 - RNA, 23 nt, Artificial Sequence
  Synthetic
cuccgugcugucagcagucacug

SEQ ID NO: 7732 - RNA, 24 nt, Artificial Sequence
  Synthetic
acuccgugcugucagcagucacug

SEQ ID NO: 7733 - RNA, 18 nt, Artificial Sequence
  Synthetic
cgugaucagugaggacug

SEQ ID NO: 7734 - RNA, 19 nt, Artificial Sequence
  Synthetic
acgugaucagugaggacug

SEQ ID NO: 7735 - RNA, 21 nt, Artificial Sequence
  Synthetic
ugacgugaucagugaggacug

SEQ ID NO: 7736 - RNA, 22 nt, Artificial Sequence
  Synthetic
cugacgugaucagugaggacug

SEQ ID NO: 7737 - RNA, 23 nt, Artificial Sequence
  Synthetic
ucugacgugaucagugaggacug

SEQ ID NO: 7738 - RNA, 24 nt, Artificial Sequence
  Synthetic
gucugacgugaucagugaggacug

SEQ ID NO: 7739 - RNA, 18 nt, Artificial Sequence
  Synthetic
uacgagccauaucaccug

SEQ ID NO: 7740 - RNA, 19 nt, Artificial Sequence
  Synthetic
cuacgagccauaucaccug

SEQ ID NO: 7741 - RNA, 20 nt, Artificial Sequence
  Synthetic
acuacgagccauaucaccug

SEQ ID NO: 7742 - RNA, 21 nt, Artificial Sequence
  Synthetic
cacuacgagccauaucaccug

SEQ ID NO: 7743 - RNA, 22 nt, Artificial Sequence
  Synthetic
ucacuacgagccauaucaccug

SEQ ID NO: 7744 - RNA, 23 nt, Artificial Sequence
  Synthetic
gucacuacgagccauaucaccug

SEQ ID NO: 7745 - RNA, 24 nt, Artificial Sequence
  Synthetic
ggucacuacgagccauaucaccug

SEQ ID NO: 7746 - RNA, 18 nt, Artificial Sequence
  Synthetic
ccucauuggugaaaucug

SEQ ID NO: 7747 - RNA, 19 nt, Artificial Sequence
  Synthetic
accucauuggugaaaucug

SEQ ID NO: 7748 - RNA, 21 nt, Artificial Sequence
  Synthetic
gaaccucauuggugaaaucug

SEQ ID NO: 7749 - RNA, 22 nt, Artificial Sequence
  Synthetic
agaaccucauuggugaaaucug

SEQ ID NO: 7750 - RNA, 23 nt, Artificial Sequence
  Synthetic
aagaaccucauuggugaaaucug

SEQ ID NO: 7751 - RNA, 24 nt, Artificial Sequence
  Synthetic
caagaaccucauuggugaaaucug

SEQ ID NO: 7752 - RNA, 18 nt, Artificial Sequence
  Synthetic
agacucaccuccagagug

SEQ ID NO: 7753 - RNA, 19 nt, Artificial Sequence
  Synthetic
cagacucaccuccagagug

SEQ ID NO: 7754 - RNA, 21 nt, Artificial Sequence
  Synthetic
ggcagacucaccuccagagug

SEQ ID NO: 7755 - RNA, 22 nt, Artificial Sequence
  Synthetic
uggcagacucaccuccagagug

SEQ ID NO: 7756 - RNA, 23 nt, Artificial Sequence
  Synthetic
cuggcagacucaccuccagagug

SEQ ID NO: 7757 - RNA, 24 nt, Artificial Sequence
  Synthetic
ccuggcagacucaccuccagagug

SEQ ID NO: 7758 - RNA, 18 nt, Artificial Sequence
  Synthetic
augccaagaaccucauug

SEQ ID NO: 7759 - RNA, 19 nt, Artificial Sequence
  Synthetic
caugccaagaaccucauug

SEQ ID NO: 7760 - RNA, 21 nt, Artificial Sequence
  Synthetic
ugcaugccaagaaccucauug

SEQ ID NO: 7761 - RNA, 22 nt, Artificial Sequence
  Synthetic
gugcaugccaagaaccucauug

SEQ ID NO: 7762 - RNA, 23 nt, Artificial Sequence
  Synthetic
ugugcaugccaagaaccucauug

SEQ ID NO: 7763 - RNA, 24 nt, Artificial Sequence
  Synthetic
gugugcaugccaagaaccucauug

SEQ ID NO: 7764 - RNA, 18 nt, Artificial Sequence
  Synthetic
gaaccucauuggugaaau

SEQ ID NO: 7765 - RNA, 19 nt, Artificial Sequence
  Synthetic
agaaccucauuggugaaau

SEQ ID NO: 7766 - RNA, 21 nt, Artificial Sequence
  Synthetic
caagaaccucauuggugaaau

SEQ ID NO: 7767 - RNA, 22 nt, Artificial Sequence
  Synthetic
ccaagaaccucauuggugaaau

SEQ ID NO: 7768 - RNA, 23 nt, Artificial Sequence
  Synthetic
gccaagaaccucauuggugaaau

SEQ ID NO: 7769 - RNA, 24 nt, Artificial Sequence
  Synthetic
ugccaagaaccucauuggugaaau

SEQ ID NO: 7770 - RNA, 18 nt, Artificial Sequence
  Synthetic
aaagguacaaauaacaau

SEQ ID NO: 7771 - RNA, 19 nt, Artificial Sequence
  Synthetic
aaaagguacaaauaacaau

SEQ ID NO: 7772 - RNA, 20 nt, Artificial Sequence
  Synthetic
caaaagguacaaauaacaau

SEQ ID NO: 7773 - RNA, 21 nt, Artificial Sequence
  Synthetic
ucaaaagguacaaauaacaau

SEQ ID NO: 7774 - RNA, 22 nt, Artificial Sequence
  Synthetic
aucaaaagguacaaauaacaau

SEQ ID NO: 7775 - RNA, 23 nt, Artificial Sequence
  Synthetic
caucaaaagguacaaauaacaau

SEQ ID NO: 7776 - RNA, 24 nt, Artificial Sequence
  Synthetic
acaucaaaagguacaaauaacaau

SEQ ID NO: 7777 - RNA, 18 nt, Artificial Sequence
  Synthetic
agaaaaagaguuccuaau

SEQ ID NO: 7778 - RNA, 19 nt, Artificial Sequence
  Synthetic
gagaaaaagaguuccuaau

SEQ ID NO: 7779 - RNA, 21 nt, Artificial Sequence
  Synthetic
cagagaaaaagaguuccuaau

SEQ ID NO: 7780 - RNA, 22 nt, Artificial Sequence
  Synthetic
acagagaaaaagaguuccuaau

SEQ ID NO: 7781 - RNA, 23 nt, Artificial Sequence
  Synthetic
cacagagaaaaagaguuccuaau

SEQ ID NO: 7782 - RNA, 24 nt, Artificial Sequence
  Synthetic
ccacagagaaaaagaguuccuaau

SEQ ID NO: 7783 - RNA, 18 nt, Artificial Sequence
  Synthetic
aaaggaaaaauauaguau

SEQ ID NO: 7784 - RNA, 19 nt, Artificial Sequence
  Synthetic
uaaaggaaaaauauaguau

SEQ ID NO: 7785 - RNA, 21 nt, Artificial Sequence
  Synthetic
uguaaaggaaaaauauaguau

SEQ ID NO: 7786 - RNA, 22 nt, Artificial Sequence
  Synthetic
uuguaaaggaaaaauauaguau

SEQ ID NO: 7787 - RNA, 23 nt, Artificial Sequence
  Synthetic
cuuguaaaggaaaaauauaguau

SEQ ID NO: 7788 - RNA, 24 nt, Artificial Sequence
  Synthetic
gcuuguaaaggaaaaauauaguau

SEQ ID NO: 7789 - RNA, 18 nt, Artificial Sequence
  Synthetic
uggaggggcacaagaacu

SEQ ID NO: 7790 - RNA, 19 nt, Artificial Sequence
  Synthetic
auggaggggcacaagaacu

SEQ ID NO: 7791 - RNA, 20 nt, Artificial Sequence
  Synthetic
cauggaggggcacaagaacu

SEQ ID NO: 7792 - RNA, 21 nt, Artificial Sequence
  Synthetic
acauggaggggcacaagaacu

SEQ ID NO: 7793 - RNA, 22 nt, Artificial Sequence
  Synthetic
gacauggaggggcacaagaacu

SEQ ID NO: 7794 - RNA, 23 nt, Artificial Sequence
  Synthetic
ugacauggaggggcacaagaacu

SEQ ID NO: 7795 - RNA, 24 nt, Artificial Sequence
  Synthetic
cugacauggaggggcacaagaacu

SEQ ID NO: 7796 - RNA, 18 nt, Artificial Sequence
  Synthetic
cgccuguagcaggucacu

SEQ ID NO: 7797 - RNA, 19 nt, Artificial Sequence
  Synthetic
gcgccuguagcaggucacu

SEQ ID NO: 7798 - RNA, 20 nt, Artificial Sequence
  Synthetic
agcgccuguagcaggucacu

SEQ ID NO: 7799 - RNA, 21 nt, Artificial Sequence
  Synthetic
gagcgccuguagcaggucacu

SEQ ID NO: 7800 - RNA, 22 nt, Artificial Sequence
  Synthetic
ggagcgccuguagcaggucacu

SEQ ID NO: 7801 - RNA, 23 nt, Artificial Sequence
  Synthetic
uggagcgccuguagcaggucacu

SEQ ID NO: 7802 - RNA, 24 nt, Artificial Sequence
  Synthetic
cuggagcgccuguagcaggucacu

SEQ ID NO: 7803 - RNA, 18 nt, Artificial Sequence
  Synthetic
cuccuuuugcuauggacu

SEQ ID NO: 7804 - RNA, 19 nt, Artificial Sequence
  Synthetic
ucuccuuuugcuauggacu

SEQ ID NO: 7805 - RNA, 20 nt, Artificial Sequence
  Synthetic
uucuccuuuugcuauggacu

SEQ ID NO: 7806 - RNA, 21 nt, Artificial Sequence
  Synthetic
uuucuccuuuugcuauggacu

SEQ ID NO: 7807 - RNA, 22 nt, Artificial Sequence
  Synthetic
auuucuccuuuugcuauggacu

SEQ ID NO: 7808 - RNA, 23 nt, Artificial Sequence
  Synthetic
uauuucuccuuuugcuauggacu

SEQ ID NO: 7809 - RNA, 24 nt, Artificial Sequence
  Synthetic
uuauuucuccuuuugcuauggacu

SEQ ID NO: 7810 - RNA, 18 nt, Artificial Sequence
  Synthetic
uugaaauaaugauugccu

SEQ ID NO: 7811 - RNA, 19 nt, Artificial Sequence
  Synthetic
cuugaaauaaugauugccu

SEQ ID NO: 7812 - RNA, 21 nt, Artificial Sequence
  Synthetic
cacuugaaauaaugauugccu

SEQ ID NO: 7813 - RNA, 22 nt, Artificial Sequence
  Synthetic
ccacuugaaauaaugauugccu

SEQ ID NO: 7814 - RNA, 23 nt, Artificial Sequence
  Synthetic
gccacuugaaauaaugauugccu

SEQ ID NO: 7815 - RNA, 24 nt, Artificial Sequence
  Synthetic
agccacuugaaauaaugauugccu

SEQ ID NO: 7816 - RNA, 18 nt, Artificial Sequence
  Synthetic
aaugccauugucuaugcu

SEQ ID NO: 7817 - RNA, 19 nt, Artificial Sequence
  Synthetic
aaaugccauugucuaugcu

SEQ ID NO: 7818 - RNA, 21 nt, Artificial Sequence
  Synthetic
gcaaaugccauugucuaugcu

SEQ ID NO: 7819 - RNA, 22 nt, Artificial Sequence
  Synthetic
ggcaaaugccauugucuaugcu

SEQ ID NO: 7820 - RNA, 23 nt, Artificial Sequence
  Synthetic
uggcaaaugccauugucuaugcu

SEQ ID NO: 7821 - RNA, 24 nt, Artificial Sequence
  Synthetic
uuggcaaaugccauugucuaugcu

SEQ ID NO: 7822 - RNA, 18 nt, Artificial Sequence
  Synthetic
uuuauuucuccuuuugcu

SEQ ID NO: 7823 - RNA, 19 nt, Artificial Sequence
  Synthetic
uuuuauuucuccuuuugcu

SEQ ID NO: 7824 - RNA, 20 nt, Artificial Sequence
  Synthetic
cuuuuauuucuccuuuugcu

SEQ ID NO: 7825 - RNA, 21 nt, Artificial Sequence
  Synthetic
ccuuuuauuucuccuuuugcu

SEQ ID NO: 7826 - RNA, 22 nt, Artificial Sequence
  Synthetic
uccuuuuauuucuccuuuugcu

SEQ ID NO: 7827 - RNA, 23 nt, Artificial Sequence
  Synthetic
guccuuuuauuucuccuuuugcu

SEQ ID NO: 7828 - RNA, 24 nt, Artificial Sequence
  Synthetic
gguccuuuuauuucuccuuuugcu

SEQ ID NO: 7829 - RNA, 18 nt, Artificial Sequence
  Synthetic
accucauuggugaaaucu

SEQ ID NO: 7830 - RNA, 19 nt, Artificial Sequence
  Synthetic
aaccucauuggugaaaucu

SEQ ID NO: 7831 - RNA, 21 nt, Artificial Sequence
  Synthetic
agaaccucauuggugaaaucu

SEQ ID NO: 7832 - RNA, 22 nt, Artificial Sequence
  Synthetic
aagaaccucauuggugaaaucu

SEQ ID NO: 7833 - RNA, 23 nt, Artificial Sequence
  Synthetic
caagaaccucauuggugaaaucu

SEQ ID NO: 7834 - RNA, 24 nt, Artificial Sequence
  Synthetic
ccaagaaccucauuggugaaaucu

SEQ ID NO: 7835 - RNA, 18 nt, Artificial Sequence
  Synthetic
uaaaacaacuguguaucu

SEQ ID NO: 7836 - RNA, 19 nt, Artificial Sequence
  Synthetic
uuaaaacaacuguguaucu

SEQ ID NO: 7837 - RNA, 21 nt, Artificial Sequence
  Synthetic
cuuuaaaacaacuguguaucu

SEQ ID NO: 7838 - RNA, 22 nt, Artificial Sequence
  Synthetic
gcuuuaaaacaacuguguaucu

SEQ ID NO: 7839 - RNA, 23 nt, Artificial Sequence
  Synthetic
agcuuuaaaacaacuguguaucu

SEQ ID NO: 7840 - RNA, 24 nt, Artificial Sequence
  Synthetic
uagcuuuaaaacaacuguguaucu

SEQ ID NO: 7841 - RNA, 18 nt, Artificial Sequence
  Synthetic
ucuguuuggcuuuacucu

SEQ ID NO: 7842 - RNA, 19 nt, Artificial Sequence
  Synthetic
aucuguuuggcuuuacucu

SEQ ID NO: 7843 - RNA, 21 nt, Artificial Sequence
  Synthetic
gaaucuguuuggcuuuacucu

SEQ ID NO: 7844 - RNA, 22 nt, Artificial Sequence
  Synthetic
ugaaucuguuuggcuuuacucu

SEQ ID NO: 7845 - RNA, 23 nt, Artificial Sequence
  Synthetic
uugaaucuguuuggcuuuacucu

SEQ ID NO: 7846 - RNA, 24 nt, Artificial Sequence
  Synthetic
cuugaaucuguuuggcuuuacucu

SEQ ID NO: 7847 - RNA, 18 nt, Artificial Sequence
  Synthetic
uaaucuaaaugaagcucu

SEQ ID NO: 7848 - RNA, 19 nt, Artificial Sequence
  Synthetic
cuaaucuaaaugaagcucu

SEQ ID NO: 7849 - RNA, 20 nt, Artificial Sequence
  Synthetic
acuaaucuaaaugaagcucu

SEQ ID NO: 7850 - RNA, 21 nt, Artificial Sequence
  Synthetic
cacuaaucuaaaugaagcucu

SEQ ID NO: 7851 - RNA, 22 nt, Artificial Sequence
  Synthetic
ccacuaaucuaaaugaagcucu

SEQ ID NO: 7852 - RNA, 23 nt, Artificial Sequence
  Synthetic
accacuaaucuaaaugaagcucu

SEQ ID NO: 7853 - RNA, 24 nt, Artificial Sequence
  Synthetic
aaccacuaaucuaaaugaagcucu

SEQ ID NO: 7854 - RNA, 18 nt, Artificial Sequence
  Synthetic
gcuagcugugcagucucu

SEQ ID NO: 7855 - RNA, 19 nt, Artificial Sequence
  Synthetic
ugcuagcugugcagucucu

SEQ ID NO: 7856 - RNA, 21 nt, Artificial Sequence
  Synthetic
ugugcuagcugugcagucucu

SEQ ID NO: 7857 - RNA, 22 nt, Artificial Sequence
  Synthetic
uugugcuagcugugcagucucu

SEQ ID NO: 7858 - RNA, 23 nt, Artificial Sequence
  Synthetic
cuugugcuagcugugcagucucu

SEQ ID NO: 7859 - RNA, 24 nt, Artificial Sequence
  Synthetic
ucuugugcuagcugugcagucucu

SEQ ID NO: 7860 - RNA, 18 nt, Artificial Sequence
  Synthetic
aaucuggggaacucuucu

SEQ ID NO: 7861 - RNA, 19 nt, Artificial Sequence
  Synthetic
aaaucuggggaacucuucu

SEQ ID NO: 7862 - RNA, 21 nt, Artificial Sequence
  Synthetic
ugaaaucuggggaacucuucu

SEQ ID NO: 7863 - RNA, 22 nt, Artificial Sequence
  Synthetic
gugaaaucuggggaacucuucu

SEQ ID NO: 7864 - RNA, 23 nt, Artificial Sequence
  Synthetic
ggugaaaucuggggaacucuucu

SEQ ID NO: 7865 - RNA, 24 nt, Artificial Sequence
  Synthetic
uggugaaaucuggggaacucuucu

SEQ ID NO: 7866 - RNA, 18 nt, Artificial Sequence
  Synthetic
gagucugacgugaucagu

SEQ ID NO: 7867 - RNA, 19 nt, Artificial Sequence
  Synthetic
ggagucugacgugaucagu

SEQ ID NO: 7868 - RNA, 21 nt, Artificial Sequence
  Synthetic
cuggagucugacgugaucagu

SEQ ID NO: 7869 - RNA, 22 nt, Artificial Sequence
  Synthetic
ccuggagucugacgugaucagu

SEQ ID NO: 7870 - RNA, 23 nt, Artificial Sequence
  Synthetic
uccuggagucugacgugaucagu

SEQ ID NO: 7871 - RNA, 24 nt, Artificial Sequence
  Synthetic
guccuggagucugacgugaucagu

SEQ ID NO: 7872 - RNA, 18 nt, Artificial Sequence
  Synthetic
uaaaauguuaaauuuagu

SEQ ID NO: 7873 - RNA, 19 nt, Artificial Sequence
  Synthetic
auaaaauguuaaauuuagu

SEQ ID NO: 7874 - RNA, 21 nt, Artificial Sequence
  Synthetic
gaauaaaauguuaaauuuagu

SEQ ID NO: 7875 - RNA, 22 nt, Artificial Sequence
  Synthetic
ggaauaaaauguuaaauuuagu

SEQ ID NO: 7876 - RNA, 23 nt, Artificial Sequence
  Synthetic
uggaauaaaauguuaaauuuagu

SEQ ID NO: 7877 - RNA, 24 nt, Artificial Sequence
  Synthetic
auggaauaaaauguuaaauuuagu

SEQ ID NO: 7878 - RNA, 18 nt, Artificial Sequence
  Synthetic
uaaauauaccaaaacugu

SEQ ID NO: 7879 - RNA, 19 nt, Artificial Sequence
  Synthetic
auaaauauaccaaaacugu

SEQ ID NO: 7880 - RNA, 21 nt, Artificial Sequence
  Synthetic
caauaaauauaccaaaacugu

SEQ ID NO: 7881 - RNA, 22 nt, Artificial Sequence
  Synthetic
ccaauaaauauaccaaaacugu

SEQ ID NO: 7882 - RNA, 23 nt, Artificial Sequence
  Synthetic
gccaauaaauauaccaaaacugu

SEQ ID NO: 7883 - RNA, 24 nt, Artificial Sequence
  Synthetic
agccaauaaauauaccaaaacugu

SEQ ID NO: 7884 - RNA, 18 nt, Artificial Sequence
  Synthetic
acaacagugucaauacuu

SEQ ID NO: 7885 - RNA, 19 nt, Artificial Sequence
  Synthetic
aacaacagugucaauacuu

SEQ ID NO: 7886 - RNA, 21 nt, Artificial Sequence
  Synthetic
ccaacaacagugucaauacuu

SEQ ID NO: 7887 - RNA, 22 nt, Artificial Sequence
  Synthetic
accaacaacagugucaauacuu

SEQ ID NO: 7888 - RNA, 23 nt, Artificial Sequence
  Synthetic
uaccaacaacagugucaauacuu

SEQ ID NO: 7889 - RNA, 24 nt, Artificial Sequence
  Synthetic
auaccaacaacagugucaauacuu

SEQ ID NO: 7890 - RNA, 18 nt, Artificial Sequence
  Synthetic
augccauugucuaugcuu

SEQ ID NO: 7891 - RNA, 19 nt, Artificial Sequence
  Synthetic
aaugccauugucuaugcuu

SEQ ID NO: 7892 - RNA, 21 nt, Artificial Sequence
  Synthetic
caaaugccauugucuaugcuu

SEQ ID NO: 7893 - RNA, 22 nt, Artificial Sequence
  Synthetic
gcaaaugccauugucuaugcuu

SEQ ID NO: 7894 - RNA, 23 nt, Artificial Sequence
  Synthetic
ggcaaaugccauugucuaugcuu

SEQ ID NO: 7895 - RNA, 24 nt, Artificial Sequence
  Synthetic
uggcaaaugccauugucuaugcuu

SEQ ID NO: 7896 - RNA, 18 nt, Artificial Sequence
  Synthetic
aaaacaacuguguaucuu

SEQ ID NO: 7897 - RNA, 19 nt, Artificial Sequence
  Synthetic
uaaaacaacuguguaucuu

SEQ ID NO: 7898 - RNA, 21 nt, Artificial Sequence
  Synthetic
uuuaaaacaacuguguaucuu

SEQ ID NO: 7899 - RNA, 22 nt, Artificial Sequence
  Synthetic
cuuuaaaacaacuguguaucuu

SEQ ID NO: 7900 - RNA, 23 nt, Artificial Sequence
  Synthetic
gcuuuaaaacaacuguguaucuu

SEQ ID NO: 7901 - RNA, 24 nt, Artificial Sequence
  Synthetic
agcuuuaaaacaacuguguaucuu

SEQ ID NO: 7902 - RNA, 18 nt, Artificial Sequence
  Synthetic
uucaaauucacaggcuuu

SEQ ID NO: 7903 - RNA, 19 nt, Artificial Sequence
  Synthetic
auucaaauucacaggcuuu

SEQ ID NO: 7904 - RNA, 21 nt, Artificial Sequence
  Synthetic
ucauucaaauucacaggcuuu

SEQ ID NO: 7905 - RNA, 22 nt, Artificial Sequence
  Synthetic
cucauucaaauucacaggcuuu

SEQ ID NO: 7906 - RNA, 23 nt, Artificial Sequence
  Synthetic
ccucauucaaauucacaggcuuu

SEQ ID NO: 7907 - RNA, 24 nt, Artificial Sequence
  Synthetic
uccucauucaaauucacaggcuuu

SEQ ID NO: 7908 - RNA, 18 nt, Artificial Sequence
  Synthetic
aaacaacuguguaucuuu

SEQ ID NO: 7909 - RNA, 19 nt, Artificial Sequence
  Synthetic
aaaacaacuguguaucuuu

SEQ ID NO: 7910 - RNA, 21 nt, Artificial Sequence
  Synthetic
uuaaaacaacuguguaucuuu

SEQ ID NO: 7911 - RNA, 22 nt, Artificial Sequence
  Synthetic
uuuaaaacaacuguguaucuuu

SEQ ID NO: 7912 - RNA, 23 nt, Artificial Sequence
  Synthetic
cuuuaaaacaacuguguaucuuu

SEQ ID NO: 7913 - RNA, 24 nt, Artificial Sequence
  Synthetic
gcuuuaaaacaacuguguaucuuu

SEQ ID NO: 7914 - RNA, 18 nt, Artificial Sequence
  Synthetic
uugccuggcauucaaaaa

SEQ ID NO: 7915 - RNA, 19 nt, Artificial Sequence
  Synthetic
uuugccuggcauucaaaaa

SEQ ID NO: 7916 - RNA, 21 nt, Artificial Sequence
  Synthetic
cuuuugccuggcauucaaaaa

SEQ ID NO: 7917 - RNA, 22 nt, Artificial Sequence
  Synthetic
gcuuuugccuggcauucaaaaa

SEQ ID NO: 7918 - RNA, 23 nt, Artificial Sequence
  Synthetic
agcuuuugccuggcauucaaaaa

SEQ ID NO: 7919 - RNA, 24 nt, Artificial Sequence
  Synthetic
uagcuuuugccuggcauucaaaaa

SEQ ID NO: 7920 - RNA, 18 nt, Artificial Sequence
  Synthetic
aggggaggagaagaaaaa

SEQ ID NO: 7921 - RNA, 19 nt, Artificial Sequence
  Synthetic
caggggaggagaagaaaaa

SEQ ID NO: 7922 - RNA, 21 nt, Artificial Sequence
  Synthetic
cgcaggggaggagaagaaaaa

SEQ ID NO: 7923 - RNA, 22 nt, Artificial Sequence
  Synthetic
gcgcaggggaggagaagaaaaa

SEQ ID NO: 7924 - RNA, 23 nt, Artificial Sequence
  Synthetic
agcgcaggggaggagaagaaaaa

SEQ ID NO: 7925 - RNA, 24 nt, Artificial Sequence
  Synthetic
cagcgcaggggaggagaagaaaaa

SEQ ID NO: 7926 - RNA, 18 nt, Artificial Sequence
  Synthetic
uucacaguccauagcaaa

SEQ ID NO: 7927 - RNA, 19 nt, Artificial Sequence
  Synthetic
uuucacaguccauagcaaa

SEQ ID NO: 7928 - RNA, 21 nt, Artificial Sequence
  Synthetic
guuuucacaguccauagcaaa

SEQ ID NO: 7929 - RNA, 22 nt, Artificial Sequence
  Synthetic
aguuuucacaguccauagcaaa

SEQ ID NO: 7930 - RNA, 23 nt, Artificial Sequence
  Synthetic
caguuuucacaguccauagcaaa

SEQ ID NO: 7931 - RNA, 24 nt, Artificial Sequence
  Synthetic
ucaguuuucacaguccauagcaaa

SEQ ID NO: 7932 - RNA, 18 nt, Artificial Sequence
  Synthetic
gcaggggaggagaagaaa

SEQ ID NO: 7933 - RNA, 19 nt, Artificial Sequence
  Synthetic
cgcaggggaggagaagaaa

SEQ ID NO: 7934 - RNA, 21 nt, Artificial Sequence
  Synthetic
agcgcaggggaggagaagaaa

SEQ ID NO: 7935 - RNA, 22 nt, Artificial Sequence
  Synthetic
cagcgcaggggaggagaagaaa

SEQ ID NO: 7936 - RNA, 23 nt, Artificial Sequence
  Synthetic
gcagcgcaggggaggagaagaaa

SEQ ID NO: 7937 - RNA, 24 nt, Artificial Sequence
  Synthetic
ugcagcgcaggggaggagaagaaa

SEQ ID NO: 7938 - RNA, 18 nt, Artificial Sequence
  Synthetic
uacuaucugauucagaaa

SEQ ID NO: 7939 - RNA, 19 nt, Artificial Sequence
  Synthetic
uuacuaucugauucagaaa

SEQ ID NO: 7940 - RNA, 21 nt, Artificial Sequence
  Synthetic
guuuacuaucugauucagaaa

SEQ ID NO: 7941 - RNA, 22 nt, Artificial Sequence
  Synthetic
uguuuacuaucugauucagaaa

SEQ ID NO: 7942 - RNA, 23 nt, Artificial Sequence
  Synthetic
auguuuacuaucugauucagaaa

SEQ ID NO: 7943 - RNA, 24 nt, Artificial Sequence
  Synthetic
gauguuuacuaucugauucagaaa

SEQ ID NO: 7944 - RNA, 18 nt, Artificial Sequence
  Synthetic
ugauuuugucauuaccaa

SEQ ID NO: 7945 - RNA, 19 nt, Artificial Sequence
  Synthetic
gugauuuugucauuaccaa

SEQ ID NO: 7946 - RNA, 21 nt, Artificial Sequence
  Synthetic
cugugauuuugucauuaccaa

SEQ ID NO: 7947 - RNA, 22 nt, Artificial Sequence
  Synthetic
ccugugauuuugucauuaccaa

SEQ ID NO: 7948 - RNA, 23 nt, Artificial Sequence
  Synthetic
accugugauuuugucauuaccaa

SEQ ID NO: 7949 - RNA, 24 nt, Artificial Sequence
  Synthetic
uaccugugauuuugucauuaccaa

SEQ ID NO: 7950 - RNA, 18 nt, Artificial Sequence
  Synthetic
aaaacugggccagagcaa

SEQ ID NO: 7951 - RNA, 19 nt, Artificial Sequence
  Synthetic
aaaaacugggccagagcaa

SEQ ID NO: 7952 - RNA, 21 nt, Artificial Sequence
  Synthetic
ucaaaaacugggccagagcaa

SEQ ID NO: 7953 - RNA, 22 nt, Artificial Sequence
  Synthetic
uucaaaaacugggccagagcaa

SEQ ID NO: 7954 - RNA, 23 nt, Artificial Sequence
  Synthetic
auucaaaaacugggccagagcaa

SEQ ID NO: 7955 - RNA, 24 nt, Artificial Sequence
  Synthetic
cauucaaaaacugggccagagcaa

SEQ ID NO: 7956 - RNA, 18 nt, Artificial Sequence
  Synthetic
uuucacaguccauagcaa

SEQ ID NO: 7957 - RNA, 19 nt, Artificial Sequence
  Synthetic
uuuucacaguccauagcaa

SEQ ID NO: 7958 - RNA, 20 nt, Artificial Sequence
  Synthetic
guuuucacaguccauagcaa

SEQ ID NO: 7959 - RNA, 21 nt, Artificial Sequence
  Synthetic
aguuuucacaguccauagcaa

SEQ ID NO: 7960 - RNA, 22 nt, Artificial Sequence
  Synthetic
caguuuucacaguccauagcaa

SEQ ID NO: 7961 - RNA, 23 nt, Artificial Sequence
  Synthetic
ucaguuuucacaguccauagcaa

SEQ ID NO: 7962 - RNA, 24 nt, Artificial Sequence
  Synthetic
gucaguuuucacaguccauagcaa

SEQ ID NO: 7963 - RNA, 18 nt, Artificial Sequence
  Synthetic
gggaaaaaaucaguucaa

SEQ ID NO: 7964 - RNA, 19 nt, Artificial Sequence
  Synthetic
ggggaaaaaaucaguucaa

SEQ ID NO: 7965 - RNA, 21 nt, Artificial Sequence
  Synthetic
ggggggaaaaaaucaguucaa

SEQ ID NO: 7966 - RNA, 22 nt, Artificial Sequence
  Synthetic
uggggggaaaaaaucaguucaa

SEQ ID NO: 7967 - RNA, 23 nt, Artificial Sequence
  Synthetic
guggggggaaaaaaucaguucaa

SEQ ID NO: 7968 - RNA, 24 nt, Artificial Sequence
  Synthetic
uguggggggaaaaaaucaguucaa

SEQ ID NO: 7969 - RNA, 18 nt, Artificial Sequence
  Synthetic
auuuuauuccauugcgaa

SEQ ID NO: 7970 - RNA, 19 nt, Artificial Sequence
  Synthetic
cauuuuauuccauugcgaa

SEQ ID NO: 7971 - RNA, 21 nt, Artificial Sequence
  Synthetic
aacauuuuauuccauugcgaa

SEQ ID NO: 7972 - RNA, 22 nt, Artificial Sequence
  Synthetic
uaacauuuuauuccauugcgaa

SEQ ID NO: 7973 - RNA, 23 nt, Artificial Sequence
  Synthetic
uuaacauuuuauuccauugcgaa

SEQ ID NO: 7974 - RNA, 24 nt, Artificial Sequence
  Synthetic
uuuaacauuuuauuccauugcgaa

SEQ ID NO: 7975 - RNA, 18 nt, Artificial Sequence
  Synthetic
uagcaaaaggagaaauaa

SEQ ID NO: 7976 - RNA, 19 nt, Artificial Sequence
  Synthetic
auagcaaaaggagaaauaa

SEQ ID NO: 7977 - RNA, 20 nt, Artificial Sequence
  Synthetic
cauagcaaaaggagaaauaa

SEQ ID NO: 7978 - RNA, 21 nt, Artificial Sequence
  Synthetic
ccauagcaaaaggagaaauaa

SEQ ID NO: 7979 - RNA, 22 nt, Artificial Sequence
  Synthetic
uccauagcaaaaggagaaauaa

SEQ ID NO: 7980 - RNA, 23 nt, Artificial Sequence
  Synthetic
guccauagcaaaaggagaaauaa

SEQ ID NO: 7981 - RNA, 24 nt, Artificial Sequence
  Synthetic
aguccauagcaaaaggagaaauaa

SEQ ID NO: 7982 - RNA, 18 nt, Artificial Sequence
  Synthetic
caagucacaagguaguaa

SEQ ID NO: 7983 - RNA, 19 nt, Artificial Sequence
  Synthetic
gcaagucacaagguaguaa

SEQ ID NO: 7984 - RNA, 21 nt, Artificial Sequence
  Synthetic
gagcaagucacaagguaguaa

SEQ ID NO: 7985 - RNA, 22 nt, Artificial Sequence
  Synthetic
ugagcaagucacaagguaguaa

SEQ ID NO: 7986 - RNA, 23 nt, Artificial Sequence
  Synthetic
cugagcaagucacaagguaguaa

SEQ ID NO: 7987 - RNA, 24 nt, Artificial Sequence
  Synthetic
ucugagcaagucacaagguaguaa

SEQ ID NO: 7988 - RNA, 18 nt, Artificial Sequence
  Synthetic
guugcagauacguuguaa

SEQ ID NO: 7989 - RNA, 19 nt, Artificial Sequence
  Synthetic
uguugcagauacguuguaa

SEQ ID NO: 7990 - RNA, 21 nt, Artificial Sequence
  Synthetic
guuguugcagauacguuguaa

SEQ ID NO: 7991 - RNA, 22 nt, Artificial Sequence
  Synthetic
aguuguugcagauacguuguaa

SEQ ID NO: 7992 - RNA, 23 nt, Artificial Sequence
  Synthetic
caguuguugcagauacguuguaa

SEQ ID NO: 7993 - RNA, 24 nt, Artificial Sequence
  Synthetic
acaguuguugcagauacguuguaa

SEQ ID NO: 7994 - RNA, 18 nt, Artificial Sequence
  Synthetic
caaucccguuucuuuuaa

SEQ ID NO: 7995 - RNA, 19 nt, Artificial Sequence
  Synthetic
gcaaucccguuucuuuuaa

SEQ ID NO: 7996 - RNA, 21 nt, Artificial Sequence
  Synthetic
gggcaaucccguuucuuuuaa

SEQ ID NO: 7997 - RNA, 22 nt, Artificial Sequence
  Synthetic
agggcaaucccguuucuuuuaa

SEQ ID NO: 7998 - RNA, 23 nt, Artificial Sequence
  Synthetic
aagggcaaucccguuucuuuuaa

SEQ ID NO: 7999 - RNA, 24 nt, Artificial Sequence
  Synthetic
caagggcaaucccguuucuuuuaa

SEQ ID NO: 8000 - RNA, 18 nt, Artificial Sequence
  Synthetic
uggagcagcugagccaca

SEQ ID NO: 8001 - RNA, 19 nt, Artificial Sequence
  Synthetic
cuggagcagcugagccaca

SEQ ID NO: 8002 - RNA, 21 nt, Artificial Sequence
  Synthetic
agcuggagcagcugagccaca

SEQ ID NO: 8003 - RNA, 22 nt, Artificial Sequence
  Synthetic
gagcuggagcagcugagccaca

SEQ ID NO: 8004 - RNA, 23 nt, Artificial Sequence
  Synthetic
agagcuggagcagcugagccaca

SEQ ID NO: 8005 - RNA, 24 nt, Artificial Sequence
  Synthetic
cagagcuggagcagcugagccaca

SEQ ID NO: 8006 - RNA, 18 nt, Artificial Sequence
  Synthetic
guuccccagauuucacca

SEQ ID NO: 8007 - RNA, 19 nt, Artificial Sequence
  Synthetic
aguuccccagauuucacca

SEQ ID NO: 8008 - RNA, 21 nt, Artificial Sequence
  Synthetic
agaguuccccagauuucacca

SEQ ID NO: 8009 - RNA, 22 nt, Artificial Sequence
  Synthetic
aagaguuccccagauuucacca

SEQ ID NO: 8010 - RNA, 23 nt, Artificial Sequence
  Synthetic
gaagaguuccccagauuucacca

SEQ ID NO: 8011 - RNA, 24 nt, Artificial Sequence
  Synthetic
agaagaguuccccagauuucacca

SEQ ID NO: 8012 - RNA, 18 nt, Artificial Sequence
  Synthetic
ggcagugggaauugacca

SEQ ID NO: 8013 - RNA, 19 nt, Artificial Sequence
  Synthetic
gggcagugggaauugacca

SEQ ID NO: 8014 - RNA, 21 nt, Artificial Sequence
  Synthetic
aagggcagugggaauugacca

SEQ ID NO: 8015 - RNA, 22 nt, Artificial Sequence
  Synthetic
caagggcagugggaauugacca

SEQ ID NO: 8016 - RNA, 23 nt, Artificial Sequence
  Synthetic
ucaagggcagugggaauugacca

SEQ ID NO: 8017 - RNA, 24 nt, Artificial Sequence
  Synthetic
uucaagggcagugggaauugacca

SEQ ID NO: 8018 - RNA, 18 nt, Artificial Sequence
  Synthetic
gcuggagcagcugagcca

SEQ ID NO: 8019 - RNA, 19 nt, Artificial Sequence
  Synthetic
agcuggagcagcugagcca

SEQ ID NO: 8020 - RNA, 21 nt, Artificial Sequence
  Synthetic
agagcuggagcagcugagcca

SEQ ID NO: 8021 - RNA, 22 nt, Artificial Sequence
  Synthetic
cagagcuggagcagcugagcca

SEQ ID NO: 8022 - RNA, 23 nt, Artificial Sequence
  Synthetic
gcagagcuggagcagcugagcca

SEQ ID NO: 8023 - RNA, 24 nt, Artificial Sequence
  Synthetic
ggcagagcuggagcagcugagcca

SEQ ID NO: 8024 - RNA, 18 nt, Artificial Sequence
  Synthetic
ggagugaccugcagcgca

SEQ ID NO: 8025 - RNA, 19 nt, Artificial Sequence
  Synthetic
cggagugaccugcagcgca

SEQ ID NO: 8026 - RNA, 21 nt, Artificial Sequence
  Synthetic
cacggagugaccugcagcgca

SEQ ID NO: 8027 - RNA, 22 nt, Artificial Sequence
  Synthetic
gcacggagugaccugcagcgca

SEQ ID NO: 8028 - RNA, 23 nt, Artificial Sequence
  Synthetic
agcacggagugaccugcagcgca

SEQ ID NO: 8029 - RNA, 24 nt, Artificial Sequence
  Synthetic
cagcacggagugaccugcagcgca

SEQ ID NO: 8030 - RNA, 18 nt, Artificial Sequence
  Synthetic
cagauucauucaagggca

SEQ ID NO: 8031 - RNA, 19 nt, Artificial Sequence
  Synthetic
acagauucauucaagggca

SEQ ID NO: 8032 - RNA, 21 nt, Artificial Sequence
  Synthetic
agacagauucauucaagggca

SEQ ID NO: 8033 - RNA, 22 nt, Artificial Sequence
  Synthetic
aagacagauucauucaagggca

SEQ ID NO: 8034 - RNA, 23 nt, Artificial Sequence
  Synthetic
aaagacagauucauucaagggca

SEQ ID NO: 8035 - RNA, 24 nt, Artificial Sequence
  Synthetic
gaaagacagauucauucaagggca

SEQ ID NO: 8036 - RNA, 18 nt, Artificial Sequence
  Synthetic
augcuucaggaaagcuca

SEQ ID NO: 8037 - RNA, 19 nt, Artificial Sequence
  Synthetic
aaugcuucaggaaagcuca

SEQ ID NO: 8038 - RNA, 21 nt, Artificial Sequence
  Synthetic
acaaugcuucaggaaagcuca

SEQ ID NO: 8039 - RNA, 22 nt, Artificial Sequence
  Synthetic
cacaaugcuucaggaaagcuca

SEQ ID NO: 8040 - RNA, 23 nt, Artificial Sequence
  Synthetic
ccacaaugcuucaggaaagcuca

SEQ ID NO: 8041 - RNA, 24 nt, Artificial Sequence
  Synthetic
gccacaaugcuucaggaaagcuca

SEQ ID NO: 8042 - RNA, 18 nt, Artificial Sequence
  Synthetic
ggggaaaaaaucaguuca

SEQ ID NO: 8043 - RNA, 19 nt, Artificial Sequence
  Synthetic
gggggaaaaaaucaguuca

SEQ ID NO: 8044 - RNA, 21 nt, Artificial Sequence
  Synthetic
uggggggaaaaaaucaguuca

SEQ ID NO: 8045 - RNA, 22 nt, Artificial Sequence
  Synthetic
guggggggaaaaaaucaguuca

SEQ ID NO: 8046 - RNA, 23 nt, Artificial Sequence
  Synthetic
uguggggggaaaaaaucaguuca

SEQ ID NO: 8047 - RNA, 24 nt, Artificial Sequence
  Synthetic
uuguggggggaaaaaaucaguuca

SEQ ID NO: 8048 - RNA, 18 nt, Artificial Sequence
  Synthetic
gggaggagaagaaaaaga

SEQ ID NO: 8049 - RNA, 19 nt, Artificial Sequence
  Synthetic
ggggaggagaagaaaaaga

SEQ ID NO: 8050 - RNA, 21 nt, Artificial Sequence
  Synthetic
caggggaggagaagaaaaaga

SEQ ID NO: 8051 - RNA, 22 nt, Artificial Sequence
  Synthetic
gcaggggaggagaagaaaaaga

SEQ ID NO: 8052 - RNA, 23 nt, Artificial Sequence
  Synthetic
cgcaggggaggagaagaaaaaga

SEQ ID NO: 8053 - RNA, 24 nt, Artificial Sequence
  Synthetic
gcgcaggggaggagaagaaaaaga

SEQ ID NO: 8054 - RNA, 18 nt, Artificial Sequence
  Synthetic
ggugccugagaugcaaga

SEQ ID NO: 8055 - RNA, 19 nt, Artificial Sequence
  Synthetic
uggugccugagaugcaaga

SEQ ID NO: 8056 - RNA, 21 nt, Artificial Sequence
  Synthetic
auuggugccugagaugcaaga

SEQ ID NO: 8057 - RNA, 22 nt, Artificial Sequence
  Synthetic
cauuggugccugagaugcaaga

SEQ ID NO: 8058 - RNA, 23 nt, Artificial Sequence
  Synthetic
acauuggugccugagaugcaaga

SEQ ID NO: 8059 - RNA, 24 nt, Artificial Sequence
  Synthetic
gacauuggugccugagaugcaaga

SEQ ID NO: 8060 - RNA, 18 nt, Artificial Sequence
  Synthetic
ugaggggggauguugaga

SEQ ID NO: 8061 - RNA, 19 nt, Artificial Sequence
  Synthetic
gugaggggggauguugaga

SEQ ID NO: 8062 - RNA, 21 nt, Artificial Sequence
  Synthetic
cugugaggggggauguugaga

SEQ ID NO: 8063 - RNA, 22 nt, Artificial Sequence
  Synthetic
ucugugaggggggauguugaga

SEQ ID NO: 8064 - RNA, 23 nt, Artificial Sequence
  Synthetic
cucugugaggggggauguugaga

SEQ ID NO: 8065 - RNA, 24 nt, Artificial Sequence
  Synthetic
ucucugugaggggggauguugaga

SEQ ID NO: 8066 - RNA, 18 nt, Artificial Sequence
  Synthetic
ucacgucagacuccagga

SEQ ID NO: 8067 - RNA, 19 nt, Artificial Sequence
  Synthetic
aucacgucagacuccagga

SEQ ID NO: 8068 - RNA, 21 nt, Artificial Sequence
  Synthetic
ugaucacgucagacuccagga

SEQ ID NO: 8069 - RNA, 22 nt, Artificial Sequence
  Synthetic
cugaucacgucagacuccagga

SEQ ID NO: 8070 - RNA, 23 nt, Artificial Sequence
  Synthetic
acugaucacgucagacuccagga

SEQ ID NO: 8071 - RNA, 24 nt, Artificial Sequence
  Synthetic
cacugaucacgucagacuccagga

SEQ ID NO: 8072 - RNA, 18 nt, Artificial Sequence
  Synthetic
ggggauguugagagggga

SEQ ID NO: 8073 - RNA, 19 nt, Artificial Sequence
  Synthetic
gggggauguugagagggga

SEQ ID NO: 8074 - RNA, 21 nt, Artificial Sequence
  Synthetic
aggggggauguugagagggga

SEQ ID NO: 8075 - RNA, 22 nt, Artificial Sequence
  Synthetic
gaggggggauguugagagggga

SEQ ID NO: 8076 - RNA, 23 nt, Artificial Sequence
  Synthetic
ugaggggggauguugagagggga

SEQ ID NO: 8077 - RNA, 24 nt, Artificial Sequence
  Synthetic
gugaggggggauguugagagggga

SEQ ID NO: 8078 - RNA, 18 nt, Artificial Sequence
  Synthetic
aggggagguggaggggga

SEQ ID NO: 8079 - RNA, 19 nt, Artificial Sequence
  Synthetic
caggggagguggaggggga

SEQ ID NO: 8080 - RNA, 21 nt, Artificial Sequence
  Synthetic
cacaggggagguggaggggga

SEQ ID NO: 8081 - RNA, 22 nt, Artificial Sequence
  Synthetic
ccacaggggagguggaggggga

SEQ ID NO: 8082 - RNA, 23 nt, Artificial Sequence
  Synthetic
gccacaggggagguggaggggga

SEQ ID NO: 8083 - RNA, 24 nt, Artificial Sequence
  Synthetic
agccacaggggagguggaggggga

SEQ ID NO: 8084 - RNA, 18 nt, Artificial Sequence
  Synthetic
agccacaggggaggugga

SEQ ID NO: 8085 - RNA, 19 nt, Artificial Sequence
  Synthetic
gagccacaggggaggugga

SEQ ID NO: 8086 - RNA, 21 nt, Artificial Sequence
  Synthetic
cugagccacaggggaggugga

SEQ ID NO: 8087 - RNA, 22 nt, Artificial Sequence
  Synthetic
gcugagccacaggggaggugga

SEQ ID NO: 8088 - RNA, 23 nt, Artificial Sequence
  Synthetic
agcugagccacaggggaggugga

SEQ ID NO: 8089 - RNA, 24 nt, Artificial Sequence
  Synthetic
cagcugagccacaggggaggugga

SEQ ID NO: 8090 - RNA, 18 nt, Artificial Sequence
  Synthetic
uuuuaaagcuagggguga

SEQ ID NO: 8091 - RNA, 19 nt, Artificial Sequence
  Synthetic
guuuuaaagcuagggguga

SEQ ID NO: 8092 - RNA, 21 nt, Artificial Sequence
  Synthetic
uuguuuuaaagcuagggguga

SEQ ID NO: 8093 - RNA, 22 nt, Artificial Sequence
  Synthetic
guuguuuuaaagcuagggguga

SEQ ID NO: 8094 - RNA, 23 nt, Artificial Sequence
  Synthetic
aguuguuuuaaagcuagggguga

SEQ ID NO: 8095 - RNA, 24 nt, Artificial Sequence
  Synthetic
caguuguuuuaaagcuagggguga

SEQ ID NO: 8096 - RNA, 18 nt, Artificial Sequence
  Synthetic
cccugugauucucuguga

SEQ ID NO: 8097 - RNA, 19 nt, Artificial Sequence
  Synthetic
ucccugugauucucuguga

SEQ ID NO: 8098 - RNA, 21 nt, Artificial Sequence
  Synthetic
cuucccugugauucucuguga

SEQ ID NO: 8099 - RNA, 22 nt, Artificial Sequence
  Synthetic
acuucccugugauucucuguga

SEQ ID NO: 8100 - RNA, 23 nt, Artificial Sequence
  Synthetic
cacuucccugugauucucuguga

SEQ ID NO: 8101 - RNA, 24 nt, Artificial Sequence
  Synthetic
acacuucccugugauucucuguga

SEQ ID NO: 8102 - RNA, 18 nt, Artificial Sequence
  Synthetic
ugugaggggggauguuga

SEQ ID NO: 8103 - RNA, 19 nt, Artificial Sequence
  Synthetic
cugugaggggggauguuga

SEQ ID NO: 8104 - RNA, 21 nt, Artificial Sequence
  Synthetic
cucugugaggggggauguuga

SEQ ID NO: 8105 - RNA, 22 nt, Artificial Sequence
  Synthetic
ucucugugaggggggauguuga

SEQ ID NO: 8106 - RNA, 23 nt, Artificial Sequence
  Synthetic
uucucugugaggggggauguuga

SEQ ID NO: 8107 - RNA, 24 nt, Artificial Sequence
  Synthetic
auucucugugaggggggauguuga

SEQ ID NO: 8108 - RNA, 18 nt, Artificial Sequence
  Synthetic
gaaagccugugaauuuga

SEQ ID NO: 8109 - RNA, 19 nt, Artificial Sequence
  Synthetic
agaaagccugugaauuuga

SEQ ID NO: 8110 - RNA, 21 nt, Artificial Sequence
  Synthetic
ccagaaagccugugaauuuga

SEQ ID NO: 8111 - RNA, 22 nt, Artificial Sequence
  Synthetic
uccagaaagccugugaauuuga

SEQ ID NO: 8112 - RNA, 23 nt, Artificial Sequence
  Synthetic
guccagaaagccugugaauuuga

SEQ ID NO: 8113 - RNA, 24 nt, Artificial Sequence
  Synthetic
aguccagaaagccugugaauuuga

SEQ ID NO: 8114 - RNA, 18 nt, Artificial Sequence
  Synthetic
ggaaaucugccgcuucua

SEQ ID NO: 8115 - RNA, 19 nt, Artificial Sequence
  Synthetic
gggaaaucugccgcuucua

SEQ ID NO: 8116 - RNA, 21 nt, Artificial Sequence
  Synthetic
gggggaaaucugccgcuucua

SEQ ID NO: 8117 - RNA, 22 nt, Artificial Sequence
  Synthetic
ggggggaaaucugccgcuucua

SEQ ID NO: 8118 - RNA, 23 nt, Artificial Sequence
  Synthetic
aggggggaaaucugccgcuucua

SEQ ID NO: 8119 - RNA, 24 nt, Artificial Sequence
  Synthetic
gaggggggaaaucugccgcuucua

SEQ ID NO: 8120 - RNA, 18 nt, Artificial Sequence
  Synthetic
cacaagacagaugaauua

SEQ ID NO: 8121 - RNA, 19 nt, Artificial Sequence
  Synthetic
gcacaagacagaugaauua

SEQ ID NO: 8122 - RNA, 21 nt, Artificial Sequence
  Synthetic
uagcacaagacagaugaauua

SEQ ID NO: 8123 - RNA, 22 nt, Artificial Sequence
  Synthetic
cuagcacaagacagaugaauua

SEQ ID NO: 8124 - RNA, 23 nt, Artificial Sequence
  Synthetic
gcuagcacaagacagaugaauua

SEQ ID NO: 8125 - RNA, 24 nt, Artificial Sequence
  Synthetic
agcuagcacaagacagaugaauua

SEQ ID NO: 8126 - RNA, 18 nt, Artificial Sequence
  Synthetic
aaucccguuucuuuuaac

SEQ ID NO: 8127 - RNA, 19 nt, Artificial Sequence
  Synthetic
caaucccguuucuuuuaac

SEQ ID NO: 8128 - RNA, 21 nt, Artificial Sequence
  Synthetic
ggcaaucccguuucuuuuaac

SEQ ID NO: 8129 - RNA, 22 nt, Artificial Sequence
  Synthetic
gggcaaucccguuucuuuuaac

SEQ ID NO: 8130 - RNA, 23 nt, Artificial Sequence
  Synthetic
agggcaaucccguuucuuuuaac

SEQ ID NO: 8131 - RNA, 24 nt, Artificial Sequence
  Synthetic
aagggcaaucccguuucuuuuaac

SEQ ID NO: 8132 - RNA, 18 nt, Artificial Sequence
  Synthetic
cuggagcagcugagccac

SEQ ID NO: 8133 - RNA, 19 nt, Artificial Sequence
  Synthetic
gcuggagcagcugagccac

SEQ ID NO: 8134 - RNA, 21 nt, Artificial Sequence
  Synthetic
gagcuggagcagcugagccac

SEQ ID NO: 8135 - RNA, 22 nt, Artificial Sequence
  Synthetic
agagcuggagcagcugagccac

SEQ ID NO: 8136 - RNA, 23 nt, Artificial Sequence
  Synthetic
cagagcuggagcagcugagccac

SEQ ID NO: 8137 - RNA, 24 nt, Artificial Sequence
  Synthetic
gcagagcuggagcagcugagccac

SEQ ID NO: 8138 - RNA, 18 nt, Artificial Sequence
  Synthetic
cuguggaguuagcagcac

SEQ ID NO: 8139 - RNA, 19 nt, Artificial Sequence
  Synthetic
ucuguggaguuagcagcac

SEQ ID NO: 8140 - RNA, 21 nt, Artificial Sequence
  Synthetic
ucucuguggaguuagcagcac

SEQ ID NO: 8141 - RNA, 22 nt, Artificial Sequence
  Synthetic
uucucuguggaguuagcagcac

SEQ ID NO: 8142 - RNA, 23 nt, Artificial Sequence
  Synthetic
uuucucuguggaguuagcagcac

SEQ ID NO: 8143 - RNA, 24 nt, Artificial Sequence
  Synthetic
uuuucucuguggaguuagcagcac

SEQ ID NO: 8144 - RNA, 18 nt, Artificial Sequence
  Synthetic
ggggagguggagggggac

SEQ ID NO: 8145 - RNA, 19 nt, Artificial Sequence
  Synthetic
aggggagguggagggggac

SEQ ID NO: 8146 - RNA, 21 nt, Artificial Sequence
  Synthetic
acaggggagguggagggggac

SEQ ID NO: 8147 - RNA, 22 nt, Artificial Sequence
  Synthetic
cacaggggagguggagggggac

SEQ ID NO: 8148 - RNA, 23 nt, Artificial Sequence
  Synthetic
ccacaggggagguggagggggac

SEQ ID NO: 8149 - RNA, 24 nt, Artificial Sequence
  Synthetic
gccacaggggagguggagggggac

SEQ ID NO: 8150 - RNA, 18 nt, Artificial Sequence
  Synthetic
gcaagacggucgaaaacc

SEQ ID NO: 8151 - RNA, 19 nt, Artificial Sequence
  Synthetic
ugcaagacggucgaaaacc

SEQ ID NO: 8152 - RNA, 21 nt, Artificial Sequence
  Synthetic
uaugcaagacggucgaaaacc

SEQ ID NO: 8153 - RNA, 22 nt, Artificial Sequence
  Synthetic
uuaugcaagacggucgaaaacc

SEQ ID NO: 8154 - RNA, 23 nt, Artificial Sequence
  Synthetic
cuuaugcaagacggucgaaaacc

SEQ ID NO: 8155 - RNA, 24 nt, Artificial Sequence
  Synthetic
gcuuaugcaagacggucgaaaacc

SEQ ID NO: 8156 - RNA, 18 nt, Artificial Sequence
  Synthetic
uugguuggcugugcgacc

SEQ ID NO: 8157 - RNA, 19 nt, Artificial Sequence
  Synthetic
auugguuggcugugcgacc

SEQ ID NO: 8158 - RNA, 21 nt, Artificial Sequence
  Synthetic
ccauugguuggcugugcgacc

SEQ ID NO: 8159 - RNA, 22 nt, Artificial Sequence
  Synthetic
gccauugguuggcugugcgacc

SEQ ID NO: 8160 - RNA, 23 nt, Artificial Sequence
  Synthetic
ugccauugguuggcugugcgacc

SEQ ID NO: 8161 - RNA, 24 nt, Artificial Sequence
  Synthetic
cugccauugguuggcugugcgacc

SEQ ID NO: 8162 - RNA, 18 nt, Artificial Sequence
  Synthetic
acgucagacuccaggacc

SEQ ID NO: 8163 - RNA, 19 nt, Artificial Sequence
  Synthetic
cacgucagacuccaggacc

SEQ ID NO: 8164 - RNA, 21 nt, Artificial Sequence
  Synthetic
aucacgucagacuccaggacc

SEQ ID NO: 8165 - RNA, 22 nt, Artificial Sequence
  Synthetic
gaucacgucagacuccaggacc

SEQ ID NO: 8166 - RNA, 23 nt, Artificial Sequence
  Synthetic
ugaucacgucagacuccaggacc

SEQ ID NO: 8167 - RNA, 24 nt, Artificial Sequence
  Synthetic
cugaucacgucagacuccaggacc

SEQ ID NO: 8168 - RNA, 18 nt, Artificial Sequence
  Synthetic
cuauaggaaugcucuccc

SEQ ID NO: 8169 - RNA, 19 nt, Artificial Sequence
  Synthetic
ucuauaggaaugcucuccc

SEQ ID NO: 8170 - RNA, 21 nt, Artificial Sequence
  Synthetic
cuucuauaggaaugcucuccc

SEQ ID NO: 8171 - RNA, 22 nt, Artificial Sequence
  Synthetic
gcuucuauaggaaugcucuccc

SEQ ID NO: 8172 - RNA, 23 nt, Artificial Sequence
  Synthetic
cgcuucuauaggaaugcucuccc

SEQ ID NO: 8173 - RNA, 24 nt, Artificial Sequence
  Synthetic
ccgcuucuauaggaaugcucuccc

SEQ ID NO: 8174 - RNA, 18 nt, Artificial Sequence
  Synthetic
ucuauaggaaugcucucc

SEQ ID NO: 8175 - RNA, 19 nt, Artificial Sequence
  Synthetic
uucuauaggaaugcucucc

SEQ ID NO: 8176 - RNA, 21 nt, Artificial Sequence
  Synthetic
gcuucuauaggaaugcucucc

SEQ ID NO: 8177 - RNA, 22 nt, Artificial Sequence
  Synthetic
cgcuucuauaggaaugcucucc

SEQ ID NO: 8178 - RNA, 23 nt, Artificial Sequence
  Synthetic
ccgcuucuauaggaaugcucucc

SEQ ID NO: 8179 - RNA, 24 nt, Artificial Sequence
  Synthetic
gccgcuucuauaggaaugcucucc

SEQ ID NO: 8180 - RNA, 18 nt, Artificial Sequence
  Synthetic
ccugccugcccuuucucc

SEQ ID NO: 8181 - RNA, 19 nt, Artificial Sequence
  Synthetic
cccugccugcccuuucucc

SEQ ID NO: 8182 - RNA, 20 nt, Artificial Sequence
  Synthetic
ucccugccugcccuuucucc

SEQ ID NO: 8183 - RNA, 21 nt, Artificial Sequence
  Synthetic
cucccugccugcccuuucucc

SEQ ID NO: 8184 - RNA, 22 nt, Artificial Sequence
  Synthetic
ccucccugccugcccuuucucc

SEQ ID NO: 8185 - RNA, 23 nt, Artificial Sequence
  Synthetic
gccucccugccugcccuuucucc

SEQ ID NO: 8186 - RNA, 24 nt, Artificial Sequence
  Synthetic
ggccucccugccugcccuuucucc

SEQ ID NO: 8187 - RNA, 18 nt, Artificial Sequence
  Synthetic
gcaagugucucuccuucc

SEQ ID NO: 8188 - RNA, 19 nt, Artificial Sequence
  Synthetic
ggcaagugucucuccuucc

SEQ ID NO: 8189 - RNA, 21 nt, Artificial Sequence
  Synthetic
ugggcaagugucucuccuucc

SEQ ID NO: 8190 - RNA, 22 nt, Artificial Sequence
  Synthetic
gugggcaagugucucuccuucc

SEQ ID NO: 8191 - RNA, 23 nt, Artificial Sequence
  Synthetic
cgugggcaagugucucuccuucc

SEQ ID NO: 8192 - RNA, 24 nt, Artificial Sequence
  Synthetic
ccgugggcaagugucucuccuucc

SEQ ID NO: 8193 - RNA, 18 nt, Artificial Sequence
  Synthetic
acacaguuguuuuaaagc

SEQ ID NO: 8194 - RNA, 19 nt, Artificial Sequence
  Synthetic
uacacaguuguuuuaaagc

SEQ ID NO: 8195 - RNA, 21 nt, Artificial Sequence
  Synthetic
gauacacaguuguuuuaaagc

SEQ ID NO: 8196 - RNA, 22 nt, Artificial Sequence
  Synthetic
agauacacaguuguuuuaaagc

SEQ ID NO: 8197 - RNA, 23 nt, Artificial Sequence
  Synthetic
aagauacacaguuguuuuaaagc

SEQ ID NO: 8198 - RNA, 24 nt, Artificial Sequence
  Synthetic
aaagauacacaguuguuuuaaagc

SEQ ID NO: 8199 - RNA, 18 nt, Artificial Sequence
  Synthetic
gcagugacugcugacagc

SEQ ID NO: 8200 - RNA, 19 nt, Artificial Sequence
  Synthetic
agcagugacugcugacagc

SEQ ID NO: 8201 - RNA, 21 nt, Artificial Sequence
  Synthetic
ucagcagugacugcugacagc

SEQ ID NO: 8202 - RNA, 22 nt, Artificial Sequence
  Synthetic
cucagcagugacugcugacagc

SEQ ID NO: 8203 - RNA, 23 nt, Artificial Sequence
  Synthetic
gcucagcagugacugcugacagc

SEQ ID NO: 8204 - RNA, 24 nt, Artificial Sequence
  Synthetic
agcucagcagugacugcugacagc

SEQ ID NO: 8205 - RNA, 18 nt, Artificial Sequence
  Synthetic
aggggaaggaggcagagc

SEQ ID NO: 8206 - RNA, 19 nt, Artificial Sequence
  Synthetic
gaggggaaggaggcagagc

SEQ ID NO: 8207 - RNA, 21 nt, Artificial Sequence
  Synthetic
gagaggggaaggaggcagagc

SEQ ID NO: 8208 - RNA, 22 nt, Artificial Sequence
  Synthetic
ugagaggggaaggaggcagagc

SEQ ID NO: 8209 - RNA, 23 nt, Artificial Sequence
  Synthetic
uugagaggggaaggaggcagagc

SEQ ID NO: 8210 - RNA, 24 nt, Artificial Sequence
  Synthetic
guugagaggggaaggaggcagagc

SEQ ID NO: 8211 - RNA, 18 nt, Artificial Sequence
  Synthetic
gagggauaguguaugagc

SEQ ID NO: 8212 - RNA, 19 nt, Artificial Sequence
  Synthetic
agagggauaguguaugagc

SEQ ID NO: 8213 - RNA, 21 nt, Artificial Sequence
  Synthetic
agagagggauaguguaugagc

SEQ ID NO: 8214 - RNA, 22 nt, Artificial Sequence
  Synthetic
aagagagggauaguguaugagc

SEQ ID NO: 8215 - RNA, 23 nt, Artificial Sequence
  Synthetic
aaagagagggauaguguaugagc

SEQ ID NO: 8216 - RNA, 24 nt, Artificial Sequence
  Synthetic
aaaagagagggauaguguaugagc

SEQ ID NO: 8217 - RNA, 18 nt, Artificial Sequence
  Synthetic
cggagugaccugcagcgc

SEQ ID NO: 8218 - RNA, 19 nt, Artificial Sequence
  Synthetic
acggagugaccugcagcgc

SEQ ID NO: 8219 - RNA, 21 nt, Artificial Sequence
  Synthetic
gcacggagugaccugcagcgc

SEQ ID NO: 8220 - RNA, 22 nt, Artificial Sequence
  Synthetic
agcacggagugaccugcagcgc

SEQ ID NO: 8221 - RNA, 23 nt, Artificial Sequence
  Synthetic
cagcacggagugaccugcagcgc

SEQ ID NO: 8222 - RNA, 24 nt, Artificial Sequence
  Synthetic
acagcacggagugaccugcagcgc

SEQ ID NO: 8223 - RNA, 18 nt, Artificial Sequence
  Synthetic
ggcauucaaaaacugggc

SEQ ID NO: 8224 - RNA, 19 nt, Artificial Sequence
  Synthetic
uggcauucaaaaacugggc

SEQ ID NO: 8225 - RNA, 21 nt, Artificial Sequence
  Synthetic
ccuggcauucaaaaacugggc

SEQ ID NO: 8226 - RNA, 22 nt, Artificial Sequence
  Synthetic
gccuggcauucaaaaacugggc

SEQ ID NO: 8227 - RNA, 23 nt, Artificial Sequence
  Synthetic
ugccuggcauucaaaaacugggc

SEQ ID NO: 8228 - RNA, 24 nt, Artificial Sequence
  Synthetic
uugccuggcauucaaaaacugggc

SEQ ID NO: 8229 - RNA, 18 nt, Artificial Sequence
  Synthetic
agagcaaguggaaaaugc

SEQ ID NO: 8230 - RNA, 19 nt, Artificial Sequence
  Synthetic
cagagcaaguggaaaaugc

SEQ ID NO: 8231 - RNA, 21 nt, Artificial Sequence
  Synthetic
gccagagcaaguggaaaaugc

SEQ ID NO: 8232 - RNA, 22 nt, Artificial Sequence
  Synthetic
ggccagagcaaguggaaaaugc

SEQ ID NO: 8233 - RNA, 23 nt, Artificial Sequence
  Synthetic
gggccagagcaaguggaaaaugc

SEQ ID NO: 8234 - RNA, 24 nt, Artificial Sequence
  Synthetic
ugggccagagcaaguggaaaaugc

SEQ ID NO: 8235 - RNA, 18 nt, Artificial Sequence
  Synthetic
cucuggaggugagucugc

SEQ ID NO: 8236 - RNA, 19 nt, Artificial Sequence
  Synthetic
acucuggaggugagucugc

SEQ ID NO: 8237 - RNA, 21 nt, Artificial Sequence
  Synthetic
ccacucuggaggugagucugc

SEQ ID NO: 8238 - RNA, 22 nt, Artificial Sequence
  Synthetic
uccacucuggaggugagucugc

SEQ ID NO: 8239 - RNA, 23 nt, Artificial Sequence
  Synthetic
cuccacucuggaggugagucugc

SEQ ID NO: 8240 - RNA, 24 nt, Artificial Sequence
  Synthetic
ucuccacucuggaggugagucugc

SEQ ID NO: 8241 - RNA, 18 nt, Artificial Sequence
  Synthetic
uaacauugacauuggugc

SEQ ID NO: 8242 - RNA, 19 nt, Artificial Sequence
  Synthetic
cuaacauugacauuggugc

SEQ ID NO: 8243 - RNA, 21 nt, Artificial Sequence
  Synthetic
ggcuaacauugacauuggugc

SEQ ID NO: 8244 - RNA, 22 nt, Artificial Sequence
  Synthetic
aggcuaacauugacauuggugc

SEQ ID NO: 8245 - RNA, 23 nt, Artificial Sequence
  Synthetic
gaggcuaacauugacauuggugc

SEQ ID NO: 8246 - RNA, 24 nt, Artificial Sequence
  Synthetic
agaggcuaacauugacauuggugc

SEQ ID NO: 8247 - RNA, 18 nt, Artificial Sequence
  Synthetic
gucgaaaaccuuggaauc

SEQ ID NO: 8248 - RNA, 19 nt, Artificial Sequence
  Synthetic
ggucgaaaaccuuggaauc

SEQ ID NO: 8249 - RNA, 21 nt, Artificial Sequence
  Synthetic
acggucgaaaaccuuggaauc

SEQ ID NO: 8250 - RNA, 22 nt, Artificial Sequence
  Synthetic
gacggucgaaaaccuuggaauc

SEQ ID NO: 8251 - RNA, 23 nt, Artificial Sequence
  Synthetic
agacggucgaaaaccuuggaauc

SEQ ID NO: 8252 - RNA, 24 nt, Artificial Sequence
  Synthetic
aagacggucgaaaaccuuggaauc

SEQ ID NO: 8253 - RNA, 18 nt, Artificial Sequence
  Synthetic
aacuguguuucuccacuc

SEQ ID NO: 8254 - RNA, 19 nt, Artificial Sequence
  Synthetic
aaacuguguuucuccacuc

SEQ ID NO: 8255 - RNA, 21 nt, Artificial Sequence
  Synthetic
gcaaacuguguuucuccacuc

SEQ ID NO: 8256 - RNA, 22 nt, Artificial Sequence
  Synthetic
agcaaacuguguuucuccacuc

SEQ ID NO: 8257 - RNA, 23 nt, Artificial Sequence
  Synthetic
gagcaaacuguguuucuccacuc

SEQ ID NO: 8258 - RNA, 24 nt, Artificial Sequence
  Synthetic
agagcaaacuguguuucuccacuc

SEQ ID NO: 8259 - RNA, 18 nt, Artificial Sequence
  Synthetic
acugaucacgucagacuc

SEQ ID NO: 8260 - RNA, 19 nt, Artificial Sequence
  Synthetic
cacugaucacgucagacuc

SEQ ID NO: 8261 - RNA, 21 nt, Artificial Sequence
  Synthetic
cucacugaucacgucagacuc

SEQ ID NO: 8262 - RNA, 22 nt, Artificial Sequence
  Synthetic
ccucacugaucacgucagacuc

SEQ ID NO: 8263 - RNA, 23 nt, Artificial Sequence
  Synthetic
uccucacugaucacgucagacuc

SEQ ID NO: 8264 - RNA, 24 nt, Artificial Sequence
  Synthetic
guccucacugaucacgucagacuc

SEQ ID NO: 8265 - RNA, 18 nt, Artificial Sequence
  Synthetic
uuacuaguaauuuagcuc

SEQ ID NO: 8266 - RNA, 19 nt, Artificial Sequence
  Synthetic
auuacuaguaauuuagcuc

SEQ ID NO: 8267 - RNA, 20 nt, Artificial Sequence
  Synthetic
uauuacuaguaauuuagcuc

SEQ ID NO: 8268 - RNA, 21 nt, Artificial Sequence
  Synthetic
guauuacuaguaauuuagcuc

SEQ ID NO: 8269 - RNA, 22 nt, Artificial Sequence
  Synthetic
aguauuacuaguaauuuagcuc

SEQ ID NO: 8270 - RNA, 23 nt, Artificial Sequence
  Synthetic
aaguauuacuaguaauuuagcuc

SEQ ID NO: 8271 - RNA, 24 nt, Artificial Sequence
  Synthetic
caaguauuacuaguaauuuagcuc

SEQ ID NO: 8272 - RNA, 18 nt, Artificial Sequence
  Synthetic
aucaguucaagggaaguc

SEQ ID NO: 8273 - RNA, 19 nt, Artificial Sequence
  Synthetic
aaucaguucaagggaaguc

SEQ ID NO: 8274 - RNA, 21 nt, Artificial Sequence
  Synthetic
aaaaucaguucaagggaaguc

SEQ ID NO: 8275 - RNA, 22 nt, Artificial Sequence
  Synthetic
aaaaaucaguucaagggaaguc

SEQ ID NO: 8276 - RNA, 23 nt, Artificial Sequence
  Synthetic
aaaaaaucaguucaagggaaguc

SEQ ID NO: 8277 - RNA, 24 nt, Artificial Sequence
  Synthetic
gaaaaaaucaguucaagggaaguc

SEQ ID NO: 8278 - RNA, 18 nt, Artificial Sequence
  Synthetic
gauuauuaaccuacaguc

SEQ ID NO: 8279 - RNA, 19 nt, Artificial Sequence
  Synthetic
ggauuauuaaccuacaguc

SEQ ID NO: 8280 - RNA, 21 nt, Artificial Sequence
  Synthetic
agggauuauuaaccuacaguc

SEQ ID NO: 8281 - RNA, 22 nt, Artificial Sequence
  Synthetic
cagggauuauuaaccuacaguc

SEQ ID NO: 8282 - RNA, 23 nt, Artificial Sequence
  Synthetic
gcagggauuauuaaccuacaguc

SEQ ID NO: 8283 - RNA, 24 nt, Artificial Sequence
  Synthetic
agcagggauuauuaaccuacaguc

SEQ ID NO: 8284 - RNA, 18 nt, Artificial Sequence
  Synthetic
agaaagacagauucauuc

SEQ ID NO: 8285 - RNA, 19 nt, Artificial Sequence
  Synthetic
aagaaagacagauucauuc

SEQ ID NO: 8286 - RNA, 21 nt, Artificial Sequence
  Synthetic
gcaagaaagacagauucauuc

SEQ ID NO: 8287 - RNA, 22 nt, Artificial Sequence
  Synthetic
agcaagaaagacagauucauuc

SEQ ID NO: 8288 - RNA, 23 nt, Artificial Sequence
  Synthetic
gagcaagaaagacagauucauuc

SEQ ID NO: 8289 - RNA, 24 nt, Artificial Sequence
  Synthetic
ugagcaagaaagacagauucauuc

SEQ ID NO: 8290 - RNA, 18 nt, Artificial Sequence
  Synthetic
cgagagccacaaugcuuc

SEQ ID NO: 8291 - RNA, 19 nt, Artificial Sequence
  Synthetic
ccgagagccacaaugcuuc

SEQ ID NO: 8292 - RNA, 21 nt, Artificial Sequence
  Synthetic
gaccgagagccacaaugcuuc

SEQ ID NO: 8293 - RNA, 22 nt, Artificial Sequence
  Synthetic
ggaccgagagccacaaugcuuc

SEQ ID NO: 8294 - RNA, 23 nt, Artificial Sequence
  Synthetic
aggaccgagagccacaaugcuuc

SEQ ID NO: 8295 - RNA, 24 nt, Artificial Sequence
  Synthetic
caggaccgagagccacaaugcuuc

SEQ ID NO: 8296 - RNA, 18 nt, Artificial Sequence
  Synthetic
gggggaaaaaaucaguuc

SEQ ID NO: 8297 - RNA, 19 nt, Artificial Sequence
  Synthetic
ggggggaaaaaaucaguuc

SEQ ID NO: 8298 - RNA, 21 nt, Artificial Sequence
  Synthetic
guggggggaaaaaaucaguuc

SEQ ID NO: 8299 - RNA, 22 nt, Artificial Sequence
  Synthetic
uguggggggaaaaaaucaguuc

SEQ ID NO: 8300 - RNA, 23 nt, Artificial Sequence
  Synthetic
uuguggggggaaaaaaucaguuc

SEQ ID NO: 8301 - RNA, 24 nt, Artificial Sequence
  Synthetic
auuguggggggaaaaaaucaguuc

SEQ ID NO: 8302 - RNA, 18 nt, Artificial Sequence
  Synthetic
ccacgugauccuggguuc

SEQ ID NO: 8303 - RNA, 19 nt, Artificial Sequence
  Synthetic
uccacgugauccuggguuc

SEQ ID NO: 8304 - RNA, 21 nt, Artificial Sequence
  Synthetic
aguccacgugauccuggguuc

SEQ ID NO: 8305 - RNA, 22 nt, Artificial Sequence
  Synthetic
uaguccacgugauccuggguuc

SEQ ID NO: 8306 - RNA, 23 nt, Artificial Sequence
  Synthetic
auaguccacgugauccuggguuc

SEQ ID NO: 8307 - RNA, 24 nt, Artificial Sequence
  Synthetic
uauaguccacgugauccuggguuc

SEQ ID NO: 8308 - RNA, 18 nt, Artificial Sequence
  Synthetic
cacaguccauagcaaaag

SEQ ID NO: 8309 - RNA, 19 nt, Artificial Sequence
  Synthetic
ucacaguccauagcaaaag

SEQ ID NO: 8310 - RNA, 20 nt, Artificial Sequence
  Synthetic
uucacaguccauagcaaaag

SEQ ID NO: 8311 - RNA, 21 nt, Artificial Sequence
  Synthetic
uuucacaguccauagcaaaag

SEQ ID NO: 8312 - RNA, 22 nt, Artificial Sequence
  Synthetic
uuuucacaguccauagcaaaag

SEQ ID NO: 8313 - RNA, 23 nt, Artificial Sequence
  Synthetic
guuuucacaguccauagcaaaag

SEQ ID NO: 8314 - RNA, 24 nt, Artificial Sequence
  Synthetic
aguuuucacaguccauagcaaaag

SEQ ID NO: 8315 - RNA, 18 nt, Artificial Sequence
  Synthetic
ggguuuauuaauguaaag

SEQ ID NO: 8316 - RNA, 19 nt, Artificial Sequence
  Synthetic
uggguuuauuaauguaaag

SEQ ID NO: 8317 - RNA, 21 nt, Artificial Sequence
  Synthetic
uuuggguuuauuaauguaaag

SEQ ID NO: 8318 - RNA, 22 nt, Artificial Sequence
  Synthetic
cuuuggguuuauuaauguaaag

SEQ ID NO: 8319 - RNA, 23 nt, Artificial Sequence
  Synthetic
ucuuuggguuuauuaauguaaag

SEQ ID NO: 8320 - RNA, 24 nt, Artificial Sequence
  Synthetic
cucuuuggguuuauuaauguaaag

SEQ ID NO: 8321 - RNA, 18 nt, Artificial Sequence
  Synthetic
aaacugggccagagcaag

SEQ ID NO: 8322 - RNA, 19 nt, Artificial Sequence
  Synthetic
aaaacugggccagagcaag

SEQ ID NO: 8323 - RNA, 21 nt, Artificial Sequence
  Synthetic
caaaaacugggccagagcaag

SEQ ID NO: 8324 - RNA, 22 nt, Artificial Sequence
  Synthetic
ucaaaaacugggccagagcaag

SEQ ID NO: 8325 - RNA, 23 nt, Artificial Sequence
  Synthetic
uucaaaaacugggccagagcaag

SEQ ID NO: 8326 - RNA, 24 nt, Artificial Sequence
  Synthetic
auucaaaaacugggccagagcaag

SEQ ID NO: 8327 - RNA, 18 nt, Artificial Sequence
  Synthetic
aaaucaguucaagggaag

SEQ ID NO: 8328 - RNA, 19 nt, Artificial Sequence
  Synthetic
aaaaucaguucaagggaag

SEQ ID NO: 8329 - RNA, 21 nt, Artificial Sequence
  Synthetic
aaaaaaucaguucaagggaag

SEQ ID NO: 8330 - RNA, 22 nt, Artificial Sequence
  Synthetic
gaaaaaaucaguucaagggaag

SEQ ID NO: 8331 - RNA, 23 nt, Artificial Sequence
  Synthetic
ggaaaaaaucaguucaagggaag

SEQ ID NO: 8332 - RNA, 24 nt, Artificial Sequence
  Synthetic
gggaaaaaaucaguucaagggaag

SEQ ID NO: 8333 - RNA, 18 nt, Artificial Sequence
  Synthetic
ggagcagcugagccacag

SEQ ID NO: 8334 - RNA, 19 nt, Artificial Sequence
  Synthetic
uggagcagcugagccacag

SEQ ID NO: 8335 - RNA, 21 nt, Artificial Sequence
  Synthetic
gcuggagcagcugagccacag

SEQ ID NO: 8336 - RNA, 22 nt, Artificial Sequence
  Synthetic
agcuggagcagcugagccacag

SEQ ID NO: 8337 - RNA, 23 nt, Artificial Sequence
  Synthetic
gagcuggagcagcugagccacag

SEQ ID NO: 8338 - RNA, 24 nt, Artificial Sequence
  Synthetic
agagcuggagcagcugagccacag

SEQ ID NO: 8339 - RNA, 18 nt, Artificial Sequence
  Synthetic
gaggcagagcuggagcag

SEQ ID NO: 8340 - RNA, 19 nt, Artificial Sequence
  Synthetic
ggaggcagagcuggagcag

SEQ ID NO: 8341 - RNA, 21 nt, Artificial Sequence
  Synthetic
aaggaggcagagcuggagcag

SEQ ID NO: 8342 - RNA, 22 nt, Artificial Sequence
  Synthetic
gaaggaggcagagcuggagcag

SEQ ID NO: 8343 - RNA, 23 nt, Artificial Sequence
  Synthetic
ggaaggaggcagagcuggagcag

SEQ ID NO: 8344 - RNA, 24 nt, Artificial Sequence
  Synthetic
gggaaggaggcagagcuggagcag

SEQ ID NO: 8345 - RNA, 18 nt, Artificial Sequence
  Synthetic
gugucugcauaugagcag

SEQ ID NO: 8346 - RNA, 19 nt, Artificial Sequence
  Synthetic
ugugucugcauaugagcag

SEQ ID NO: 8347 - RNA, 20 nt, Artificial Sequence
  Synthetic
augugucugcauaugagcag

SEQ ID NO: 8348 - RNA, 21 nt, Artificial Sequence
  Synthetic
gaugugucugcauaugagcag

SEQ ID NO: 8349 - RNA, 22 nt, Artificial Sequence
  Synthetic
agaugugucugcauaugagcag

SEQ ID NO: 8350 - RNA, 23 nt, Artificial Sequence
  Synthetic
gagaugugucugcauaugagcag

SEQ ID NO: 8351 - RNA, 24 nt, Artificial Sequence
  Synthetic
ugagaugugucugcauaugagcag

SEQ ID NO: 8352 - RNA, 18 nt, Artificial Sequence
  Synthetic
gagugaccugcagcgcag

SEQ ID NO: 8353 - RNA, 19 nt, Artificial Sequence
  Synthetic
ggagugaccugcagcgcag

SEQ ID NO: 8354 - RNA, 21 nt, Artificial Sequence
  Synthetic
acggagugaccugcagcgcag

SEQ ID NO: 8355 - RNA, 22 nt, Artificial Sequence
  Synthetic
cacggagugaccugcagcgcag

SEQ ID NO: 8356 - RNA, 23 nt, Artificial Sequence
  Synthetic
gcacggagugaccugcagcgcag

SEQ ID NO: 8357 - RNA, 24 nt, Artificial Sequence
  Synthetic
agcacggagugaccugcagcgcag

SEQ ID NO: 8358 - RNA, 18 nt, Artificial Sequence
  Synthetic
agauucauucaagggcag

SEQ ID NO: 8359 - RNA, 19 nt, Artificial Sequence
  Synthetic
cagauucauucaagggcag

SEQ ID NO: 8360 - RNA, 21 nt, Artificial Sequence
  Synthetic
gacagauucauucaagggcag

SEQ ID NO: 8361 - RNA, 22 nt, Artificial Sequence
  Synthetic
agacagauucauucaagggcag

SEQ ID NO: 8362 - RNA, 23 nt, Artificial Sequence
  Synthetic
aagacagauucauucaagggcag

SEQ ID NO: 8363 - RNA, 24 nt, Artificial Sequence
  Synthetic
aaagacagauucauucaagggcag

SEQ ID NO: 8364 - RNA, 18 nt, Artificial Sequence
  Synthetic
gaggggaaggaggcagag

SEQ ID NO: 8365 - RNA, 19 nt, Artificial Sequence
  Synthetic
agaggggaaggaggcagag

SEQ ID NO: 8366 - RNA, 21 nt, Artificial Sequence
  Synthetic
ugagaggggaaggaggcagag

SEQ ID NO: 8367 - RNA, 22 nt, Artificial Sequence
  Synthetic
uugagaggggaaggaggcagag

SEQ ID NO: 8368 - RNA, 23 nt, Artificial Sequence
  Synthetic
guugagaggggaaggaggcagag

SEQ ID NO: 8369 - RNA, 24 nt, Artificial Sequence
  Synthetic
uguugagaggggaaggaggcagag

SEQ ID NO: 8370 - RNA, 18 nt, Artificial Sequence
  Synthetic
gaggggggauguugagag

SEQ ID NO: 8371 - RNA, 19 nt, Artificial Sequence
  Synthetic
ugaggggggauguugagag

SEQ ID NO: 8372 - RNA, 21 nt, Artificial Sequence
  Synthetic
ugugaggggggauguugagag

SEQ ID NO: 8373 - RNA, 22 nt, Artificial Sequence
  Synthetic
cugugaggggggauguugagag

SEQ ID NO: 8374 - RNA, 23 nt, Artificial Sequence
  Synthetic
ucugugaggggggauguugagag

SEQ ID NO: 8375 - RNA, 24 nt, Artificial Sequence
  Synthetic
cucugugaggggggauguugagag

SEQ ID NO: 8376 - RNA, 18 nt, Artificial Sequence
  Synthetic
ugcagcgcaggggaggag

SEQ ID NO: 8377 - RNA, 19 nt, Artificial Sequence
  Synthetic
cugcagcgcaggggaggag

SEQ ID NO: 8378 - RNA, 21 nt, Artificial Sequence
  Synthetic
accugcagcgcaggggaggag

SEQ ID NO: 8379 - RNA, 22 nt, Artificial Sequence
  Synthetic
gaccugcagcgcaggggaggag

SEQ ID NO: 8380 - RNA, 23 nt, Artificial Sequence
  Synthetic
ugaccugcagcgcaggggaggag

SEQ ID NO: 8381 - RNA, 24 nt, Artificial Sequence
  Synthetic
gugaccugcagcgcaggggaggag

SEQ ID NO: 8382 - RNA, 18 nt, Artificial Sequence
  Synthetic
agcugagccacaggggag

SEQ ID NO: 8383 - RNA, 19 nt, Artificial Sequence
  Synthetic
cagcugagccacaggggag

SEQ ID NO: 8384 - RNA, 21 nt, Artificial Sequence
  Synthetic
agcagcugagccacaggggag

SEQ ID NO: 8385 - RNA, 22 nt, Artificial Sequence
  Synthetic
gagcagcugagccacaggggag

SEQ ID NO: 8386 - RNA, 23 nt, Artificial Sequence
  Synthetic
ggagcagcugagccacaggggag

SEQ ID NO: 8387 - RNA, 24 nt, Artificial Sequence
  Synthetic
uggagcagcugagccacaggggag

SEQ ID NO: 8388 - RNA, 18 nt, Artificial Sequence
  Synthetic
accugcagcgcaggggag

SEQ ID NO: 8389 - RNA, 19 nt, Artificial Sequence
  Synthetic
gaccugcagcgcaggggag

SEQ ID NO: 8390 - RNA, 21 nt, Artificial Sequence
  Synthetic
gugaccugcagcgcaggggag

SEQ ID NO: 8391 - RNA, 22 nt, Artificial Sequence
  Synthetic
agugaccugcagcgcaggggag

SEQ ID NO: 8392 - RNA, 23 nt, Artificial Sequence
  Synthetic
gagugaccugcagcgcaggggag

SEQ ID NO: 8393 - RNA, 24 nt, Artificial Sequence
  Synthetic
ggagugaccugcagcgcaggggag

SEQ ID NO: 8394 - RNA, 18 nt, Artificial Sequence
  Synthetic
gccacaggggagguggag

SEQ ID NO: 8395 - RNA, 19 nt, Artificial Sequence
  Synthetic
agccacaggggagguggag

SEQ ID NO: 8396 - RNA, 21 nt, Artificial Sequence
  Synthetic
ugagccacaggggagguggag

SEQ ID NO: 8397 - RNA, 22 nt, Artificial Sequence
  Synthetic
cugagccacaggggagguggag

SEQ ID NO: 8398 - RNA, 23 nt, Artificial Sequence
  Synthetic
gcugagccacaggggagguggag

SEQ ID NO: 8399 - RNA, 24 nt, Artificial Sequence
  Synthetic
agcugagccacaggggagguggag

SEQ ID NO: 8400 - RNA, 18 nt, Artificial Sequence
  Synthetic
uuuaaagcuaggggugag

SEQ ID NO: 8401 - RNA, 19 nt, Artificial Sequence
  Synthetic
uuuuaaagcuaggggugag

SEQ ID NO: 8402 - RNA, 21 nt, Artificial Sequence
  Synthetic
uguuuuaaagcuaggggugag

SEQ ID NO: 8403 - RNA, 22 nt, Artificial Sequence
  Synthetic
uuguuuuaaagcuaggggugag

SEQ ID NO: 8404 - RNA, 23 nt, Artificial Sequence
  Synthetic
guuguuuuaaagcuaggggugag

SEQ ID NO: 8405 - RNA, 24 nt, Artificial Sequence
  Synthetic
aguuguuuuaaagcuaggggugag

SEQ ID NO: 8406 - RNA, 18 nt, Artificial Sequence
  Synthetic
ccugugauucucugugag

SEQ ID NO: 8407 - RNA, 19 nt, Artificial Sequence
  Synthetic
cccugugauucucugugag

SEQ ID NO: 8408 - RNA, 21 nt, Artificial Sequence
  Synthetic
uucccugugauucucugugag

SEQ ID NO: 8409 - RNA, 22 nt, Artificial Sequence
  Synthetic
cuucccugugauucucugugag

SEQ ID NO: 8410 - RNA, 23 nt, Artificial Sequence
  Synthetic
acuucccugugauucucugugag

SEQ ID NO: 8411 - RNA, 24 nt, Artificial Sequence
  Synthetic
cacuucccugugauucucugugag

SEQ ID NO: 8412 - RNA, 18 nt, Artificial Sequence
  Synthetic
gugaggggggauguugag

SEQ ID NO: 8413 - RNA, 19 nt, Artificial Sequence
  Synthetic
ugugaggggggauguugag

SEQ ID NO: 8414 - RNA, 21 nt, Artificial Sequence
  Synthetic
ucugugaggggggauguugag

SEQ ID NO: 8415 - RNA, 22 nt, Artificial Sequence
  Synthetic
cucugugaggggggauguugag

SEQ ID NO: 8416 - RNA, 23 nt, Artificial Sequence
  Synthetic
ucucugugaggggggauguugag

SEQ ID NO: 8417 - RNA, 24 nt, Artificial Sequence
  Synthetic
uucucugugaggggggauguugag

SEQ ID NO: 8418 - RNA, 18 nt, Artificial Sequence
  Synthetic
acggagugaccugcagcg

SEQ ID NO: 8419 - RNA, 19 nt, Artificial Sequence
  Synthetic
cacggagugaccugcagcg

SEQ ID NO: 8420 - RNA, 21 nt, Artificial Sequence
  Synthetic
agcacggagugaccugcagcg

SEQ ID NO: 8421 - RNA, 22 nt, Artificial Sequence
  Synthetic
cagcacggagugaccugcagcg

SEQ ID NO: 8422 - RNA, 23 nt, Artificial Sequence
  Synthetic
acagcacggagugaccugcagcg

SEQ ID NO: 8423 - RNA, 24 nt, Artificial Sequence
  Synthetic
gacagcacggagugaccugcagcg

SEQ ID NO: 8424 - RNA, 18 nt, Artificial Sequence
  Synthetic
cccguuucuuuuaacagg

SEQ ID NO: 8425 - RNA, 19 nt, Artificial Sequence
  Synthetic
ucccguuucuuuuaacagg

SEQ ID NO: 8426 - RNA, 21 nt, Artificial Sequence
  Synthetic
aaucccguuucuuuuaacagg

SEQ ID NO: 8427 - RNA, 22 nt, Artificial Sequence
  Synthetic
caaucccguuucuuuuaacagg

SEQ ID NO: 8428 - RNA, 23 nt, Artificial Sequence
  Synthetic
gcaaucccguuucuuuuaacagg

SEQ ID NO: 8429 - RNA, 24 nt, Artificial Sequence
  Synthetic
ggcaaucccguuucuuuuaacagg

SEQ ID NO: 8430 - RNA, 18 nt, Artificial Sequence
  Synthetic
gggggacaggaaggcagg

SEQ ID NO: 8431 - RNA, 19 nt, Artificial Sequence
  Synthetic
agggggacaggaaggcagg

SEQ ID NO: 8432 - RNA, 21 nt, Artificial Sequence
  Synthetic
ggagggggacaggaaggcagg

SEQ ID NO: 8433 - RNA, 22 nt, Artificial Sequence
  Synthetic
uggagggggacaggaaggcagg

SEQ ID NO: 8434 - RNA, 23 nt, Artificial Sequence
  Synthetic
guggagggggacaggaaggcagg

SEQ ID NO: 8435 - RNA, 24 nt, Artificial Sequence
  Synthetic
gguggagggggacaggaaggcagg

SEQ ID NO: 8436 - RNA, 18 nt, Artificial Sequence
  Synthetic
guugagaggggaaggagg

SEQ ID NO: 8437 - RNA, 19 nt, Artificial Sequence
  Synthetic
uguugagaggggaaggagg

SEQ ID NO: 8438 - RNA, 21 nt, Artificial Sequence
  Synthetic
gauguugagaggggaaggagg

SEQ ID NO: 8439 - RNA, 22 nt, Artificial Sequence
  Synthetic
ggauguugagaggggaaggagg

SEQ ID NO: 8440 - RNA, 23 nt, Artificial Sequence
  Synthetic
gggauguugagaggggaaggagg

SEQ ID NO: 8441 - RNA, 24 nt, Artificial Sequence
  Synthetic
ggggauguugagaggggaaggagg

SEQ ID NO: 8442 - RNA, 18 nt, Artificial Sequence
  Synthetic
auccuggguucuaggagg

SEQ ID NO: 8443 - RNA, 19 nt, Artificial Sequence
  Synthetic
gauccuggguucuaggagg

SEQ ID NO: 8444 - RNA, 21 nt, Artificial Sequence
  Synthetic
gugauccuggguucuaggagg

SEQ ID NO: 8445 - RNA, 22 nt, Artificial Sequence
  Synthetic
cgugauccuggguucuaggagg

SEQ ID NO: 8446 - RNA, 23 nt, Artificial Sequence
  Synthetic
acgugauccuggguucuaggagg

SEQ ID NO: 8447 - RNA, 24 nt, Artificial Sequence
  Synthetic
cacgugauccuggguucuaggagg

SEQ ID NO: 8448 - RNA, 18 nt, Artificial Sequence
  Synthetic
gcugagccacaggggagg

SEQ ID NO: 8449 - RNA, 19 nt, Artificial Sequence
  Synthetic
agcugagccacaggggagg

SEQ ID NO: 8450 - RNA, 21 nt, Artificial Sequence
  Synthetic
gcagcugagccacaggggagg

SEQ ID NO: 8451 - RNA, 22 nt, Artificial Sequence
  Synthetic
agcagcugagccacaggggagg

SEQ ID NO: 8452 - RNA, 23 nt, Artificial Sequence
  Synthetic
gagcagcugagccacaggggagg

SEQ ID NO: 8453 - RNA, 24 nt, Artificial Sequence
  Synthetic
ggagcagcugagccacaggggagg

SEQ ID NO: 8454 - RNA, 18 nt, Artificial Sequence
  Synthetic
uuaaagcuaggggugagg

SEQ ID NO: 8455 - RNA, 19 nt, Artificial Sequence
  Synthetic
uuuaaagcuaggggugagg

SEQ ID NO: 8456 - RNA, 21 nt, Artificial Sequence
  Synthetic
guuuuaaagcuaggggugagg

SEQ ID NO: 8457 - RNA, 22 nt, Artificial Sequence
  Synthetic
uguuuuaaagcuaggggugagg

SEQ ID NO: 8458 - RNA, 23 nt, Artificial Sequence
  Synthetic
uuguuuuaaagcuaggggugagg

SEQ ID NO: 8459 - RNA, 24 nt, Artificial Sequence
  Synthetic
guuguuuuaaagcuaggggugagg

SEQ ID NO: 8460 - RNA, 18 nt, Artificial Sequence
  Synthetic
uuggcuuaugcaagacgg

SEQ ID NO: 8461 - RNA, 19 nt, Artificial Sequence
  Synthetic
cuuggcuuaugcaagacgg

SEQ ID NO: 8462 - RNA, 21 nt, Artificial Sequence
  Synthetic
gacuuggcuuaugcaagacgg

SEQ ID NO: 8463 - RNA, 22 nt, Artificial Sequence
  Synthetic
ggacuuggcuuaugcaagacgg

SEQ ID NO: 8464 - RNA, 23 nt, Artificial Sequence
  Synthetic
uggacuuggcuuaugcaagacgg

SEQ ID NO: 8465 - RNA, 24 nt, Artificial Sequence
  Synthetic
guggacuuggcuuaugcaagacgg

SEQ ID NO: 8466 - RNA, 18 nt, Artificial Sequence
  Synthetic
gagaaauaaaaggaccgg

SEQ ID NO: 8467 - RNA, 19 nt, Artificial Sequence
  Synthetic
ggagaaauaaaaggaccgg

SEQ ID NO: 8468 - RNA, 20 nt, Artificial Sequence
  Synthetic
aggagaaauaaaaggaccgg

SEQ ID NO: 8469 - RNA, 21 nt, Artificial Sequence
  Synthetic
aaggagaaauaaaaggaccgg

SEQ ID NO: 8470 - RNA, 22 nt, Artificial Sequence
  Synthetic
aaaggagaaauaaaaggaccgg

SEQ ID NO: 8471 - RNA, 23 nt, Artificial Sequence
  Synthetic
aaaaggagaaauaaaaggaccgg

SEQ ID NO: 8472 - RNA, 24 nt, Artificial Sequence
  Synthetic
caaaaggagaaauaaaaggaccgg

SEQ ID NO: 8473 - RNA, 18 nt, Artificial Sequence
  Synthetic
gugaccugcagcgcaggg

SEQ ID NO: 8474 - RNA, 19 nt, Artificial Sequence
  Synthetic
agugaccugcagcgcaggg

SEQ ID NO: 8475 - RNA, 21 nt, Artificial Sequence
  Synthetic
ggagugaccugcagcgcaggg

SEQ ID NO: 8476 - RNA, 22 nt, Artificial Sequence
  Synthetic
cggagugaccugcagcgcaggg

SEQ ID NO: 8477 - RNA, 23 nt, Artificial Sequence
  Synthetic
acggagugaccugcagcgcaggg

SEQ ID NO: 8478 - RNA, 24 nt, Artificial Sequence
  Synthetic
cacggagugaccugcagcgcaggg

SEQ ID NO: 8479 - RNA, 18 nt, Artificial Sequence
  Synthetic
uaaagcuaggggugaggg

SEQ ID NO: 8480 - RNA, 19 nt, Artificial Sequence
  Synthetic
uuaaagcuaggggugaggg

SEQ ID NO: 8481 - RNA, 21 nt, Artificial Sequence
  Synthetic
uuuuaaagcuaggggugaggg

SEQ ID NO: 8482 - RNA, 22 nt, Artificial Sequence
  Synthetic
guuuuaaagcuaggggugaggg

SEQ ID NO: 8483 - RNA, 23 nt, Artificial Sequence
  Synthetic
uguuuuaaagcuaggggugaggg

SEQ ID NO: 8484 - RNA, 24 nt, Artificial Sequence
  Synthetic
uuguuuuaaagcuaggggugaggg

SEQ ID NO: 8485 - RNA, 18 nt, Artificial Sequence
  Synthetic
guuguuuuaaagcuaggg

SEQ ID NO: 8486 - RNA, 19 nt, Artificial Sequence
  Synthetic
aguuguuuuaaagcuaggg

SEQ ID NO: 8487 - RNA, 21 nt, Artificial Sequence
  Synthetic
acaguuguuuuaaagcuaggg

SEQ ID NO: 8488 - RNA, 22 nt, Artificial Sequence
  Synthetic
cacaguuguuuuaaagcuaggg

SEQ ID NO: 8489 - RNA, 23 nt, Artificial Sequence
  Synthetic
acacaguuguuuuaaagcuaggg

SEQ ID NO: 8490 - RNA, 24 nt, Artificial Sequence
  Synthetic
uacacaguuguuuuaaagcuaggg

SEQ ID NO: 8491 - RNA, 18 nt, Artificial Sequence
  Synthetic
ugaccugcagcgcagggg

SEQ ID NO: 8492 - RNA, 19 nt, Artificial Sequence
  Synthetic
gugaccugcagcgcagggg

SEQ ID NO: 8493 - RNA, 21 nt, Artificial Sequence
  Synthetic
gagugaccugcagcgcagggg

SEQ ID NO: 8494 - RNA, 22 nt, Artificial Sequence
  Synthetic
ggagugaccugcagcgcagggg

SEQ ID NO: 8495 - RNA, 23 nt, Artificial Sequence
  Synthetic
cggagugaccugcagcgcagggg

SEQ ID NO: 8496 - RNA, 24 nt, Artificial Sequence
  Synthetic
acggagugaccugcagcgcagggg

SEQ ID NO: 8497 - RNA, 18 nt, Artificial Sequence
  Synthetic
gggggauguugagagggg

SEQ ID NO: 8498 - RNA, 19 nt, Artificial Sequence
  Synthetic
ggggggauguugagagggg

SEQ ID NO: 8499 - RNA, 21 nt, Artificial Sequence
  Synthetic
gaggggggauguugagagggg

SEQ ID NO: 8500 - RNA, 22 nt, Artificial Sequence
  Synthetic
ugaggggggauguugagagggg

SEQ ID NO: 8501 - RNA, 23 nt, Artificial Sequence
  Synthetic
gugaggggggauguugagagggg

SEQ ID NO: 8502 - RNA, 24 nt, Artificial Sequence
  Synthetic
ugugaggggggauguugagagggg

SEQ ID NO: 8503 - RNA, 18 nt, Artificial Sequence
  Synthetic
gcagggcuauauuguggg

SEQ ID NO: 8504 - RNA, 19 nt, Artificial Sequence
  Synthetic
ggcagggcuauauuguggg

SEQ ID NO: 8505 - RNA, 21 nt, Artificial Sequence
  Synthetic
gaggcagggcuauauuguggg

SEQ ID NO: 8506 - RNA, 22 nt, Artificial Sequence
  Synthetic
ggaggcagggcuauauuguggg

SEQ ID NO: 8507 - RNA, 23 nt, Artificial Sequence
  Synthetic
aggaggcagggcuauauuguggg

SEQ ID NO: 8508 - RNA, 24 nt, Artificial Sequence
  Synthetic
uaggaggcagggcuauauuguggg

SEQ ID NO: 8509 - RNA, 18 nt, Artificial Sequence
  Synthetic
gagccacaggggaggugg

SEQ ID NO: 8510 - RNA, 19 nt, Artificial Sequence
  Synthetic
ugagccacaggggaggugg

SEQ ID NO: 8511 - RNA, 21 nt, Artificial Sequence
  Synthetic
gcugagccacaggggaggugg

SEQ ID NO: 8512 - RNA, 22 nt, Artificial Sequence
  Synthetic
agcugagccacaggggaggugg

SEQ ID NO: 8513 - RNA, 23 nt, Artificial Sequence
  Synthetic
cagcugagccacaggggaggugg

SEQ ID NO: 8514 - RNA, 24 nt, Artificial Sequence
  Synthetic
gcagcugagccacaggggaggugg

SEQ ID NO: 8515 - RNA, 18 nt, Artificial Sequence
  Synthetic
ggcagggcuauauugugg

SEQ ID NO: 8516 - RNA, 19 nt, Artificial Sequence
  Synthetic
aggcagggcuauauugugg

SEQ ID NO: 8517 - RNA, 21 nt, Artificial Sequence
  Synthetic
ggaggcagggcuauauugugg

SEQ ID NO: 8518 - RNA, 22 nt, Artificial Sequence
  Synthetic
aggaggcagggcuauauugugg

SEQ ID NO: 8519 - RNA, 23 nt, Artificial Sequence
  Synthetic
uaggaggcagggcuauauugugg

SEQ ID NO: 8520 - RNA, 24 nt, Artificial Sequence
  Synthetic
cuaggaggcagggcuauauugugg

SEQ ID NO: 8521 - RNA, 18 nt, Artificial Sequence
  Synthetic
caauaaccaaaaagaaug

SEQ ID NO: 8522 - RNA, 19 nt, Artificial Sequence
  Synthetic
ccaauaaccaaaaagaaug

SEQ ID NO: 8523 - RNA, 21 nt, Artificial Sequence
  Synthetic
ugccaauaaccaaaaagaaug

SEQ ID NO: 8524 - RNA, 22 nt, Artificial Sequence
  Synthetic
uugccaauaaccaaaaagaaug

SEQ ID NO: 8525 - RNA, 23 nt, Artificial Sequence
  Synthetic
uuugccaauaaccaaaaagaaug

SEQ ID NO: 8526 - RNA, 24 nt, Artificial Sequence
  Synthetic
auuugccaauaaccaaaaagaaug

SEQ ID NO: 8527 - RNA, 18 nt, Artificial Sequence
  Synthetic
agccugugaauuugaaug

SEQ ID NO: 8528 - RNA, 19 nt, Artificial Sequence
  Synthetic
aagccugugaauuugaaug

SEQ ID NO: 8529 - RNA, 21 nt, Artificial Sequence
  Synthetic
gaaagccugugaauuugaaug

SEQ ID NO: 8530 - RNA, 22 nt, Artificial Sequence
  Synthetic
agaaagccugugaauuugaaug

SEQ ID NO: 8531 - RNA, 23 nt, Artificial Sequence
  Synthetic
cagaaagccugugaauuugaaug

SEQ ID NO: 8532 - RNA, 24 nt, Artificial Sequence
  Synthetic
ccagaaagccugugaauuugaaug

SEQ ID NO: 8533 - RNA, 18 nt, Artificial Sequence
  Synthetic
ucucugugaggggggaug

SEQ ID NO: 8534 - RNA, 19 nt, Artificial Sequence
  Synthetic
uucucugugaggggggaug

SEQ ID NO: 8535 - RNA, 21 nt, Artificial Sequence
  Synthetic
gauucucugugaggggggaug

SEQ ID NO: 8536 - RNA, 22 nt, Artificial Sequence
  Synthetic
ugauucucugugaggggggaug

SEQ ID NO: 8537 - RNA, 23 nt, Artificial Sequence
  Synthetic
gugauucucugugaggggggaug

SEQ ID NO: 8538 - RNA, 24 nt, Artificial Sequence
  Synthetic
ugugauucucugugaggggggaug

SEQ ID NO: 8539 - RNA, 18 nt, Artificial Sequence
  Synthetic
caaguucaggcuuaacug

SEQ ID NO: 8540 - RNA, 19 nt, Artificial Sequence
  Synthetic
ucaaguucaggcuuaacug

SEQ ID NO: 8541 - RNA, 21 nt, Artificial Sequence
  Synthetic
ucucaaguucaggcuuaacug

SEQ ID NO: 8542 - RNA, 22 nt, Artificial Sequence
  Synthetic
gucucaaguucaggcuuaacug

SEQ ID NO: 8543 - RNA, 23 nt, Artificial Sequence
  Synthetic
ugucucaaguucaggcuuaacug

SEQ ID NO: 8544 - RNA, 24 nt, Artificial Sequence
  Synthetic
augucucaaguucaggcuuaacug

SEQ ID NO: 8545 - RNA, 18 nt, Artificial Sequence
  Synthetic
ugagccacaggggaggug

SEQ ID NO: 8546 - RNA, 19 nt, Artificial Sequence
  Synthetic
cugagccacaggggaggug

SEQ ID NO: 8547 - RNA, 21 nt, Artificial Sequence
  Synthetic
agcugagccacaggggaggug

SEQ ID NO: 8548 - RNA, 22 nt, Artificial Sequence
  Synthetic
cagcugagccacaggggaggug

SEQ ID NO: 8549 - RNA, 23 nt, Artificial Sequence
  Synthetic
gcagcugagccacaggggaggug

SEQ ID NO: 8550 - RNA, 24 nt, Artificial Sequence
  Synthetic
agcagcugagccacaggggaggug

SEQ ID NO: 8551 - RNA, 18 nt, Artificial Sequence
  Synthetic
guuuuaaagcuaggggug

SEQ ID NO: 8552 - RNA, 19 nt, Artificial Sequence
  Synthetic
uguuuuaaagcuaggggug

SEQ ID NO: 8553 - RNA, 21 nt, Artificial Sequence
  Synthetic
guuguuuuaaagcuaggggug

SEQ ID NO: 8554 - RNA, 22 nt, Artificial Sequence
  Synthetic
aguuguuuuaaagcuaggggug

SEQ ID NO: 8555 - RNA, 23 nt, Artificial Sequence
  Synthetic
caguuguuuuaaagcuaggggug

SEQ ID NO: 8556 - RNA, 24 nt, Artificial Sequence
  Synthetic
acaguuguuuuaaagcuaggggug

SEQ ID NO: 8557 - RNA, 18 nt, Artificial Sequence
  Synthetic
caacuacucagcccugug

SEQ ID NO: 8558 - RNA, 19 nt, Artificial Sequence
  Synthetic
gcaacuacucagcccugug

SEQ ID NO: 8559 - RNA, 21 nt, Artificial Sequence
  Synthetic
gggcaacuacucagcccugug

SEQ ID NO: 8560 - RNA, 22 nt, Artificial Sequence
  Synthetic
ugggcaacuacucagcccugug

SEQ ID NO: 8561 - RNA, 23 nt, Artificial Sequence
  Synthetic
cugggcaacuacucagcccugug

SEQ ID NO: 8562 - RNA, 24 nt, Artificial Sequence
  Synthetic
ucugggcaacuacucagcccugug

SEQ ID NO: 8563 - RNA, 18 nt, Artificial Sequence
  Synthetic
ucccugugauucucugug

SEQ ID NO: 8564 - RNA, 19 nt, Artificial Sequence
  Synthetic
uucccugugauucucugug

SEQ ID NO: 8565 - RNA, 21 nt, Artificial Sequence
  Synthetic
acuucccugugauucucugug

SEQ ID NO: 8566 - RNA, 22 nt, Artificial Sequence
  Synthetic
cacuucccugugauucucugug

SEQ ID NO: 8567 - RNA, 23 nt, Artificial Sequence
  Synthetic
acacuucccugugauucucugug

SEQ ID NO: 8568 - RNA, 24 nt, Artificial Sequence
  Synthetic
aacacuucccugugauucucugug

SEQ ID NO: 8569 - RNA, 18 nt, Artificial Sequence
  Synthetic
aggcagggcuauauugug

SEQ ID NO: 8570 - RNA, 19 nt, Artificial Sequence
  Synthetic
gaggcagggcuauauugug

SEQ ID NO: 8571 - RNA, 21 nt, Artificial Sequence
  Synthetic
aggaggcagggcuauauugug

SEQ ID NO: 8572 - RNA, 22 nt, Artificial Sequence
  Synthetic
uaggaggcagggcuauauugug

SEQ ID NO: 8573 - RNA, 23 nt, Artificial Sequence
  Synthetic
cuaggaggcagggcuauauugug

SEQ ID NO: 8574 - RNA, 24 nt, Artificial Sequence
  Synthetic
ucuaggaggcagggcuauauugug

SEQ ID NO: 8575 - RNA, 18 nt, Artificial Sequence
  Synthetic
ggaggcagggcuauauug

SEQ ID NO: 8576 - RNA, 19 nt, Artificial Sequence
  Synthetic
aggaggcagggcuauauug

SEQ ID NO: 8577 - RNA, 21 nt, Artificial Sequence
  Synthetic
cuaggaggcagggcuauauug

SEQ ID NO: 8578 - RNA, 22 nt, Artificial Sequence
  Synthetic
ucuaggaggcagggcuauauug

SEQ ID NO: 8579 - RNA, 23 nt, Artificial Sequence
  Synthetic
uucuaggaggcagggcuauauug

SEQ ID NO: 8580 - RNA, 24 nt, Artificial Sequence
  Synthetic
guucuaggaggcagggcuauauug

SEQ ID NO: 8581 - RNA, 18 nt, Artificial Sequence
  Synthetic
gagaugcaagacugaaau

SEQ ID NO: 8582 - RNA, 19 nt, Artificial Sequence
  Synthetic
ugagaugcaagacugaaau

SEQ ID NO: 8583 - RNA, 21 nt, Artificial Sequence
  Synthetic
ccugagaugcaagacugaaau

SEQ ID NO: 8584 - RNA, 22 nt, Artificial Sequence
  Synthetic
gccugagaugcaagacugaaau

SEQ ID NO: 8585 - RNA, 23 nt, Artificial Sequence
  Synthetic
ugccugagaugcaagacugaaau

SEQ ID NO: 8586 - RNA, 24 nt, Artificial Sequence
  Synthetic
gugccugagaugcaagacugaaau

SEQ ID NO: 8587 - RNA, 18 nt, Artificial Sequence
  Synthetic
ggucgaaaaccuuggaau

SEQ ID NO: 8588 - RNA, 19 nt, Artificial Sequence
  Synthetic
cggucgaaaaccuuggaau

SEQ ID NO: 8589 - RNA, 21 nt, Artificial Sequence
  Synthetic
gacggucgaaaaccuuggaau

SEQ ID NO: 8590 - RNA, 22 nt, Artificial Sequence
  Synthetic
agacggucgaaaaccuuggaau

SEQ ID NO: 8591 - RNA, 23 nt, Artificial Sequence
  Synthetic
aagacggucgaaaaccuuggaau

SEQ ID NO: 8592 - RNA, 24 nt, Artificial Sequence
  Synthetic
caagacggucgaaaaccuuggaau

SEQ ID NO: 8593 - RNA, 18 nt, Artificial Sequence
  Synthetic
aagccugugaauuugaau

SEQ ID NO: 8594 - RNA, 19 nt, Artificial Sequence
  Synthetic
aaagccugugaauuugaau

SEQ ID NO: 8595 - RNA, 21 nt, Artificial Sequence
  Synthetic
agaaagccugugaauuugaau

SEQ ID NO: 8596 - RNA, 22 nt, Artificial Sequence
  Synthetic
cagaaagccugugaauuugaau

SEQ ID NO: 8597 - RNA, 23 nt, Artificial Sequence
  Synthetic
ccagaaagccugugaauuugaau

SEQ ID NO: 8598 - RNA, 24 nt, Artificial Sequence
  Synthetic
uccagaaagccugugaauuugaau

SEQ ID NO: 8599 - RNA, 18 nt, Artificial Sequence
  Synthetic
ggugagaugugucugcau

SEQ ID NO: 8600 - RNA, 19 nt, Artificial Sequence
  Synthetic
gggugagaugugucugcau

SEQ ID NO: 8601 - RNA, 20 nt, Artificial Sequence
  Synthetic
cgggugagaugugucugcau

SEQ ID NO: 8602 - RNA, 21 nt, Artificial Sequence
  Synthetic
ccgggugagaugugucugcau

SEQ ID NO: 8603 - RNA, 22 nt, Artificial Sequence
  Synthetic
accgggugagaugugucugcau

SEQ ID NO: 8604 - RNA, 23 nt, Artificial Sequence
  Synthetic
gaccgggugagaugugucugcau

SEQ ID NO: 8605 - RNA, 24 nt, Artificial Sequence
  Synthetic
ggaccgggugagaugugucugcau

SEQ ID NO: 8606 - RNA, 18 nt, Artificial Sequence
  Synthetic
aaucuauauuuuauauau

SEQ ID NO: 8607 - RNA, 19 nt, Artificial Sequence
  Synthetic
uaaucuauauuuuauauau

SEQ ID NO: 8608 - RNA, 21 nt, Artificial Sequence
  Synthetic
uguaaucuauauuuuauauau

SEQ ID NO: 8609 - RNA, 22 nt, Artificial Sequence
  Synthetic
uuguaaucuauauuuuauauau

SEQ ID NO: 8610 - RNA, 23 nt, Artificial Sequence
  Synthetic
uuuguaaucuauauuuuauauau

SEQ ID NO: 8611 - RNA, 24 nt, Artificial Sequence
  Synthetic
cuuuguaaucuauauuuuauauau

SEQ ID NO: 8612 - RNA, 18 nt, Artificial Sequence
  Synthetic
uacuuaguuucuccuuau

SEQ ID NO: 8613 - RNA, 19 nt, Artificial Sequence
  Synthetic
uuacuuaguuucuccuuau

SEQ ID NO: 8614 - RNA, 21 nt, Artificial Sequence
  Synthetic
gauuacuuaguuucuccuuau

SEQ ID NO: 8615 - RNA, 22 nt, Artificial Sequence
  Synthetic
agauuacuuaguuucuccuuau

SEQ ID NO: 8616 - RNA, 23 nt, Artificial Sequence
  Synthetic
aagauuacuuaguuucuccuuau

SEQ ID NO: 8617 - RNA, 24 nt, Artificial Sequence
  Synthetic
uaagauuacuuaguuucuccuuau

SEQ ID NO: 8618 - RNA, 18 nt, Artificial Sequence
  Synthetic
aaacuguguuucuccacu

SEQ ID NO: 8619 - RNA, 19 nt, Artificial Sequence
  Synthetic
caaacuguguuucuccacu

SEQ ID NO: 8620 - RNA, 21 nt, Artificial Sequence
  Synthetic
agcaaacuguguuucuccacu

SEQ ID NO: 8621 - RNA, 22 nt, Artificial Sequence
  Synthetic
gagcaaacuguguuucuccacu

SEQ ID NO: 8622 - RNA, 23 nt, Artificial Sequence
  Synthetic
agagcaaacuguguuucuccacu

SEQ ID NO: 8623 - RNA, 24 nt, Artificial Sequence
  Synthetic
uagagcaaacuguguuucuccacu

SEQ ID NO: 8624 - RNA, 18 nt, Artificial Sequence
  Synthetic
uuuauacucaaaacuacu

SEQ ID NO: 8625 - RNA, 19 nt, Artificial Sequence
  Synthetic
auuuauacucaaaacuacu

SEQ ID NO: 8626 - RNA, 21 nt, Artificial Sequence
  Synthetic
auauuuauacucaaaacuacu

SEQ ID NO: 8627 - RNA, 22 nt, Artificial Sequence
  Synthetic
aauauuuauacucaaaacuacu

SEQ ID NO: 8628 - RNA, 23 nt, Artificial Sequence
  Synthetic
aaauauuuauacucaaaacuacu

SEQ ID NO: 8629 - RNA, 24 nt, Artificial Sequence
  Synthetic
gaaauauuuauacucaaaacuacu

SEQ ID NO: 8630 - RNA, 18 nt, Artificial Sequence
  Synthetic
acuaguaauuuagcuccu

SEQ ID NO: 8631 - RNA, 19 nt, Artificial Sequence
  Synthetic
uacuaguaauuuagcuccu

SEQ ID NO: 8632 - RNA, 20 nt, Artificial Sequence
  Synthetic
uuacuaguaauuuagcuccu

SEQ ID NO: 8633 - RNA, 21 nt, Artificial Sequence
  Synthetic
auuacuaguaauuuagcuccu

SEQ ID NO: 8634 - RNA, 22 nt, Artificial Sequence
  Synthetic
uauuacuaguaauuuagcuccu

SEQ ID NO: 8635 - RNA, 23 nt, Artificial Sequence
  Synthetic
guauuacuaguaauuuagcuccu

SEQ ID NO: 8636 - RNA, 24 nt, Artificial Sequence
  Synthetic
aguauuacuaguaauuuagcuccu

SEQ ID NO: 8637 - RNA, 18 nt, Artificial Sequence
  Synthetic
acuucccugugauucucu

SEQ ID NO: 8638 - RNA, 19 nt, Artificial Sequence
  Synthetic
cacuucccugugauucucu

SEQ ID NO: 8639 - RNA, 21 nt, Artificial Sequence
  Synthetic
aacacuucccugugauucucu

SEQ ID NO: 8640 - RNA, 22 nt, Artificial Sequence
  Synthetic
gaacacuucccugugauucucu

SEQ ID NO: 8641 - RNA, 23 nt, Artificial Sequence
  Synthetic
ugaacacuucccugugauucucu

SEQ ID NO: 8642 - RNA, 24 nt, Artificial Sequence
  Synthetic
gugaacacuucccugugauucucu

SEQ ID NO: 8643 - RNA, 18 nt, Artificial Sequence
  Synthetic
uaggaacucuuuuucucu

SEQ ID NO: 8644 - RNA, 19 nt, Artificial Sequence
  Synthetic
uuaggaacucuuuuucucu

SEQ ID NO: 8645 - RNA, 21 nt, Artificial Sequence
  Synthetic
uauuaggaacucuuuuucucu

SEQ ID NO: 8646 - RNA, 22 nt, Artificial Sequence
  Synthetic
uuauuaggaacucuuuuucucu

SEQ ID NO: 8647 - RNA, 23 nt, Artificial Sequence
  Synthetic
cuuauuaggaacucuuuuucucu

SEQ ID NO: 8648 - RNA, 24 nt, Artificial Sequence
  Synthetic
ccuuauuaggaacucuuuuucucu

SEQ ID NO: 8649 - RNA, 18 nt, Artificial Sequence
  Synthetic
cacgugauccuggguucu

SEQ ID NO: 8650 - RNA, 19 nt, Artificial Sequence
  Synthetic
ccacgugauccuggguucu

SEQ ID NO: 8651 - RNA, 21 nt, Artificial Sequence
  Synthetic
guccacgugauccuggguucu

SEQ ID NO: 8652 - RNA, 22 nt, Artificial Sequence
  Synthetic
aguccacgugauccuggguucu

SEQ ID NO: 8653 - RNA, 23 nt, Artificial Sequence
  Synthetic
uaguccacgugauccuggguucu

SEQ ID NO: 8654 - RNA, 24 nt, Artificial Sequence
  Synthetic
auaguccacgugauccuggguucu

SEQ ID NO: 8655 - RNA, 18 nt, Artificial Sequence
  Synthetic
uugcagcucucguguucu

SEQ ID NO: 8656 - RNA, 19 nt, Artificial Sequence
  Synthetic
cuugcagcucucguguucu

SEQ ID NO: 8657 - RNA, 21 nt, Artificial Sequence
  Synthetic
cccuugcagcucucguguucu

SEQ ID NO: 8658 - RNA, 22 nt, Artificial Sequence
  Synthetic
acccuugcagcucucguguucu

SEQ ID NO: 8659 - RNA, 23 nt, Artificial Sequence
  Synthetic
gacccuugcagcucucguguucu

SEQ ID NO: 8660 - RNA, 24 nt, Artificial Sequence
  Synthetic
agacccuugcagcucucguguucu

SEQ ID NO: 8661 - RNA, 18 nt, Artificial Sequence
  Synthetic
auuugaaaacaucuuucu

SEQ ID NO: 8662 - RNA, 19 nt, Artificial Sequence
  Synthetic
uauuugaaaacaucuuucu

SEQ ID NO: 8663 - RNA, 21 nt, Artificial Sequence
  Synthetic
uauauuugaaaacaucuuucu

SEQ ID NO: 8664 - RNA, 22 nt, Artificial Sequence
  Synthetic
auauauuugaaaacaucuuucu

SEQ ID NO: 8665 - RNA, 23 nt, Artificial Sequence
  Synthetic
uauauauuugaaaacaucuuucu

SEQ ID NO: 8666 - RNA, 24 nt, Artificial Sequence
  Synthetic
uuauauauuugaaaacaucuuucu

SEQ ID NO: 8667 - RNA, 18 nt, Artificial Sequence
  Synthetic
aaucaguucaagggaagu

SEQ ID NO: 8668 - RNA, 19 nt, Artificial Sequence
  Synthetic
aaaucaguucaagggaagu

SEQ ID NO: 8669 - RNA, 21 nt, Artificial Sequence
  Synthetic
aaaaaucaguucaagggaagu

SEQ ID NO: 8670 - RNA, 22 nt, Artificial Sequence
  Synthetic
aaaaaaucaguucaagggaagu

SEQ ID NO: 8671 - RNA, 23 nt, Artificial Sequence
  Synthetic
gaaaaaaucaguucaagggaagu

SEQ ID NO: 8672 - RNA, 24 nt, Artificial Sequence
  Synthetic
ggaaaaaaucaguucaagggaagu

SEQ ID NO: 8673 - RNA, 18 nt, Artificial Sequence
  Synthetic
ugagucugccagggcagu

SEQ ID NO: 8674 - RNA, 19 nt, Artificial Sequence
  Synthetic
gugagucugccagggcagu

SEQ ID NO: 8675 - RNA, 21 nt, Artificial Sequence
  Synthetic
aggugagucugccagggcagu

SEQ ID NO: 8676 - RNA, 22 nt, Artificial Sequence
  Synthetic
gaggugagucugccagggcagu

SEQ ID NO: 8677 - RNA, 23 nt, Artificial Sequence
  Synthetic
ggaggugagucugccagggcagu

SEQ ID NO: 8678 - RNA, 24 nt, Artificial Sequence
  Synthetic
uggaggugagucugccagggcagu

SEQ ID NO: 8679 - RNA, 18 nt, Artificial Sequence
  Synthetic
caugcacacacacagagu

SEQ ID NO: 8680 - RNA, 19 nt, Artificial Sequence
  Synthetic
gcaugcacacacacagagu

SEQ ID NO: 8681 - RNA, 21 nt, Artificial Sequence
  Synthetic
uggcaugcacacacacagagu

SEQ ID NO: 8682 - RNA, 22 nt, Artificial Sequence
  Synthetic
uuggcaugcacacacacagagu

SEQ ID NO: 8683 - RNA, 23 nt, Artificial Sequence
  Synthetic
cuuggcaugcacacacacagagu

SEQ ID NO: 8684 - RNA, 24 nt, Artificial Sequence
  Synthetic
ucuuggcaugcacacacacagagu

SEQ ID NO: 8685 - RNA, 18 nt, Artificial Sequence
  Synthetic
uguuuuaaagcuaggggu

SEQ ID NO: 8686 - RNA, 19 nt, Artificial Sequence
  Synthetic
uuguuuuaaagcuaggggu

SEQ ID NO: 8687 - RNA, 21 nt, Artificial Sequence
  Synthetic
aguuguuuuaaagcuaggggu

SEQ ID NO: 8688 - RNA, 22 nt, Artificial Sequence
  Synthetic
caguuguuuuaaagcuaggggu

SEQ ID NO: 8689 - RNA, 23 nt, Artificial Sequence
  Synthetic
acaguuguuuuaaagcuaggggu

SEQ ID NO: 8690 - RNA, 24 nt, Artificial Sequence
  Synthetic
cacaguuguuuuaaagcuaggggu

SEQ ID NO: 8691 - RNA, 18 nt, Artificial Sequence
  Synthetic
uucccugugauucucugu

SEQ ID NO: 8692 - RNA, 19 nt, Artificial Sequence
  Synthetic
cuucccugugauucucugu

SEQ ID NO: 8693 - RNA, 21 nt, Artificial Sequence
  Synthetic
cacuucccugugauucucugu

SEQ ID NO: 8694 - RNA, 22 nt, Artificial Sequence
  Synthetic
acacuucccugugauucucugu

SEQ ID NO: 8695 - RNA, 23 nt, Artificial Sequence
  Synthetic
aacacuucccugugauucucugu

SEQ ID NO: 8696 - RNA, 24 nt, Artificial Sequence
  Synthetic
gaacacuucccugugauucucugu

SEQ ID NO: 8697 - RNA, 18 nt, Artificial Sequence
  Synthetic
aaaagagagggauagugu

SEQ ID NO: 8698 - RNA, 19 nt, Artificial Sequence
  Synthetic
aaaaagagagggauagugu

SEQ ID NO: 8699 - RNA, 21 nt, Artificial Sequence
  Synthetic
agaaaaagagagggauagugu

SEQ ID NO: 8700 - RNA, 22 nt, Artificial Sequence
  Synthetic
aagaaaaagagagggauagugu

SEQ ID NO: 8701 - RNA, 23 nt, Artificial Sequence
  Synthetic
gaagaaaaagagagggauagugu

SEQ ID NO: 8702 - RNA, 24 nt, Artificial Sequence
  Synthetic
agaagaaaaagagagggauagugu

SEQ ID NO: 8703 - RNA, 18 nt, Artificial Sequence
  Synthetic
gaggcagggcuauauugu

SEQ ID NO: 8704 - RNA, 19 nt, Artificial Sequence
  Synthetic
ggaggcagggcuauauugu

SEQ ID NO: 8705 - RNA, 21 nt, Artificial Sequence
  Synthetic
uaggaggcagggcuauauugu

SEQ ID NO: 8706 - RNA, 22 nt, Artificial Sequence
  Synthetic
cuaggaggcagggcuauauugu

SEQ ID NO: 8707 - RNA, 23 nt, Artificial Sequence
  Synthetic
ucuaggaggcagggcuauauugu

SEQ ID NO: 8708 - RNA, 24 nt, Artificial Sequence
  Synthetic
uucuaggaggcagggcuauauugu

SEQ ID NO: 8709 - RNA, 18 nt, Artificial Sequence
  Synthetic
gcacaagacagaugaauu

SEQ ID NO: 8710 - RNA, 19 nt, Artificial Sequence
  Synthetic
agcacaagacagaugaauu

SEQ ID NO: 8711 - RNA, 20 nt, Artificial Sequence
  Synthetic
uagcacaagacagaugaauu

SEQ ID NO: 8712 - RNA, 21 nt, Artificial Sequence
  Synthetic
cuagcacaagacagaugaauu

SEQ ID NO: 8713 - RNA, 22 nt, Artificial Sequence
  Synthetic
gcuagcacaagacagaugaauu

SEQ ID NO: 8714 - RNA, 23 nt, Artificial Sequence
  Synthetic
agcuagcacaagacagaugaauu

SEQ ID NO: 8715 - RNA, 24 nt, Artificial Sequence
  Synthetic
cagcuagcacaagacagaugaauu

SEQ ID NO: 8716 - RNA, 18 nt, Artificial Sequence
  Synthetic
uuuacaagcugaguaauu

SEQ ID NO: 8717 - RNA, 19 nt, Artificial Sequence
  Synthetic
cuuuacaagcugaguaauu

SEQ ID NO: 8718 - RNA, 21 nt, Artificial Sequence
  Synthetic
uccuuuacaagcugaguaauu

SEQ ID NO: 8719 - RNA, 22 nt, Artificial Sequence
  Synthetic
uuccuuuacaagcugaguaauu

SEQ ID NO: 8720 - RNA, 23 nt, Artificial Sequence
  Synthetic
uuuccuuuacaagcugaguaauu

SEQ ID NO: 8721 - RNA, 24 nt, Artificial Sequence
  Synthetic
uuuuccuuuacaagcugaguaauu

SEQ ID NO: 8722 - RNA, 18 nt, Artificial Sequence
  Synthetic
acagaguaagaacugauu

SEQ ID NO: 8723 - RNA, 19 nt, Artificial Sequence
  Synthetic
cacagaguaagaacugauu

SEQ ID NO: 8724 - RNA, 21 nt, Artificial Sequence
  Synthetic
cacacagaguaagaacugauu

SEQ ID NO: 8725 - RNA, 22 nt, Artificial Sequence
  Synthetic
acacacagaguaagaacugauu

SEQ ID NO: 8726 - RNA, 23 nt, Artificial Sequence
  Synthetic
cacacacagaguaagaacugauu

SEQ ID NO: 8727 - RNA, 24 nt, Artificial Sequence
  Synthetic
acacacacagaguaagaacugauu

SEQ ID NO: 8728 - RNA, 18 nt, Artificial Sequence
  Synthetic
gauguuuacuaucugauu

SEQ ID NO: 8729 - RNA, 19 nt, Artificial Sequence
  Synthetic
cgauguuuacuaucugauu

SEQ ID NO: 8730 - RNA, 21 nt, Artificial Sequence
  Synthetic
agcgauguuuacuaucugauu

SEQ ID NO: 8731 - RNA, 22 nt, Artificial Sequence
  Synthetic
cagcgauguuuacuaucugauu

SEQ ID NO: 8732 - RNA, 23 nt, Artificial Sequence
  Synthetic
ucagcgauguuuacuaucugauu

SEQ ID NO: 8733 - RNA, 24 nt, Artificial Sequence
  Synthetic
uucagcgauguuuacuaucugauu

SEQ ID NO: 8734 - RNA, 18 nt, Artificial Sequence
  Synthetic
aggaggcagggcuauauu

SEQ ID NO: 8735 - RNA, 19 nt, Artificial Sequence
  Synthetic
uaggaggcagggcuauauu

SEQ ID NO: 8736 - RNA, 21 nt, Artificial Sequence
  Synthetic
ucuaggaggcagggcuauauu

SEQ ID NO: 8737 - RNA, 22 nt, Artificial Sequence
  Synthetic
uucuaggaggcagggcuauauu

SEQ ID NO: 8738 - RNA, 23 nt, Artificial Sequence
  Synthetic
guucuaggaggcagggcuauauu

SEQ ID NO: 8739 - RNA, 24 nt, Artificial Sequence
  Synthetic
gguucuaggaggcagggcuauauu

SEQ ID NO: 8740 - RNA, 18 nt, Artificial Sequence
  Synthetic
acuuaguuucuccuuauu

SEQ ID NO: 8741 - RNA, 19 nt, Artificial Sequence
  Synthetic
uacuuaguuucuccuuauu

SEQ ID NO: 8742 - RNA, 21 nt, Artificial Sequence
  Synthetic
auuacuuaguuucuccuuauu

SEQ ID NO: 8743 - RNA, 22 nt, Artificial Sequence
  Synthetic
gauuacuuaguuucuccuuauu

SEQ ID NO: 8744 - RNA, 23 nt, Artificial Sequence
  Synthetic
agauuacuuaguuucuccuuauu

SEQ ID NO: 8745 - RNA, 24 nt, Artificial Sequence
  Synthetic
aagauuacuuaguuucuccuuauu

SEQ ID NO: 8746 - RNA, 18 nt, Artificial Sequence
  Synthetic
aguugucaauugucccuu

SEQ ID NO: 8747 - RNA, 19 nt, Artificial Sequence
  Synthetic
aaguugucaauugucccuu

SEQ ID NO: 8748 - RNA, 20 nt, Artificial Sequence
  Synthetic
aaaguugucaauugucccuu

SEQ ID NO: 8749 - RNA, 21 nt, Artificial Sequence
  Synthetic
gaaaguugucaauugucccuu

SEQ ID NO: 8750 - RNA, 22 nt, Artificial Sequence
  Synthetic
agaaaguugucaauugucccuu

SEQ ID NO: 8751 - RNA, 23 nt, Artificial Sequence
  Synthetic
uagaaaguugucaauugucccuu

SEQ ID NO: 8752 - RNA, 24 nt, Artificial Sequence
  Synthetic
guagaaaguugucaauugucccuu

SEQ ID NO: 8753 - RNA, 18 nt, Artificial Sequence
  Synthetic
ccgagagccacaaugcuu

SEQ ID NO: 8754 - RNA, 19 nt, Artificial Sequence
  Synthetic
accgagagccacaaugcuu

SEQ ID NO: 8755 - RNA, 21 nt, Artificial Sequence
  Synthetic
ggaccgagagccacaaugcuu

SEQ ID NO: 8756 - RNA, 22 nt, Artificial Sequence
  Synthetic
aggaccgagagccacaaugcuu

SEQ ID NO: 8757 - RNA, 23 nt, Artificial Sequence
  Synthetic
caggaccgagagccacaaugcuu

SEQ ID NO: 8758 - RNA, 24 nt, Artificial Sequence
  Synthetic
ccaggaccgagagccacaaugcuu

SEQ ID NO: 8759 - RNA, 18 nt, Artificial Sequence
  Synthetic
aaauaagaauagaaucuu

SEQ ID NO: 8760 - RNA, 19 nt, Artificial Sequence
  Synthetic
caaauaagaauagaaucuu

SEQ ID NO: 8761 - RNA, 21 nt, Artificial Sequence
  Synthetic
aucaaauaagaauagaaucuu

SEQ ID NO: 8762 - RNA, 22 nt, Artificial Sequence
  Synthetic
aaucaaauaagaauagaaucuu

SEQ ID NO: 8763 - RNA, 23 nt, Artificial Sequence
  Synthetic
caaucaaauaagaauagaaucuu

SEQ ID NO: 8764 - RNA, 24 nt, Artificial Sequence
  Synthetic
ccaaucaaauaagaauagaaucuu

SEQ ID NO: 8765 - RNA, 18 nt, Artificial Sequence
  Synthetic
gagucugccagggcaguu

SEQ ID NO: 8766 - RNA, 19 nt, Artificial Sequence
  Synthetic
ugagucugccagggcaguu

SEQ ID NO: 8767 - RNA, 21 nt, Artificial Sequence
  Synthetic
ggugagucugccagggcaguu

SEQ ID NO: 8768 - RNA, 22 nt, Artificial Sequence
  Synthetic
aggugagucugccagggcaguu

SEQ ID NO: 8769 - RNA, 23 nt, Artificial Sequence
  Synthetic
gaggugagucugccagggcaguu

SEQ ID NO: 8770 - RNA, 24 nt, Artificial Sequence
  Synthetic
ggaggugagucugccagggcaguu

SEQ ID NO: 8771 - RNA, 18 nt, Artificial Sequence
  Synthetic
ucugugaggggggauguu

SEQ ID NO: 8772 - RNA, 19 nt, Artificial Sequence
  Synthetic
cucugugaggggggauguu

SEQ ID NO: 8773 - RNA, 21 nt, Artificial Sequence
  Synthetic
uucucugugaggggggauguu

SEQ ID NO: 8774 - RNA, 22 nt, Artificial Sequence
  Synthetic
auucucugugaggggggauguu

SEQ ID NO: 8775 - RNA, 23 nt, Artificial Sequence
  Synthetic
gauucucugugaggggggauguu

SEQ ID NO: 8776 - RNA, 24 nt, Artificial Sequence
  Synthetic
ugauucucugugaggggggauguu

SEQ ID NO: 8777 - RNA, 18 nt, Artificial Sequence
  Synthetic
uuaaaaugaccuuuauuu

SEQ ID NO: 8778 - RNA, 19 nt, Artificial Sequence
  Synthetic
guuaaaaugaccuuuauuu

SEQ ID NO: 8779 - RNA, 20 nt, Artificial Sequence
  Synthetic
uguuaaaaugaccuuuauuu

SEQ ID NO: 8780 - RNA, 21 nt, Artificial Sequence
  Synthetic
auguuaaaaugaccuuuauuu

SEQ ID NO: 8781 - RNA, 22 nt, Artificial Sequence
  Synthetic
gauguuaaaaugaccuuuauuu

SEQ ID NO: 8782 - RNA, 23 nt, Artificial Sequence
  Synthetic
ugauguuaaaaugaccuuuauuu

SEQ ID NO: 8783 - RNA, 24 nt, Artificial Sequence
  Synthetic
uugauguuaaaaugaccuuuauuu

SEQ ID NO: 8784 - RNA, 18 nt, Artificial Sequence
  Synthetic
auauuugaaaacaucuuu

SEQ ID NO: 8785 - RNA, 19 nt, Artificial Sequence
  Synthetic
uauauuugaaaacaucuuu

SEQ ID NO: 8786 - RNA, 21 nt, Artificial Sequence
  Synthetic
uauauauuugaaaacaucuuu

SEQ ID NO: 8787 - RNA, 22 nt, Artificial Sequence
  Synthetic
uuauauauuugaaaacaucuuu

SEQ ID NO: 8788 - RNA, 23 nt, Artificial Sequence
  Synthetic
uuuauauauuugaaaacaucuuu

SEQ ID NO: 8789 - RNA, 24 nt, Artificial Sequence
  Synthetic
uuuuauauauuugaaaacaucuuu

SEQ ID NO: 8790 - RNA, 18 nt, Artificial Sequence
  Synthetic
uugaaaaacuauccuuuu

SEQ ID NO: 8791 - RNA, 19 nt, Artificial Sequence
  Synthetic
uuugaaaaacuauccuuuu

SEQ ID NO: 8792 - RNA, 20 nt, Artificial Sequence
  Synthetic
uuuugaaaaacuauccuuuu

SEQ ID NO: 8793 - RNA, 21 nt, Artificial Sequence
  Synthetic
cuuuugaaaaacuauccuuuu

SEQ ID NO: 8794 - RNA, 22 nt, Artificial Sequence
  Synthetic
ccuuuugaaaaacuauccuuuu

SEQ ID NO: 8795 - RNA, 23 nt, Artificial Sequence
  Synthetic
cccuuuugaaaaacuauccuuuu

SEQ ID NO: 8796 - RNA, 24 nt, Artificial Sequence
  Synthetic
ucccuuuugaaaaacuauccuuuu

SEQ ID NO: 8797 - RNA, 18 nt, Artificial Sequence
  Synthetic
gacuauaugauugguuuu

SEQ ID NO: 8798 - RNA, 19 nt, Artificial Sequence
  Synthetic
ugacuauaugauugguuuu

SEQ ID NO: 8799 - RNA, 21 nt, Artificial Sequence
  Synthetic
gcugacuauaugauugguuuu

SEQ ID NO: 8800 - RNA, 22 nt, Artificial Sequence
  Synthetic
ugcugacuauaugauugguuuu

SEQ ID NO: 8801 - RNA, 23 nt, Artificial Sequence
  Synthetic
uugcugacuauaugauugguuuu

SEQ ID NO: 8802 - RNA, 24 nt, Artificial Sequence
  Synthetic
cuugcugacuauaugauugguuuu

SEQ ID NO: 8803 - RNA, 17 nt, Artificial Sequence
  Synthetic
gcgcugcagcuggccug

SEQ ID NO: 8804 - RNA, 20 nt, Artificial Sequence
  Synthetic
gcgcugugacugauggagga

SEQ ID NO: 8805 - RNA, 20 nt, Artificial Sequence
  Synthetic
guuaucacucucuagggacc

SEQ ID NO: 8806 - RNA, 17 nt, Artificial Sequence
  Synthetic
cugugacugauggagga

SEQ ID NO: 8807 - RNA, 17 nt, Artificial Sequence
  Synthetic
aacggccuaggaaauga

SEQ ID NO: 8808 - RNA, 17 nt, Artificial Sequence
  Synthetic
aucacucucuagggacc

SEQ ID NO: 8809 - RNA, 17 nt, Artificial Sequence
  Synthetic
cggggcugggaguuuuc

SEQ ID NO: 8810 - RNA, 17 nt, Artificial Sequence
  Synthetic
acaacacugaacaucug

SEQ ID NO: 8811 - RNA, 17 nt, Artificial Sequence
  Synthetic
cacgaagguagggcagu

SEQ ID NO: 8812 - RNA, 20 nt, Artificial Sequence
  Synthetic
auuaacggccuaggaaauga

SEQ ID NO: 8813 - RNA, 20 nt, Artificial Sequence
  Synthetic
ucacggggcugggaguuuuc

SEQ ID NO: 8814 - RNA, 20 nt, Artificial Sequence
  Synthetic
acagcgcugcagcuggccug

SEQ ID NO: 8815 - RNA, 20 nt, Artificial Sequence
  Synthetic
ugaacaacacugaacaucug

SEQ ID NO: 8816 - RNA, 20 nt, Artificial Sequence
  Synthetic
cuccacgaagguagggcagu

SEQ ID NO: 8817 - RNA, 17 nt, Artificial Sequence
  Synthetic
gagccuuuuuaucuuuu

SEQ ID NO: 8818 - RNA, 20 nt, Artificial Sequence
  Synthetic
ugugagccuuuuuaucuuuu

SEQ ID NO: 8819 - RNA, 17 nt, Artificial Sequence
  Synthetic
uccaggaccgagagcca

SEQ ID NO: 8820 - RNA, 17 nt, Artificial Sequence
  Synthetic
ugaggacugauggagca

SEQ ID NO: 8821 - RNA, 17 nt, Artificial Sequence
  Synthetic
agcuccugagagcuuca

SEQ ID NO: 8822 - RNA, 17 nt, Artificial Sequence
  Synthetic
aggcaaucauuauuuca

SEQ ID NO: 8823 - RNA, 17 nt, Artificial Sequence
  Synthetic
cucagcccuguggugga

SEQ ID NO: 8824 - RNA, 17 nt, Artificial Sequence
  Synthetic
ugacuugcucagaauua

SEQ ID NO: 8825 - RNA, 17 nt, Artificial Sequence
  Synthetic
cauauagucagcaagac

SEQ ID NO: 8826 - RNA, 17 nt, Artificial Sequence
  Synthetic
agauuuccccccucacc

SEQ ID NO: 8827 - RNA, 17 nt, Artificial Sequence
  Synthetic
auuuauuggcuauugcc

SEQ ID NO: 8828 - RNA, 17 nt, Artificial Sequence
  Synthetic
gggugaggggggaaauc

SEQ ID NO: 8829 - RNA, 17 nt, Artificial Sequence
  Synthetic
uuuccucauucaaauuc

SEQ ID NO: 8830 - RNA, 17 nt, Artificial Sequence
  Synthetic
auacuugaaggugaucg

SEQ ID NO: 8831 - RNA, 17 nt, Artificial Sequence
  Synthetic
accuaggcuugaaucug

SEQ ID NO: 8832 - RNA, 17 nt, Artificial Sequence
  Synthetic
ccuuuuuugaaccuuug

SEQ ID NO: 8833 - RNA, 17 nt, Artificial Sequence
  Synthetic
gacuguagguuaauaau

SEQ ID NO: 8834 - RNA, 17 nt, Artificial Sequence
  Synthetic
cuaguaauuuagcuccu

SEQ ID NO: 8835 - RNA, 17 nt, Artificial Sequence
  Synthetic
uuguaaaugucucaagu

SEQ ID NO: 8836 - RNA, 17 nt, Artificial Sequence
  Synthetic
ugcagagacuaacuggu

SEQ ID NO: 8837 - RNA, 17 nt, Artificial Sequence
  Synthetic
uuggcaaaugccauugu

SEQ ID NO: 8838 - RNA, 20 nt, Artificial Sequence
  Synthetic
gacuccaggaccgagagcca

SEQ ID NO: 8839 - RNA, 20 nt, Artificial Sequence
  Synthetic
cagugaggacugauggagca

SEQ ID NO: 8840 - RNA, 20 nt, Artificial Sequence
  Synthetic
uuuagcuccugagagcuuca

SEQ ID NO: 8841 - RNA, 20 nt, Artificial Sequence
  Synthetic
caaaggcaaucauuauuuca

SEQ ID NO: 8842 - RNA, 20 nt, Artificial Sequence
  Synthetic
cuacucagcccuguggugga

SEQ ID NO: 8843 - RNA, 20 nt, Artificial Sequence
  Synthetic
uugugacuugcucagaauua

SEQ ID NO: 8844 - RNA, 20 nt, Artificial Sequence
  Synthetic
aaucauauagucagcaagac

SEQ ID NO: 8845 - RNA, 20 nt, Artificial Sequence
  Synthetic
ggcagauuuccccccucacc

SEQ ID NO: 8846 - RNA, 20 nt, Artificial Sequence
  Synthetic
uauauuuauuggcuauugcc

SEQ ID NO: 8847 - RNA, 20 nt, Artificial Sequence
  Synthetic
uaggggugaggggggaaauc

SEQ ID NO: 8848 - RNA, 20 nt, Artificial Sequence
  Synthetic
uuuuuuccucauucaaauuc

SEQ ID NO: 8849 - RNA, 20 nt, Artificial Sequence
  Synthetic
guaauacuugaaggugaucg

SEQ ID NO: 8850 - RNA, 20 nt, Artificial Sequence
  Synthetic
aagaccuaggcuugaaucug

SEQ ID NO: 8851 - RNA, 20 nt, Artificial Sequence
  Synthetic
uauccuuuuuugaaccuuug

SEQ ID NO: 8852 - RNA, 20 nt, Artificial Sequence
  Synthetic
cuggacuguagguuaauaau

SEQ ID NO: 8853 - RNA, 20 nt, Artificial Sequence
  Synthetic
cauuuguaaaugucucaagu

SEQ ID NO: 8854 - RNA, 20 nt, Artificial Sequence
  Synthetic
gaaugcagagacuaacuggu

SEQ ID NO: 8855 - RNA, 20 nt, Artificial Sequence
  Synthetic
uuauuggcaaaugccauugu

SEQ ID NO: 8856 - DNA, 1100 bp, Artificial Sequence
  Synthetic
ttgcaccactgcactccagcctaggtaacagtgcaagaccctgtctcaaaaaataattattttcatgtttattatattaaaatgatgtatgaaatatgtgactcatcagggcttgaaaaactttgttgtatggagattattcttatgagttgatttttctctctcctaccttatagtaatgaaataaaccaggcatgaaagtcacaataagtaatacaatgaacacccatgggtccctgcccagcttaagtagaatattacaaatgcagttgaagccctctgtgcaactttcatccttacaactgatactgagtgaattgtactttaaatattttatagctcccactcccatgcatgcccctcagtgatagcaataattgtcaataacatgaaacacagattgatcatatagcatttaccatatatttactctataccaagcacttaacatatataattacatttaaaatttacaacagccctactacccaaaacactattagtatccccttttacaaatgcgataactgaggcgtagagagctaagtaacttactgaaagtcacacagccagcgggtggtagagcctagctttaaacccagacgatttgtctccagggctgtcacatctactggctctgccaagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcc

SEQ ID NO: 8857 - DNA, 1101 bp, Artificial Sequence
  Synthetic
gtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaacgttctcttccttgaactttgtgggaatctttgcttaagagaaggatatagattccaaccatcaggtaattccttcaggttgggagatgtgattgcaggatgttaaaggtggtgtgtgtgtgtgtgtgtgtgtgtgtaactgagaggcttgtgcctggttttgaggtgctgcccaggatgacgccaa

SEQ ID NO: 8858 - DNA, 2202 bp, Artificial Sequence
  Synthetic
ttgcaccactgcactccagcctaggtaacagtgcaagaccctgtctcaaaaaataattattttcatgtttattatattaaaatgatgtatgaaatatgtgactcatcagggcttgaaaaactttgttgtatggagattattcttatgagttgatttttctctctcctaccttatagtaatgaaataaaccaggcatgaaagtcacaataagtaatacaatgaacacccatgggtccctgcccagcttaagtagaatattacaaatgcagttgaagccctctgtgcaactttcatccttacaactgatactgagtgaattgtactttaaatattttatagctcccactcccatgcatgcccctcagtgatagcaataattgtcaataacatgaaacacagattgatcatatagcatttaccatatatttactctataccaagcacttaacatatataattacatttaaaatttacaacagccctactacccaaaacactattagtatccccttttacaaatgcgataactgaggcgtagagagctaagtaacttactgaaagtcacacagccagcgggtggtagagcctagctttaaacccagacgatttgtctccagggctgtcacatctactggctctgccaagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaacgttctcttccttgaactttgtgggaatctttgcttaagagaaggatatagattccaaccatcaggtaattccttcaggttgggagatgtgattgcaggatgttaaaggtggtgtgtgtgtgtgtgtgtgtgtgtgtaactgagaggcttgtgcctggttttgaggtgctgcccaggatgacgccaa

SEQ ID NO: 8859 - DNA, 1560 bp, Artificial Sequence
  Synthetic
aagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaacgttctcttccttgaactttgtgggaatctttgcttaagagaaggatatagattccaaccatcaggtaattccttcaggttgggagatgtgattgcaggatgttaaaggtggtgtgtgtgtgtgtgtgtgtgtgtgtaactgagaggcttgtgcctggttttgaggtgctgcccaggatgacgccaa

SEQ ID NO: 8860 - DNA, 1201 bp, Artificial Sequence
  Synthetic
gaacacccatgggtccctgcccagcttaagtagaatattacaaatgcagttgaagccctctgtgcaactttcatccttacaactgatactgagtgaattgtactttaaatattttatagctcccactcccatgcatgcccctcagtgatagcaataattgtcaataacatgaaacacagattgatcatatagcatttaccatatatttactctataccaagcacttaacatatataattacatttaaaatttacaacagccctactacccaaaacactattagtatccccttttacaaatgcgataactgaggcgtagagagctaagtaacttactgaaagtcacacagccagcgggtggtagagcctagctttaaacccagacgatttgtctccagggctgtcacatctactggctctgccaagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatga

SEQ ID NO: 8861 - DNA, 1200 bp, Artificial Sequence
  Synthetic
aagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaacgttctcttccttgaactttgtgggaatctttgcttaagagaaggatatagattccaaccatcaggtaattccttcaggttgggagatgtgattgcaggatgttaaaggtggtgtgtgtgtgtgtgtgtgtgtgtgtaactgagaggcttgtgcctggttttgaggtgctgcccaggatgacgccaagcaaatagcagcatccacactttcccacctccatctcctggtgctctcggcactaccggagcaatctttccatctctcccctgaacccaccctctattcaccctaactccacttcagtttgcttttgatttttttttttttttttttttttttttgagatggagtctcgctctgtcacccaggctggagtgcagtggcacgatctcggctcactgcaagttccgcctcccaggttcacaccattctcctgcctcagcctcccaagtagctgggactacaggcgcctgccaccacgcctggctaattttttttttttccagtgaagatggggtttcaccatgttagccaggatggtctcgatctcctgaccttgtcatccacccaccttggcctcccaaagtgctgggattacaggcgtgagccaccacgcccagcccctccacttcagtttttatctgtcatcaggggtatgaattttataagccacaacctcagg

SEQ ID NO: 8862 - DNA, 2481 bp, Artificial Sequence
  Synthetic
gaacacccatgggtccctgcccagcttaagtagaatattacaaatgcagttgaagccctctgtgcaactttcatccttacaactgatactgagtgaattgtactttaaatattttatagctcccactcccatgcatgcccctcagtgatagcaataattgtcaataacatgaaacacagattgatcatatagcatttaccatatatttactctataccaagcacttaacatatataattacatttaaaatttacaacagccctactacccaaaacactattagtatccccttttacaaatgcgataactgaggcgtagagagctaagtaacttactgaaagtcacacagccagcgggtggtagagcctagctttaaacccagacgatttgtctccagggctgtcacatctactggctctgccaagcttccgcatgatcattgtctgtgtttggaaagattatggattaagtggtgcttcgttttcttttctgaatttaccaggatgtggagaactagtttgggtaggagagcctctcacgctgagaacagcagaaacaattactggcaagtatggtgtgtggatgcgagaccccaagcccacctacccctacacccaggagaccacgtggagaatcgacacagttggcacggatgtccgccaggtttttgagtatgacctcatcagccagtttatgcagggctacccttctaaggttcacatactgcctaggccactggaaagcacgggtgctgtggtgtactcggggagcctctatttccagggcgctgagtccagaactgtcataagatatgagctgaataccgagacagtgaaggctgagaaggaaatccctggagctggctaccacggacagttcccgtattcttggggtggctacacggacattgacttggctgtggatgaagcaggcctctgggtcatttacagcaccgatgaggccaaaggtgccattgtcctctccaaactgaacccagagaatctggaactcgaacaaacctgggagacaaacatccgtaagcagtcagtcgccaatgccttcatcatctgtggcaccttgtacaccgtcagcagctacacctcagcagatgctaccgtcaactttgcttatgacacaggcacaggtatcagcaagaccctgaccatcccattcaagaaccgctataagtacagcagcatgattattgactacaaccccctggagaagaagctctttgcctgggacaacttgaacatggtcacttatgacatcaagctctccaagatgtgaaaagcctccaagctgtacaggcaatggcagaaggagatgctcagggctcctggggggagcaggctgaagggagagccagccagccagggcccaggcagctttgactgctttccaagttttcattaatccagaaggatgaacatggtcaccatctaactattcaggaattgtagtctgagggcgtagacaatttcatataataaatatcctttatcttctgtcagcatttatgggatgtttaatgacatagttcaagttttcttgtgatttggggcaaaagctgtaaggcataatagtttcttcctgaaaaccattgctcttgcatgttacatggttaccacaagccacaataaaaagcataacttctaaaggaagcagaatagctcctctggccagcatcgaatataagtaagatgcatttactacagttggcttctaatgcttcagatagaatacagttgggtctcacataaccctttacattgtgaaataaaattttcttacccaacgttctcttccttgaactttgtgggaatctttgcttaagagaaggatatagattccaaccatcaggtaattccttcaggttgggagatgtgattgcaggatgttaaaggtggtgtgtgtgtgtgtgtgtgtgtgtgtaactgagaggcttgtgcctggttttgaggtgctgcccaggatgacgccaagcaaatagcagcatccacactttcccacctccatctcctggtgctctcggcactaccggagcaatctttccatctctcccctgaacccaccctctattcaccctaactccacttcagtttgcttttgatttttttttttttttttttttttttttgagatggagtctcgctctgtcacccaggctggagtgcagtggcacgatctcggctcactgcaagttccgcctcccaggttcacaccattctcctgcctcagcctcccaagtagctgggactacaggcgcctgccaccacgcctggctaattttttttttttccagtgaagatggggtttcaccatgttagccaggatggtctcgatctcctgaccttgtcatccacccaccttggcctcccaaagtgctgggattacaggcgtgagccaccacgcccagcccctccacttcagtttttatctgtcatcaggggtatgaattttataagccacaacctcagg

SEQ ID NO: 8863 - DNA, 80 bp, Artificial Sequence
  Synthetic
ttattgactacaaccccctggagaagaagctctttgcctgggacaacttgaacatggtcacttatgacatcaagctctcc

SEQ ID NO: 8864 - DNA, 2481 bp, Artificial Sequence; identical to SEQ ID NO: 8862
  Synthetic

SEQ ID NO: 8865 - DNA, 82 bp, Artificial Sequence
  Synthetic
ttattgactacaaccccctggagaagaagctctttgcctgggacaacttgaacatggtcacttatgacatcaagctctccaa

What is claimed is:

1. A method of altering a cell comprising contacting the cell with:

(a) a first guide (gRNA) molecule comprising a first targeting domain which is complementary with a first target domain from the MYOC gene, wherein the first target domain is located within 500 bp of a start codon of the MYOC gene, wherein the first targeting domain is configured to provide a double strand break in a region of the MYOC gene which is complementary to a sequence that is the same as, or differs by no more than 3 nucleotides from, a nucleic acid sequence of SEQ ID NO:499 in the presence of a Cas9 molecule, and wherein the double strand break results in knockout of the MYOC gene; and (b) the Cas9 molecule.

2. The method of claim 1, wherein the cell is present in a subject suffering from Primary Open Angle Glaucoma (POAG).

3. The method of claim 1, wherein the cell is present in a subject having a mutation at a POAG target position of the MYOC gene.

4. The method of claim 1, wherein the cell is a trabecular meshwork cell or a retinal pigment cell.

5. The method of claim 1, wherein the contacting step is performed ex vivo.

6. The method of claim 1, wherein the contacted cell is returned to a subject's body.

7. The method of claim 1, wherein the contacting step is performed in vivo.

8. The method of claim 1, wherein the contacting step comprises contacting the cell with a nucleic acid that encodes at least one of (a) and (b).

9. The method of claim 8, wherein the contacting step is selected from the group consisting of: (i) delivering to the cell the Cas9 molecule of (b) and a nucleic acid which encodes the first gRNA molecule of (a), (ii) delivering to the cell the first gRNA molecule of (a) and a nucleic acid which encodes the Cas9 molecule of (b), and (iii) delivering to the cell a nucleic acid which encodes the first gRNA molecule of (a) and a nucleic acid encoding the Cas9 molecule of (b).

10. The method of claim 1, wherein the first targeting domain comprises a guanine (G) at a 5' end of the first targeting domain.

11. The method of claim 1, wherein the cell is an ocular cell.

* * * * *